(12) United States Patent
Hatchwell et al.

(10) Patent No.: US 10,724,096 B2
(45) Date of Patent: Jul. 28, 2020

(54) METHODS AND COMPOSITIONS FOR INHIBITING AND TREATING NEUROLOGICAL CONDITIONS

(71) Applicant: POPULATION BIO, INC., Melville, NY (US)

(72) Inventors: Eli Hatchwell, Winchester (GB); Peggy Eis, Fitchburg, WI (US)

(73) Assignee: POPULATION BIO, INC., Melville, NY (US)

( * ) Notice: Subject to any disclaimer, the term of this patent is extended or adjusted under 35 U.S.C. 154(b) by 34 days.

(21) Appl. No.: 15/508,846

(22) PCT Filed: Sep. 4, 2015

(86) PCT No.: PCT/US2015/000093
§ 371 (c)(1),
(2) Date: Mar. 3, 2017

(87) PCT Pub. No.: WO2016/036403
PCT Pub. Date: Mar. 10, 2016

(65) Prior Publication Data
US 2017/0253930 A1    Sep. 7, 2017

Related U.S. Application Data

(60) Provisional application No. 62/070,798, filed on Sep. 5, 2014.

(51) Int. Cl.
*C12Q 1/6883* (2018.01)

(52) U.S. Cl.
CPC ..... *C12Q 1/6883* (2013.01); *C12Q 2600/156* (2013.01)

(58) Field of Classification Search
None
See application file for complete search history.

(56) References Cited

U.S. PATENT DOCUMENTS

| | | |
|---|---|---|
| 3,625,214 A | 12/1971 | Takeru |
| 4,683,195 A | 7/1987 | Mullis et al. |
| 4,789,734 A | 12/1988 | Pierschbacher |
| 4,897,268 A | 1/1990 | Tice et al. |
| 4,906,474 A | 3/1990 | Langer et al. |
| 4,925,673 A | 5/1990 | Steiner et al. |
| 4,992,445 A | 2/1991 | Lawter et al. |
| 5,001,139 A | 3/1991 | Lawter et al. |
| 5,023,252 A | 6/1991 | Hseih |
| 5,075,109 A | 12/1991 | Tice et al. |
| 5,143,854 A | 9/1992 | Pirrung et al. |
| 5,190,029 A | 3/1993 | Byron et al. |
| 5,223,409 A | 6/1993 | Ladner et al. |
| 5,272,071 A | 12/1993 | Chappel |
| 5,288,514 A | 2/1994 | Ellman |
| 5,376,359 A | 12/1994 | Johnson |
| 5,384,261 A | 1/1995 | Winkler et al. |
| 5,424,186 A | 6/1995 | Fodor et al. |
| 5,445,934 A | 8/1995 | Fodor et al. |
| 5,451,683 A | 9/1995 | Barrett et al. |
| 5,510,270 A | 4/1996 | Fodor et al. |
| 5,527,681 A | 6/1996 | Holmes |
| 5,665,549 A | 9/1997 | Pinkel et al. |
| 5,700,637 A | 12/1997 | Southern |
| 5,744,305 A | 4/1998 | Fodor et al. |
| 5,776,434 A | 7/1998 | Purewal et al. |
| 5,811,128 A | 9/1998 | Tice et al. |
| 5,814,344 A | 9/1998 | Tice et al. |
| 5,820,883 A | 10/1998 | Tice et al. |
| 5,837,832 A | 11/1998 | Chee et al. |
| 5,853,763 A | 12/1998 | Tice et al. |
| 5,858,659 A | 1/1999 | Sapolsky et al. |
| 5,928,647 A | 7/1999 | Rock |
| 5,942,252 A | 8/1999 | Tice et al. |
| 5,945,334 A | 8/1999 | Besemer et al. |
| 6,040,138 A | 3/2000 | Lockhart et al. |
| 6,054,270 A | 4/2000 | Southern |
| 6,146,834 A | 11/2000 | Schaad et al. |
| 6,207,392 B1 | 3/2001 | Weiss et al. |
| 6,210,878 B1 | 4/2001 | Pinkel et al. |
| 6,251,607 B1 | 6/2001 | Tsen et al. |
| 6,300,063 B1 | 10/2001 | Lipshutz et al. |
| 6,423,499 B1 | 7/2002 | Song et al. |
| 6,429,027 B1 | 8/2002 | Chee et al. |
| 6,733,977 B2 | 5/2004 | Besemer et al. |
| 6,858,394 B1 | 2/2005 | Chee et al. |
| 6,858,412 B2 | 2/2005 | Willis et al. |
| 6,892,141 B1 | 5/2005 | Nakae et al. |
| 6,916,621 B2 | 7/2005 | Shah |

(Continued)

FOREIGN PATENT DOCUMENTS

| | | |
|---|---|---|
| CN | 1733937 A | 2/2006 |
| CN | 101148684 A | 3/2008 |

(Continued)

OTHER PUBLICATIONS

Kwee et al PLoS One. Mar. 2012. 7(3): e32768.*
Toft et al Genome Medicine. 2010. 2: 62, pp. 1-4.*
Abravaya, et al. Detection of point mutations with a modified ligase chain reaction (Gap-LCR). Nucleic Acids Research. 1995;23(4):675-682.
Agami, R. RNAi and related mechanisms and their potential use for therapy. Curr Opin Chem Biol. Dec. 2002;6(6):829-34.
Agarwal et al., Novelty in the target landscape of the pharmaceutical. Nat. Rev. Drug Discovery 12(8):575-6 (2013).
Aitman, et al. Copy number polymorphism in Fcgr3 predisposes to glomerulonephritis in rats and humans. Nature. Feb. 16, 2006;439(7078):851-5.
Albertson, et al. Profiling breast cancer by array CGH. Breast Cancer Res Treat. Apr. 2003;78(3):289-98.

(Continued)

*Primary Examiner* — Carla J Myers
(74) *Attorney, Agent, or Firm* — Wilson Sonsini Goodrich & Rosati

(57) ABSTRACT

This document provides methods and materials related to treating subjects having specific genetic variations associated with neurological disorders such as Parkinson's disease.

17 Claims, 633 Drawing Sheets
Specification includes a Sequence Listing.

(56) References Cited

U.S. PATENT DOCUMENTS

| | | |
|---|---|---|
| 6,951,761 B2 | 10/2005 | Star et al. |
| 6,969,589 B2 | 11/2005 | Patil et al. |
| 6,977,148 B2 | 12/2005 | Dean et al. |
| 7,011,949 B2 | 3/2006 | Amorese et al. |
| 7,014,997 B2 | 3/2006 | Knoll et al. |
| 7,030,231 B1 | 4/2006 | Craik et al. |
| 7,034,144 B2 | 4/2006 | Maria et al. |
| 7,238,484 B2 | 7/2007 | Pinkel et al. |
| 7,364,858 B2 | 4/2008 | Barany et al. |
| 7,424,368 B2 | 9/2008 | Huang et al. |
| 7,702,468 B2 | 4/2010 | Chinitz et al. |
| 7,910,353 B2 | 3/2011 | Shaffer et al. |
| 7,957,913 B2 | 6/2011 | Chinitz et al. |
| 8,655,599 B2 | 2/2014 | Chinitz et al. |
| 8,862,410 B2 | 10/2014 | Hatchwell et al. |
| 2002/0012921 A1 | 1/2002 | Stanton |
| 2002/0012930 A1 | 1/2002 | Rothberg et al. |
| 2003/0023070 A1 | 1/2003 | Ni et al. |
| 2003/0049663 A1 | 3/2003 | Wigler et al. |
| 2003/0068629 A1 | 4/2003 | Rothberg et al. |
| 2003/0082606 A1 | 5/2003 | Lebo et al. |
| 2003/0100102 A1 | 5/2003 | Rothberg et al. |
| 2003/0148344 A1 | 8/2003 | Rothberg et al. |
| 2003/0207295 A1 | 11/2003 | Gunderson et al. |
| 2003/0215821 A1 | 11/2003 | Gunderson et al. |
| 2004/0018491 A1 | 1/2004 | Gunderson et al. |
| 2004/0137473 A1 | 7/2004 | Wigler et al. |
| 2004/0157243 A1 | 8/2004 | Huang et al. |
| 2004/0197774 A1 | 10/2004 | Wigler et al. |
| 2004/0248161 A1 | 12/2004 | Rothberg et al. |
| 2005/0032095 A1 | 2/2005 | Wigler et al. |
| 2005/0037393 A1 | 2/2005 | Gunderson et al. |
| 2005/0037414 A1 | 2/2005 | Lee et al. |
| 2005/0079510 A1 | 4/2005 | Berka et al. |
| 2005/0100893 A1 | 5/2005 | Gunderson et al. |
| 2005/0100932 A1 | 5/2005 | Lapidus et al. |
| 2005/0112595 A1 | 5/2005 | Zhao |
| 2005/0124022 A1 | 6/2005 | Srinivasan et al. |
| 2005/0196799 A1 | 9/2005 | Wigler et al. |
| 2005/0233339 A1 | 10/2005 | Barrett et al. |
| 2005/0266444 A1 | 12/2005 | Wigler et al. |
| 2006/0012784 A1 | 1/2006 | Ulmer |
| 2006/0012793 A1 | 1/2006 | Harris |
| 2006/0024678 A1 | 2/2006 | Buzby |
| 2006/0024711 A1 | 2/2006 | Lapidus et al. |
| 2006/0063168 A1 | 3/2006 | Albertson et al. |
| 2006/0078909 A1 | 4/2006 | Srinivasan et al. |
| 2006/0134674 A1 | 6/2006 | Huang et al. |
| 2007/0141577 A1 | 6/2007 | Moore |
| 2007/0207481 A1 | 9/2007 | Wigler et al. |
| 2007/0259351 A1 | 11/2007 | Chinitz et al. |
| 2009/0026082 A1 | 1/2009 | Rothberg et al. |
| 2009/0127589 A1 | 5/2009 | Rothberg et al. |
| 2009/0304653 A1 | 12/2009 | Messier |
| 2010/0003685 A1 | 1/2010 | Aasly et al. |
| 2010/0028931 A1 | 2/2010 | Eggan et al. |
| 2010/0035252 A1 | 2/2010 | Rothberg et al. |
| 2010/0120046 A1 | 5/2010 | Brennan et al. |
| 2010/0137143 A1 | 6/2010 | Rothberg et al. |
| 2010/0167286 A1 | 7/2010 | Reijo et al. |
| 2010/0188073 A1 | 7/2010 | Rothberg et al. |
| 2010/0197507 A1 | 8/2010 | Rothberg et al. |
| 2010/0227768 A1 | 9/2010 | Wigler et al. |
| 2010/0248236 A1 | 9/2010 | Chinitz et al. |
| 2011/0021366 A1 | 1/2011 | Chinitz et al. |
| 2011/0111014 A1 | 5/2011 | Langston |
| 2011/0130337 A1 | 6/2011 | Eriksson et al. |
| 2011/0264376 A1 | 10/2011 | Chinitz et al. |
| 2011/0311512 A1 | 12/2011 | Hakonarson et al. |
| 2012/0059594 A1 | 3/2012 | Hatchwell et al. |
| 2012/0100995 A1 | 4/2012 | Scherer et al. |
| 2013/0316911 A1 | 11/2013 | Scherer |
| 2014/0088882 A1 | 3/2014 | Chinitz et al. |
| 2014/0155271 A1 | 6/2014 | Hatchwell et al. |
| 2014/0161721 A1 | 6/2014 | Hatchwell et al. |
| 2014/0162894 A1 | 6/2014 | Hatchwell et al. |
| 2014/0162933 A1 | 6/2014 | Hatchwell et al. |
| 2015/0051086 A1 | 2/2015 | Hatchwell et al. |
| 2016/0019336 A1 | 1/2016 | Chinitz et al. |

FOREIGN PATENT DOCUMENTS

| | | |
|---|---|---|
| CN | 101403008 A | 4/2009 |
| EP | 0373203 B1 | 8/1994 |
| EP | 0619321 A1 | 10/1994 |
| KR | 20090080105 A | 7/2009 |
| KR | 20110114664 A | 10/2011 |
| WO | WO-9002809 A1 | 3/1990 |
| WO | WO-9106667 A1 | 5/1991 |
| WO | WO-9117271 A1 | 11/1991 |
| WO | WO-9201047 A1 | 1/1992 |
| WO | WO-9209690 A2 | 6/1992 |
| WO | WO-9210092 A1 | 6/1992 |
| WO | WO-9215679 A1 | 9/1992 |
| WO | WO-9218619 A1 | 10/1992 |
| WO | WO-9220791 A1 | 11/1992 |
| WO | WO-9209690 A3 | 12/1992 |
| WO | WO-9301288 A1 | 1/1993 |
| WO | WO-9322684 A1 | 11/1993 |
| WO | WO-9511995 A1 | 5/1995 |
| WO | WO-9820019 A1 | 5/1998 |
| WO | WO-02099129 A2 | 12/2002 |
| WO | WO-03048318 A2 | 6/2003 |
| WO | WO-2004018633 A2 | 3/2004 |
| WO | WO-2004044225 A2 | 5/2004 |
| WO | WO-2004075010 A2 | 9/2004 |
| WO | WO-2005042763 A2 | 5/2005 |
| WO | WO-2005068664 A2 | 7/2005 |
| WO | WO-2005108997 A1 | 11/2005 |
| WO | WO-2004044225 A3 | 4/2006 |
| WO | WO-2006050475 A2 | 5/2006 |
| WO | WO-2007070640 A2 | 6/2007 |
| WO | WO-2007070640 A3 | 8/2007 |
| WO | WO-2007129000 A2 | 11/2007 |
| WO | WO-2007131135 A2 | 11/2007 |
| WO | WO-2008016374 A2 | 2/2008 |
| WO | WO-2007129000 A3 | 3/2008 |
| WO | WO-2007131135 A3 | 11/2008 |
| WO | WO-2009043178 A1 | 4/2009 |
| WO | WO-2009073764 A1 | 6/2009 |
| WO | WO-2010036353 A2 | 4/2010 |
| WO | WO-2010056897 A1 | 5/2010 |
| WO | WO-2011012672 A1 | 2/2011 |
| WO | WO-2011035012 A2 | 3/2011 |
| WO | WO-2011112961 A1 | 9/2011 |
| WO | WO-2012023519 A1 | 2/2012 |
| WO | WO-2012027491 A1 | 3/2012 |
| WO | WO-2012047234 A1 | 4/2012 |
| WO | WO-2013067451 A2 | 5/2013 |
| WO | WO-2013071119 A2 | 5/2013 |
| WO | WO-2014043519 A1 | 3/2014 |

OTHER PUBLICATIONS

Alexander Zimprich, et al., A mutation in, encoding a subunit of the retromer complex, causes late-onset parkinson disease, American journal of human genetics, American society of human genetics. Jun. 2011; 89(1):168-175.

Altschul, et al. Gapped BLAST and PSI-BLAST: a new generation of protein database search programs. Nucleic Acids Res. Sep. 1, 1997;25(17):3389-402.

Amarzguioui, et al. Approaches for chemically synthesized siRNA and vector-mediated RNAi. FEBS Lett. Oct. 31, 2005;579(26):5974-81. Epub Sep. 20, 2005.

Ansel et al., Pharmaceutical Dosage Forms and Drug Delivery Systems (Lippencott Williams & Wilkins, Baltimore Md. (1999).

Arakawa, et al. Advances in characterization of neuroprotective peptide, humanin. Curr Med Chem. 2011;18(36):5554-63.

Ausubel (Ed.), Current Protocols in Molecular Biology (2007 John Wiley & Sons, NY).

Ausubel, et al. Current Protocols in Molecular Biology. John Wiley & Sons, New York, 1999.

(56) References Cited

OTHER PUBLICATIONS

Bailey, et al. Analysis of Segmental Duplications and Genome Assembly in the Mouse. Genome Res. 2004; 14:789-801.
Bakkaloglu, et al. Molecular cytogenetic analysis and resequencing of contactin associated protein-like 2 in autism spectrum disorders. Am J Hum Genet. Jan. 2008;82(1):165-73.
Bangham et al. Diffusion of univalent ions across the lamellae of swollen phospholipids. J. Mol. Biol. 1965;13:238-252.
Bedell, et al. In vivo genome editing using a high-efficiency TALEN system. Nature. Sep. 23, 2012. doi: 10.1038/nature11537. [Epub ahead of print].
Bennett, C. Efficiency of antisense oligonucleotide drug discovery. Antisense Nucleic Acid Drug Dev. Jun. 2002;12(3):215-24.
Berkel, et al. Mutations in the SHANK2 synaptic scaffolding gene in autism spectrum disorder and mental retardation. Nat Genet. Jun. 2010;42(6):489-91. Epub May 16, 2010.
Bernard, et al. Sequence of the murine and human cellular myc oncogenes and two modes of myc transcription resulting from chromosome translocation in B lymphoid tumours. EMBO J. 1983;2(12):2375-83.
Bernstein, et al. Role for a bidentate ribonuclease in the initiation step of RNA interference. Nature. Jan. 18, 2001;409(6818):363-6.
Betancur, et al. The emerging role of synaptic cell-adhesion pathways in the pathogenesis of autism spectrum disorders. Trends Neurosci. Jul. 2009;32(7):402-12. doi: 10.1016/j.tins.2009.04.003. Epub Jun. 21, 2009.
Bier, et al. DNA microarrays. Adv Biochem Eng Biotechnol. 2008;109:433-53.
Biomarkers Definitions Working Group. Biomarkers and surrogate endpoints: preferred definitions and conceptual framework. Clin Pharmacol Ther. Mar. 2001;69(3):89-95.
Bochukova, et al. Large, rare chromosomal deletions associated with severe early-onset obesity. Nature. Feb. 4, 2010;463(7281):666-70. Epub Dec. 6, 2009.
Bodmer, et al. Common and rare variants in multifactorial susceptibility to common diseases. Nat Genet. Jun. 2008;40(6):695-701.
Bodzioch, et al. Evidence for potential functionality of nuclearly-encoded humanin isoforms. Genomics. Oct. 2009;94(4):247-56. Epub May 27, 2009.
Bosher, et al. RNA interference: genetic wand and genetic watchdog. Nat Cell Biol. Feb. 2000;2(2):E31-6.
Bremer, et al. Copy number variation characteristics in subpopulations of patients with autism spectrum disorders. Am J Med Genet B Neuropsychiatr Genet. Mar. 2011;156(2):115-24. doi: 10.1002/ajmg.b.31142. Epub Dec. 8, 2010.
Brummelkamp, et al. A system for stable expression of short interfering RNAs in mammalian cells. Science. Apr. 19, 2002;296(5567):550-3. Epub Mar. 21, 2002.
Bult, et al. The Mouse genome Database (MGD): mouse biology and model systems. Nucleic Acids Research. 2008; 36 Database Issue: D724-D728. doi:10.1093/nar/gkm961.
Bych, et al., The iron-sulphur protein Ind1 is required for effective complex I assembly. The EMBO Journal (2008) 27, 1736-174.
Calvo, et al. High-throughput, pooled sequencing identifies mutations in NUBPL and FOXRED1 in human complex I deficiency. Nat Genet. Oct. 2010;42(10):851-8. Epub Sep. 5, 2010.
Carles Vilario-Guell, et al., Mutations in Parkinson disease, American journal of human genetics, american society of human genetics. Jun. 2011; 89(1):162-167.
Chan, et al., Identification of key residues essential for the structural fold and receptor selectivity within the A-chain of human gene-2 (H2) relaxin. The Journal of Biological Chemistry vol. 287, No. 49, pp. 41152-41164, Nov. 30, 2012.
Chavanpatil et al. Novel sustained release, swellable and bioadhesive gastroretentive drug delivery system for olfoxacin. International Journal of Pharmaceutics. 2006;316(1-2):86-92.
Chen, et al., Identification of small molecule agonists of human relaxin family receptor 1 (RXFP1) by utilizing a homogenous cell-based cAMP assay.

Chen, et al. The evolution of gene regulation by transcription factors and microRNAs. Nat Rev Genet. Feb. 2007;8(2):93-103.
Chen, H. Clinical development of antisense oligonucleotides as anti-cancer therapeutics. Methods Mol Med. 2003;75:621-36.
Chi, et al. Genomewide view of gene silencing by small interfering RNAs. Proc Natl Acad Sci U S A. May. 27, 2003;100(11):6343-6. Epub May 2, 2003.
Ching, et al., Integrated analysis of copy number and loss of heterozygosity in primary breast carcinomas using high-density SNP array. International journal of oncology, 2011; 39:621-633.
Conrad, et al. Origins and functional impact of copy number variation in the human genome. Nature. Apr. 1, 2010;464(7289):704-12. Epub Oct. 7, 2009.
Co-pending U.S. Appl. No. 15/279,012, filed Sep. 28, 2016.
Corti, et al. What Genetics tells us about the causes and mechanisms of parkinson's disease. Physiological reviews.Oct. 2011; 91(4): 1161-1218.
Coskun, et al., A Mitochondrial Etiology of Alzheimer and Parkinson Disease. Biochim Biophys Acta. May 2012 ; 1820(5): 553-564. doi:10.1016/j.bbagen.2011.08.008.
Crespi, et al. Association testing of copy number variants in schizophrenia and autism spectrum disorders. J Neurodev Disord. May 30, 2012;4(1):15. doi: 10.1186/1866-1955-4-15.
Cronin, et al. Analysis of genome-wide copy number variation in Irish and Dutch ALS populations. Hum Mol Genet. Nov. 1, 2008;17(21):3392-8. Epub Aug. 7, 2008.
Daruwala, et al. A versatile statistical analysis algorithm to detect genome copy number variation. Proc Natl Acad Sci U S A. Nov. 16, 2004;101(46):16292-7. Epub Nov. 8, 2004.
De Krom, et al. A common variant in DRD3 receptor is associated with autism spectrum disorder. Biol Psychiatry. Apr. 1, 2009;65(7):625-30. doi: 10.1016/j.biopsych.2008.09.035. Epub Dec. 5, 2008.
Desmet, et al., Human Splicing Finder: an online bioinformatics tool to predict splicing signals. Nucleic Acids Research, 2009, vol. 37, No. 9 e67.
Dias, et al. Antisense oligonucleotides: basic concepts and mechanisms. Mol Cancer Ther. Mar. 2002;1(5):347-55.
Dibbens, et al. Familial and sporadic 15q13.3 microdeletions in Idiopathic Generalized Epilepsy: Precedent for Disorders with Complex Inheritance. Hum Mol Genet. Jul. 10, 2009. [Epub ahead of print].
Dijkhuizen, et al. FISH and array-CGH analysis of a complex chromosome 3 aberration suggests that loss of CNTN4 and CRBN contributes to mental retardation in 3pter deletions. Am J Med Genet A. Nov. 15, 2006;140(22):2482-7.
Elbashir, et al. RNA interference is mediated by 21- and 22-nucleotide RNAs. Genes Dev. Jan. 15, 2001;15(2):188-200.
Encode project consortium, et al. An integrated encyclopedia of DNA elements in the human genome. Nature. Sep. 6, 2012;489(7414):57-74. doi: 10.1038/nature11247.
Estivill, et al. Copy number variants and common disorders: filling the gaps and exploring complexity in genome-wide association studies. PLoS Genet. Oct. 2007;3(10):1787-99.
European search report and opinion dated Feb. 11, 2015 for EP Application No. 12839712.2.
European search report and opinion dated Feb. 27, 2015 for EP Application No. 11814903.8.
European search report and opinion dated Jun. 9, 2015 for EP Application No. 12846660.4.
European search report dated Apr. 11, 2016 for EP Application No. 13840476.9.
European Search Report dated Sep. 2, 2016 for European Application No. 13836501.0.
European search report dated Oct. 14, 2015 for EP Application No. 13746934.2.
ExAC Browser (BETA) | Exome aggregation consortium. Available at http://exac.broadinstitute.org/. Accessed on June 8, 2017.
Fan, et al. Illumina universal bead arrays. Methods Enzymol. 2006;410:57-73.
Fassbender, A., et al., "Biomarkers of endometriosis", Fertility and Sterility, 99(4), (Mar. 15, 2013), 1135-1145.

(56) References Cited

OTHER PUBLICATIONS

Fassone, et al., Complex I deficiency: clinical features, biochemistry and molecular genetics. J Med Genet 2012;49:578-590. doi:10.1136/jmedgenet-2012-101159.

Fernandez, et al. Disruption of contactin 4 (CNTN4) results in developmental delay and other features of 3p deletion syndrome. Addendum. Am J Hum Genet. Jun. 2008;82(6):1385.

Fernandez, et al. Disruption of contactin 4 (CNTN4) results in developmental delay and other features of 3p deletion syndrome. Am J Hum Genet. Jun. 2004;74(6):1286-93.

Fernandez, et al. Gene Discovery in Developmental Neuropsychiatric Disorders: Clues from Chromosomal Rearrangements. Yale Journal of Biology and Medicine, vol. 78 (2005), pp. 95-130. on p. 103. Abstract.

Fire, et al. Potent and specific genetic interference by double-stranded RNA in Caenorhabditis elegans. Nature. Feb. 19, 1998;391(6669):806-11.

Flannick, et al., Loss-of-function mutations in SLC30A8 protect against type 2 diabetes. Nat Genet. Author manuscript; available in PMC Jun. 10, 2014.

Freeman, et al. Copy number variation: new insights in genome diversity. Genome Res. Aug. 2006;16(8):949-61. Epub Jun. 29, 2006.

Freshney, R. I., Culture of Animal Cells: A Manual of Basic Technique. Wiley-Liss; 5th edition (2005).

Gagneux, et al. Genetic differences between humans and great apes. Mol Phylogenet Evol. Jan. 2001;18(1):2-13.

Galfre. et al. Antibodies to major histocompatibility antigens produced by hybrid cell lines. Nature. 1977; 266:550-52.

Gatto, et al. Genetic controls balancing excitatory and inhibitory synaptogenesis in neurodevelopmental disorder models. Frontiers in Synaptic Neuroscience. Jun. 2010; 2(4):1-19.

Gelb, et al., Diagnostic Criteria for Parkinson Disease. Arch Neurol. 1999;56(1):33-39. doi:10.1001/archneur.56.1.33.

Gelmann, et al. Identification of reciprocal translocation sites within the c-myc oncogene and immunoglobulin mu locus in a Burkitt lymphoma. Nature. Dec. 22, 1983-Jan. 4, 1984;306(5945):799-803.

GeneCards output for ATXN2 gene, from www.genecards.ord, pritned on May 20, 2015, pp. 1-13.

GeneCards output for DIAPH2 gene, from www.genecards.ord, printed on Jun. 11, 2015, pp. 1-11.

Gilling, et al. Breakpoint cloning and haplotype analysis indicate a single origin of the common Inv(10)(p11.2q21.2) mutation among northern Europeans. Am. J. Hum. Genet. 2006; 78(5):878-83.

Glessner, et al. Autism genome-wide copy number variation reveals ubiquitin and neuronal genes. Nature. May 28, 2009;459(7246):569-73. Epub Apr. 28, 2009.

Goldstein. Common genetic variation and human traits. N Engl J Med. Apr. 23, 2009;360(17):1696-8. Epub Apr. 15, 2009.

GPHN Gene—GeneCards output. pp. 1-14. Printed on Jul. 2, 2015 from www.genecards.org.

Gregoriadis. Chapter 14, "Liposomes," Drug Carriers in Biology and Medicine, pp. 2.sup.87-341 (Academic Press, 1979).

Gribble, et al. The complex nature of constitutional de novo apparently balanced translocations in patients presenting with abnormal phenotypes. J. Med. Genet. 2005; 42:8-16.

Griffiths, et al. Human anti-self antibodies with high specificity from phage display libraries. EMBO J. Feb. 1993;12(2):725-34.

Griswold, et al. A de novo 1.5 Mb microdeletion on chromosome 14q23.2-23.3 in a patient with autism and spherocytosis. Autism Res. Jun. 2011;4(3):221-7. doi: 10.1002/aur.186. Epub Feb. 28, 2011.

Grskovic, et al. Induced pluripotent stem cells—opportunities for disease modelling and drug discovery. Nat Rev Drug Discov. Nov. 11, 2011;10(12):915-29. doi: 10.1038/nrd3577.

Guatelli, et al. Isothermal, in vitro amplification of nucleic acids by a multienzyme reaction modeled after retroviral replication. Proc Natl Acad Sci U S A. Mar. 1990;87(5):1874-8.

Guilmatre, et al. Recurrent rearrangements in synaptic and neurodevelopmental genes and shared biologic pathways in schizophrenia, autism, and mental retardation. Arch Gen Psychiatry. Sep. 2009;66(9):947-56. doi: 10.1001/archgenpsychiatry.2009.80.

Harada, et al. Subtelomere specific microarray based comparative genomic hybridisation: a rapid detection system for cryptic rearrangements in idiopathic mental retardation. J. Med. Genet. 2004; 41:130-136.

Hatchwell, et al. High rate of submicroscopic human genomic polymorphism detected by array CGH. Proceedings of XIX International Genetics Congress. Melbourne, Australia. Abstracts and Posters. 2003; 1.E.0092. pp. 168 and 319.

Hattersley, et al. What makes a good genetic association study? Lancet. Oct. 8, 2005;366(9493):1315-23.

Hay, et al. Bacteriophage cloning and *Escherichia coli* expression of a human IgM Fab. Hum Antibodies Hybridomas. Apr. 1992;3(2):81-5.

He, et al. Analysis of de novo copy number variations in a family affected with autism spectrum disorders using high-resolution array-based comparative genomic hybridization. Zhonghua Yi Xue Yi Chuan Xue Za Zhi. Jun. 2012;29(3):266-9. doi: 10.3760/cma.j.issn.1003-9406.2012.03.004. English abstract only.

Hegele. SNP judgments and freedom of association. Arterioscler Thromb Vasc Biol. Jul. 1, 2002;22(7):1058-61.

Helbig, et al. 15q13.3 microdeletions increase risk of idiopathic generalized epilepsy. Nat Genet. Feb. 2009;41(2):160-2. Epub Jan. 11, 2009.

Henchcliffe, et al., Mitochondrial biology and oxidative stress in Parkinson disease pathogenesis. Nat. Clin. Pract. Neurology, 2005;4(11):600-609.

Hicks et al., "Novel patterns of genome rearrangement and their association with survival in breast cancer," Genome Res 16:1465-1479, 2006.

Hirschhorn, et al. A comprehensive review of genetic association studies. Genet Med. Mar.-Apr. 2002;4(2):45-61.

Hoffman, et al. Pharmacokinetic and pharmacodynamic aspects of gastroretentive dosage forms. Int J Pharm. Jun. 11, 2004;277(1-2):141-53.

Hoheisel, J. Microarray technology: beyond transcript profiling and genotype analysis. Nat Rev Genet. Mar. 2006;7(3):200-10.

Huang, et al. Whole genome DNA copy number changes identified by high density oligonucleotide arrays. Hum Genomics. May 2004;1(4):287-99.

Hudson, et al., Two-stage association study and meta-analysis of mitochondrial DNA variants in Parkinson disease. American Academy of Neurology. 2013;80: 2042-2048.

Human Genome CGH Microarrays—Details & Specifications, six printed pages from www.agilent.com, printed on May 20, 2015.

Hunt et al., Silent (Synonymous) SNPs: Should We Care About Them?, Methods in Molecular Biology. 2009; 578: 23-39.

Hunter, C. Genetics: a touch of elegance with RNAi. Curr Biol. Jun. 17, 1999;9(12):R440-2.

Huse, et al. Generation of a large combinatorial library of the immunoglobulin repertoire in phage lambda. Science. Dec. 8, 1989;246(4935):1275-81.

Hutvagner, et al. A microRNA in a multiple-turnover RNAi enzyme complex. Science. Sep. 20, 2002;297(5589):2056-60. Epub Aug. 1, 2002.

Iafrate, et al. Detection of large-scale variation in the human genome. Nature Genet. 2004; 36:949-51.

International Preliminary Report on Patentability dated Mar. 16, 2017 for International Application No. PCT/US2015/000093.

International search report and written opinion dated Jan. 15, 2014 for PCT/US2013/062346.

International search report and written opinion dated Jan. 20, 2014 for PCT/US2013/059739.

International search report and written opinion dated Apr. 9, 2012 for PCT/US2011/001363.

International search report and written opinion dated Apr. 22, 2013 for PCT/US2012/063451.

International search report and written opinion dated Jul. 3, 2013 for PCT/IB2012/002498.

International Search Report dated Sep. 11, 2008 for PCT Application No. US2007/68183.

(56) References Cited

OTHER PUBLICATIONS

"Introducing Genome-Wide SNP Array 6.0 Pure performance & Genetic Power." May 21, 2008. Available at http://www.genehk.com/news/doc/Genomics_genome-wide Human SNP Array 6.0.pdf. Accessed on Dec. 22, 2016.
Itsara, et al. Population analysis of large copy number variants and hotspots of human genetic disease. Am J Hum Genet. Feb. 2009;84(2):148-61. Epub Jan. 22, 2009.
Jonsson, et al., A mutation in APP protects against Alzheimer's disease and age-related cognitive decline. Nature. Aug. 2, 2012;488(7409):96-9. doi: 10.1038/nature11283.
Jorde, et al. Population genomics: a bridge from evolutionary history to genetic medicine. Hum. Mol. Genet. 2001; 10(20):2199-2207.
Juppner. Functional properties of the PTH/PTHrP receptor. Bone. Aug. 1995; 17(2):Supplement 39S-42S.
Kallioniemi, et al. Comparative genomic hybridization for molecular cytogenetic analysis of solid tumors. Science. Oct. 30, 1992;258(5083):818-21.
Karlin, et al. Applications and statistics for multiple high-scoring segments in molecular sequences. Proc Natl Acad Sci U S A. Jun. 15, 1993;90(12):5873-7.
Ketting, et al. Dicer functions in RNA interference and in synthesis of small RNA involved in developmental timing in C. elegans. Genes Dev. Oct. 15, 2001;15(20):2654-9.
Kevelam, et al., NUBPL mutations in patients with complex I deficiency and a distinct MRI pattern. Neurology. Apr. 23, 2013; 80(17): 1577-1583.
Kim, et al. Strategies for silencing human disease using RNA interference. Nat Rev Genet. Mar. 2007;8(3):173-84.
Kim et al. Synthetic dsRNA Dicer substrates enhance RNAi potency and efficacy. Nat Biotechnol 23(2):222-226 (2005).
Kim, et al., Synthetic dsRNA dicer substrates enhance RNAi potency and efficacy. Nature biotechnology. 2005; 23(2): 222-226.
Kimchi-Sarfaty, et al. A "silent" polymorphism in the MDR1 gene changes substrate specificity. Science. Jan. 26, 2007;315(5811):525-8. Epub Dec. 21, 2006.
Klausner, et al. Novel gastroretentive dosage forms: evaluation of gastroretentivity and its effect on levodopa absorption in humans. Pharm Res. Sep. 2003;20(9):1466-73.
Klein, et al. Comparative genomic hybridization, loss of heterozygosity, and DNA sequence analysis of single cells. Proc Natl Acad Sci U S A. Apr. 13, 1999;96(8):4494-9.
Knight, et al. A cytogenetic abnormality and rare coding variants identify ABCA13 as a candidate gene in schizophrenia, bipolar disorder, and depression. Am J Hum Genet. Dec. 2009;85(6):833-46. doi: 10.1016/j.ajhg.2009.11.003.
Kohler, et al. Continuous cultures of fused cells secreting antibody of predefined specificity. Nature. Aug. 7, 1975;256(5517):495-7.
Kozbor, et al. The production of monoclonal antibodies from human lymphocytes. Immunol. Today. 1983; 4(3): 72-79.
Kraus, et al. Detection and isolation of novel protein-tyrosine kinase genes employing reduced stringency hybridization. Methods Enzymol. 1991;200:546-56.
Kumar, et al. A de novo 1p34.2 microdeletion identifies the synaptic vesicle gene RIMS3 as a novel candidate for autism. J Med Genet. Jun. 21, 2009. [Epub ahead of print].
Kumar, et al. Recurrent 16p11.2 microdeletions in autism. Hum Mol Genet. Feb. 15, 2008;17(4):628-38. Epub Dec. 21, 2007.
Kumar Kishore, et al., Genetics of parkinson disease and other movement disorders, Current opinion in neurology, Aug. 2012; 25(4):466-474.
Kurreck, J. Antisense technologies. Improvement through novel chemical modifications. Eur J Biochem. Apr. 2003;270(8):1628-44.
Kutyavin, et al. A novel endonuclease IV post-PCR genotyping system. Nucleic Acids Res. 2006;34(19):e128. Epub Sep. 29, 2006.
Kwoh, et al. Transcription-based amplification system and detection of amplified human immunodeficiency virus type 1 with a bead-based sandwich hybridization format. Proc Natl Acad Sci U S A. Feb. 1989;86(4):1173-7.
Lakowicz, J. (1983) Principles of fluorescence spectroscopy. Plenum Press, New York.
Landegren, et al. A ligase-mediated gene detection technique. Science. Aug. 26, 1988;241(4869):1077-80.
Latchman, et al. Viral vectors for gene therapy in Parkinson's disease. Rev Neurosci. 2001;12(1):69-78.
Lavery, et al. Antisense and RNAi: powerful tools in drug target discovery and validation. Curr Opin Drug Discov Devel. Jul. 2003;6(4):561-9.
Lerner, E. How to make a hybridoma. Yale J Biol Med. Sep.-Oct. 1981;54(5):387-402.
Lizardi, et al. Exponential amplification of recombinant-RNA hybridization probes. Nature Biotechnology 6.10 (1988): 1197-1202.
Lucentini. Gene association typically wrong reproducible gene-disease associations are few and far between. The Scientist, Dec. 20, 2004, p. 20.
Maftei, et al. Interaction structure of the complex between neuroprotective factor humanin and Alzheimer's β-amyloid peptide revealed by affinity mass spectrometry and molecular modeling. J Pept Sci. Jun. 2012;18(6):373-82. doi: 10.1002/psc.2404. Epub Apr. 20, 2012.
Maniatis, et al. Molecular Cloning: A Laboratory Manual, Cold Spring Harbor Laboratory Press, Cold Spring Harbor, N.Y., USA (1982).
Manolio, et al.Finding the missing heritability of complex diseases. Nature. Oct. 8, 2009;461(7265):747-53.
Margulies, et al. Genome sequencing in microfabricated high-density picolitre reactors. Nature. Sep. 15, 2005;437(7057):376-80. Epub Jul. 31, 2005.
Marques, et al. A structural basis for discriminating between self and nonself double-stranded RNAs in mammalian cells. Nat Biotechnol. May 2006;24(5):559-65. Epub Apr. 30, 2006.
Marshall, et al. Structural variation of chromosomes in autism spectrum disorder. Am J Hum Genet. Feb. 2008;82(2):477-88. doi: 10.1016/j.ajhg.2007.12.009. Epub Jan. 17, 2008.
Martinez et al. Single-stranded antisense siRNAs guide target RNA cleavage in RNAi. Cell 110(5):563-574 (2002).
Mast, et al. Invader assay for single-nucleotide polymorphism genotyping and gene copy number evaluation. Methods Mol Biol. 2006;335:173-86. Abstract only.
Matsuoka, et al. Humanin and the receptors for humanin. Mol Neurobiol. Feb. 2010;41(1):22-8. Epub Dec. 9, 2009.
May et al., Endometrial alterations in endometriosis: a systematic review of putative biomarkers. Hum. Reprod. Update, 17(5); 637-53:2011.
McCarroll, et al. Copy-number variation and association studies of human disease. Nat Genet. Jul. 2007;39(7 Suppl):S37-42.
McCarthy, et al. Microduplications of 16p11.2 are associated with schizophrenia. Nat Genet. Nov. 2009;41(11):1223-7. Epub Oct. 25, 2009.
McInnes, et al. A large-scale survey of the novel 15q24 microdeletion syndrome in autism spectrum disorders identifies an atypical deletion that narrows the critical region. Mol Autism. Mar. 19, 2010;1(1):5. doi: 10.1186/2040-2392-1-5.
McManus, et al. Gene silencing in mammals by small interfering RNAs. Nat Rev Genet. Oct. 2002;3(10):737-47.
Mockler, et al. Applications of DNA tiling arrays for whole-genome analysis. Genomics. Jan. 2005;85(1):1-15.
Mohapatra, et al. Analyses of brain tumor cell lines confirm a simple model of relationships among fluorescence in situ hybridization, DNA index, and comparative genomic hybridization. Genes Chromosomes Cancer. Dec. 1997;20(4):311-9.
Mounsey et al., Mitochondrial Dysfunction in Parkinson's disease: Pathogenesis and neuroprotection. Parkinson's Disease, 2010: 18 pages.
Mummidi, et al. Evolution of human and non-human primate CC chemokine receptor 5 gene and mRNA. Potential roles for haplotype and mRNA diversity, differential haplotype-specific transcriptional activity, and altered transcription factor binding to polymorphic nucleotides in the pathogenesis of HIV-1 and simian immunodeficiency virus. J Biol Chem. Jun. 23, 2000;275(25):18946-61.
Nakamura, et al., Codon usage tabulated from international DNA sequence databases: status for the year 2000. Nucleic Acids Res. Jan. 1, 2000; 28(1): 292.

(56) References Cited

OTHER PUBLICATIONS

Nakazawa et al. UV and skin cancer: specific p53 gene mutation in normal skin as a biologically relevant exposure measurement. PNAS USA 91(1):360-364 (1994).
Nalls, et al. Extended tracts of homozygosity identify novel candidate genes associated with late-onset Alzheimer's disease. Neurogenetics. Jul. 2009;10(3):183-90. doi: 10.1007/s10048-009-0182-4. Epub Mar. 7, 2009.
Nalls, et al. Imputation of sequence variants for identification of genetic risks for Parkinson's disease: a meta-analysis of genome-wide association studies. Lancet. Feb. 19, 2011;377(9766):641-9. doi: 10.1016/S0140-6736(10)62345-8. Epub Feb. 1, 2011.
National Center for Biotechnology Information. NCBI. Available at: https://www.ncbi.nlm.nih.gov/. Accessed on: June 8, 2017.
NCBI. GenBank accession No. AL390798.3. Human chromosome 14 DNA sequence BAC R-21O19 of library RPCI-11 from chromosome 14 of *Homo sapiens* (Human), complete sequence. Apr. 28, 2011.
NCBI GenBank accession No. NG_12385.1. Mar. 27, 2012.
NCBI GenBank accession No. NM_207303.1. Apr. 20, 2004.
NHLBI Exome Sequencing Project (ESP) Exome Variant Server. Available at: http://evs.gs.washington.edu/EVS/. Accessed on Jun. 8, 2017.
Nielsen, et al. Sequence-selective recognition of DNA by strand displacement with a thymine-substituted polyamide. Science. Dec. 6, 1991;254(5037):1497-500.
Nord, et al. Accurate and exact CNV identification from targeted high-throughput sequence data. BMC Genomics. Apr. 12, 2011;12:184.
Notice of allowance dated Jul. 25, 2014 for U.S. Appl. No. 13/196,882.
Nouws et al., Assembly factors as a new class of disease genes for mitochondrial complex I deficiency: cause, pathology and treatment options. Brain, 2012;135:12-22.
Nykanen, et al. ATP requirements and small interfering RNA structure in the RNA interference pathway. Cell. Nov. 2, 2001;107(3):309-21.
Office action dated Jan. 6, 2011 for U.S. Appl. No. 12/707,561.
Office Action dated Jan. 9, 2017 for U.S. Appl. No. 14/449,217.
Office Action dated Jan. 9, 2017 U.S. Appl. No. 14/806,131.
Office Action dated Feb. 21, 2017 for U.S. Appl. No. 14/090,932.
Office action dated Feb. 24, 2016 for U.S. Appl. No. 14/039,770.
Office action dated Feb. 25, 2016 for U.S. Appl. No. 13/648,874.
Office action dated Feb. 29, 2016 for U.S. Appl. No. 14/026,642.
Office action dated Mar. 1, 2016 for U.S. Appl. No. 13/763,550.
Office action dated Apr. 3, 2013 for U.S. Appl. No. 13/095,722.
Office Action dated Apr. 7, 2017 for U.S. Appl. No. 14/538,404.
Office Action dated Apr. 13, 2017 for U.S. Appl. No. 13/648,874.
Office Action dated Apr. 13, 2017 for U.S. Appl. No. 14/039,770.
Office Action dated May 1, 2017 for U.S. Appl. No. 12/449,566.
Office action dated May 17, 2016 for U.S. Appl. No. 14/090,932.
Office Action dated May 25, 2017 for U.S. Appl. No. 13/763,550.
Office action dated May 27, 2015 for U.S. Appl. No. 14/039,770.
Office action dated May 28, 2014 for U.S. Appl. No. 12/449,566.
Office action dated Jun. 23, 2015 for U.S. Appl. No. 13/763,550.
Office action dated Jun. 28, 2016 for U.S. Appl. No. 12/449,566.
Office action dated Jun. 29, 2015 for U.S. Appl. No. 14/026,642.
Office action dated Jul. 9, 2015 for U.S. Appl. No. 13/648,874.
Office action dated Jul. 17, 2013 for U.S. Appl. No. 12/449,566.
Office action dated Aug. 4, 2015 for U.S. Appl. No. 13/668,049.
Office action dated Sep. 2, 2015 for U.S. Appl. No. 12/449,566.
Office action dated Sep. 13, 2012 for Chinese Application No. 200780015873.8.
Office Action dated Sep. 15, 2016 for U.S. Appl. No. 13/763,550.
Office action dated Oct. 3, 2014 for U.S. Appl. No. 13/668,049.
Office Action dated Oct. 19, 2016 for European Application No. 12846660.4.
Office action dated Nov. 18, 2013 for U.S. Appl. No. 13/196,882.
Office Action Dated Dec. 6, 2016 for U.S. Appl. No. 14/026,642.
Office action dated Dec. 16, 2008 for U.S. Appl. No. 11/421,348.
Office action dated Dec. 16, 2014 for U.S. Appl. No. 12/449,566.
Office action dated Feb. 9, 2011 for UK Application No. GB0822081.6.
Office action dated Jun. 14, 2010 for UK Application No. GB0822081.6.
Office action dated Jun. 2, 2009 for U.S. Appl. No. 11/421,348.
O'Keefe, et al. High-resolution genomic arrays facilitate detection of novel cryptic chromosomal lesions in myelodysplastic syndromes. Exp Hematol. Feb. 2007;35(2):240-51.
Ozelius, et al. LRRK2 G2019S as a cause of Parkinson's disease in Ashkenazi Jews. N Engl J Med. Jan. 26, 2006;354(4):424-5.
Paisan-Ruiz Coro, et al., Parkingson's disease and low frequency alleles foung together throughout LRRK2, Annals of human genetics. Jul. 2009. 73(4). 391-403.
Pang, et al. Towards a comprehensive structural variation map of an individual human genome. Genome Biol. 2010;11(5):R52. Epub May 19, 2010.
Peltz, et al. Targeting post-transcriptional control for drug discovery. RNA Biol. Jul.-Aug. 2009;6(3):329-34. Epub Jul. 7, 2009.
Pennisi. A closer look at SNPs suggests difficulties. Science. Sep. 18, 1998; 281(5384): 1787-1789.
Perkel, J. SNP genotyping: six technologies that keyed a revolution. Nature Methods. 2008; 5:447-453.
Petrini, et al. The immunoglobulin heavy chain switch: structural features of gamma 1 recombinant switch regions. J Immunol. Mar. 15, 1987;138(6):1940-6.
Pinkel, et al. Comparative genomic hybridization. Annu. Rev. Genomics Hum. Genet. 2005; 6:331-54.
Pinkel, et al. High resolution analysis of DNA copy number variation using comparative genomic hybridization to microarrays. Nat Genet. Oct. 1998;20(2):207-11.
Pinto, et al. Comprehensive assessment of array-based platforms and calling algorithms for detection of copy number variants. Nat Biotechnol. May 8, 2011;29(6):512-20. doi: 10.1038/nbt.1852.
Pinto, et al. Functional impact of global rare copy number variation in autism spectrum disorders. Nature. Jul. 15, 2010;466(7304):368-72. Epub Jun. 9, 2010.
Plasterk, et al. The silence of the genes. Curr Opin Genet Dev. Oct. 2000;10(5):562-7.
Pollack, et al. Microarray analysis reveals a major direct role of DNA copy number alteration in the transcriptional program of human breast tumors. Proc. Natl. Acad. Sci. 2002; 99(20):12963-68.
Prasad, et al. A discovery resource of rare copy number variations in individuals with autism spectrum disorder. G3 (Bethesda). Dec. 2012;2(12):1665-85. doi: 10.1534/g3.112.004689. Epub Dec. 1, 2012.
Probe Reports from the NIH Molecular Libraries Program [Internet]. Bethesda (MD): National Center for Biotechnology Information (US); 2010. Available from: https://www.ncbi.nlm.nih.gov/books/NBK47352/.
Provost, et al. Ribonuclease activity and RNA binding of recombinant human Dicer. EMBO J. Nov. 1, 2002;21(21):5864-74.
Purcell et al. "Postmortem brain abnormalities of the glutamate neurotransmitter system in autism" (Neurology, vol. 57 (2001) pp. 1618-1628).
Ragoussis, et al. Affymetrix GeneChip system: moving from research to the clinic. Expert Rev Mol Diagn. Mar. 2006;6(2):145-52.
Ramsey, et al. A CFTR potentiator in patients with cystic fibrosis and the G551D mutation. N Engl J Med. Nov. 3, 2011;365(18):1663-72.
Redon, et al. Global variation in copy number in the human genome. Nature. Nov. 23, 2006;444(7118):444-54.
Rees, et al. Isoform heterogeneity of the human gephyrin gene (GPHN), binding domains to the glycine receptor, and mutation analysis in hyperekplexia. J Biol Chem. Jul. 4, 2003;278(27):24688-96. Epub Apr. 8, 2003.
Remington "The Science and Practice of Pharmacy" (20th Ed., Lippincott Williams & Wilkins, Baltimore MD).
Revised American society for reproductive medicine classification of endometriosis: 1996. Fertility and Sterility. 67: 1997; 817-21.
Reynold, et al. Rational siRNA design for RNA interference. Nat Biotechnol. Mar. 2004;22(3):326-30. Epub Feb. 1, 2004
Risch, et al. A genomic screen of autism: evidence for a multilocus etiology. Am J Hum Genet. Aug. 1999;65(2):493-507.

(56) References Cited

OTHER PUBLICATIONS

Rodriguez-Revenga, et al. Structural variation in the human genome: the impact of copy number variants on clinical diagnosis. Genet Med. Sep. 2007;9(9):600-6.
Roohi, et al. Disruption of contactin 4 in three subjects with autism spectrum disorder. J Med Genet. Mar. 2009;46(3):176-82.
Saha, et al. Technical challenges in using human induced pluripotent stem cells to model disease. Cell Stem Cell. Dec. 4, 2009;5(6):584-95.
Saiki, et al. Primer-directed enzymatic amplification of DNA with a thermostable DNA polymerase. Science. Jan. 29, 1988;239(4839):487-91.
Sambrook et al., Molecular Cloning: A Laboratory Manual (2 ed.), Cold Spring Harbor Laboratory Press, Cold Spring Harbor, N.Y., USA (1989).
Santa Cruz Human Genome Browser Gateway. 2017. Available at: http://genome.ucsc.edu/cgi-bin/hgGateway. Accessed on: Jun. 8, 2017.
Sauna, et al., Understanding the contribution of synonymous mutations to human disease.Nat Rev Genet. Aug. 31, 2011;12(10):683-91. doi: 10.1038/nrg3051.
Schapira. Causes of neuronal death in Parkinson's disease. Adv Neurol. 2001;86:155-62.
Schapira, et al. Mitochondrial complex I deficiency in Parkinson's disease. Lancet. Jun. 3, 1989;1(8649):1269.
Schapira. Mitochondrial complex I deficiency in Parkinson's disease. Adv Neurol. 1993;60:288-91.
Schule, et al. Can cellular models revolutionize drug discovery in Parkinson's disease? Biochim Biophys Acta. Nov. 2009;1792(11):1043-51. Epub Sep. 3, 2009.
Schwarz, et al. Asymmetry in the assembly of the RNAi enzyme complex. Cell. Oct. 17, 2003;115(2):199-208.
Sebat, et al. Large-scale copy number polymorphism in the human genome. Science. 2004; 305(5683):525-8.
Sebat, et al.Strong association of de novo copy number mutations with autism. Science. Apr. 20, 2007;316(5823):445-9.
Seshan Ve and Olshen A (2017). DNAcopy: DNA copy number data analysis. R package version 1.50.1. Available at: http://www.bioconductor.org/packages/release/bioc/html/DNAcopy.html.
Sharp, P. RNA interference—2001. Genes Dev. Mar. 1, 2001;15(5):485-90.
Sheftel, et al., Human Ind1, an Iron-Sulfur Cluster Assembly Factor for Respiratory Complex I. Molecular and Cellular Biology, Nov. 2009, p. 6059-6073.
Shi, Y. Mammalian RNAi for the masses. Trends Genet. Jan. 2003;19(1):9-12.
Shuey, et al. RNAi: gene-silencing in therapeutic intervention. Drug Discov Today. Oct. 15, 2002;7(20):1040-6.
Sidransky, et al., Multicenter analysis of glucocerebrosidase mutations in Parkinson's disease.N Engl J Med. Oct. 22, 2009;361(17):1651-61. doi: 10.1056/NEJMoa0901281.
Sidrasky, E. Gaucher Disease: Insights from a Rare Mendelian Disorder. Discov Med. Author manuscript; available in PMC Aug. 22, 2014.
Simon-Sanchez, et al. Genome-wide association study reveals genetic risk underlying Parkinson's disease. Nat Genet. Dec. 2009;41(12):1308-12. doi: 10.1038/ng.487. Epub Nov. 15, 2009. with supplemental information.
Siolas, et al. Synthetic shRNAs as potent RNAi triggers. Nat Biotechnol. Feb. 2005;23(2):227-31. Epub Dec. 26, 2004.
Smith, et al. A high-density admixture map for disease gene discovery in african americans. Am J Hum Genet. May 2004;74(5):1001-13. Epub Apr. 14, 2004.
Snijders, et al. Assembly of microarrays for genome-wide measurement of DNA copy number. Nat Genet. Nov. 2001;29(3):263-4.
Snijders, et al. BAC microarray-based comparative genomic hybridization. Methods Mol Biol. 2004;256:39-56.
Snijders, et al. Mapping segmental and sequence variations among laboratory mice using BAC array CGH. Genome Res. Feb. 2005;15(2):302-11.

Soni, et al. Progress toward ultrafast DNA sequencing using solid-state nanopores. Clin Chem. Nov. 2007;53(11):1996-2001. Epub Sep. 21, 2007.
Stark, et al. De novo 325 kb microdeletion in chromosome band 10q25.3 including ATRNL1 in a boy with cognitive impairment, autism and dysmorphic features. Eur J Med Genet. Sep.-Oct. 2010;53(5):337-9. doi: 10.1016/j.ejmg.2010.07.009. Epub Jul. 27, 2010.
Stefansson, et al. Large recurrent microdeletions associated with schizophrenia. Nature. Sep. 11, 2008;455(7210):232-6.
Stephens, et al. Antisense oligonucleotide therapy in cancer. Curr Opin Mol Ther. Apr. 2003;5(2):118-22.
Streubel, et al. Gastroretentive drug delivery systems. Expert Opin Drug Deliv. Mar. 2006;3(2):217-33.
String. Search single protein by name/identifier. String consortium 2017. Available at:https://string-db.org/.
Sudhof. Neuroligins and neurexins link synaptic function to cognitive disease. Nature. Oct. 16, 2008;455(7215):903-11. doi: 10.1038/nature07456.
Summary of NRSP-8 Accomplishments: 2003-2008. Available at http://www.lgu.umd.edu/lgu_v2/pages/attachs/9956_Attach1%20%202003-08%20ACCOMPLISHMENTS.doc. Published on Feb. 9, 2008. (6 pages).
Suryawanshi, S., et al., "Plasma microRNAs as novel biomarkers for endometriosis and endometriosis-associated ovarian cancer", Clin Cancer Res., 19(5), (Mar. 1, 2013), 1213-24.
Szoka et al. Procedure for preparation of liposomes with large internal aqueous space and high capture by reverse-phase evaporation. PNAS. 1978;75:4194-4198.
Tabara, et al. The dsRNA binding protein RDE-4 interacts with RDE-1, DCR-1, and a DExH-box helicase to direct RNAi in C. elegans. Cell. Jun. 28, 2002;109(7):861-71.
Tabuchi, et al. A neuroligin-3 mutation implicated in autism increases inhibitory synaptic transmission in mice. Science. Oct. 5, 2007;318(5847):71-6. Epub Sep. 6, 2007.
Tam, et al. The role of DNA copy number variation in schizophrenia. Biol Psychiatry. Dec. 1, 2009;66(11):1005-12. doi: 10.1016/j.biopsych.2009.07.027. Epub Sep. 12, 2009.
Tenisch, et al., Massive and exclusive pontocerebellar damage in mitochondrial disease and NUBPL mutations.Neurology. Jul. 24, 2012;79(4):391. doi: 10.1212/WNL.0b013e3182611232.
Teo, et al. Statistical challenges associated with detecting copy number variations with next-generation sequencing. Bioinformatics. Aug. 31, 2012.
The 1000 Genomes project consortium. An integrated map of genetic variation from 1,092 human genomes. 56 | Nature | vol. 491 | Nov. 1, 2012.
The International Schizophrenia Consortium. Rare chromosomal deletions and duplications increase risk of schizophrenia. Nature. Sep. 11, 2008;455(7210):237-41. Epub Jul. 30, 2008.
The Merck Manual of Diagnosis and Therapy, 18th Edition, published by Merck Research Laboratories, 2006 (ISBN 0-911910-18-2).
Thompson. Applications of antisense and siRNAs during preclinical drug development. Drug Discov Today. Sep. 1, 2002;7(17):912-7.
Thorpe, et al. Improved antitumor effects of immunotoxins prepared with deglycosylated ricin A-chain and hindered disulfide linkages. Cancer Res. Nov. 15, 1988;48(22):6396-403.
Tucker et al. Next-generation sequencing in molecular diagnosis: NUBPL mutations highlight the challenges of variant detection and interpretation. Human mutation, 2012; 33(2):411-418.
UK Parkinson's Disease Consortium et al., Dissection of the genetics of parkinson's disease identifies an additional association 5' of SNCA and multiple associated haplotypes at 17q21. Human Molecular genetics. Jan. 15, 2011; 20(2): 345-353.
Urnov, et al. Genome editing with engineered zinc finger nucleases. Nat Rev Genet. Sep. 2010;11(9):636-46.
Van Goor, et al. Correction of the F508del-CFTR protein processing defect in vitro by the investigational drug VX-809. Proc Natl Acad Sci U S A. Nov. 15, 2011;108(46):18843-8. Epub Oct. 5, 2011.
Van Goor, et al. Rescue of CF airway epithelial cell function in vitro by a CFTR potentiator, VX-770. Proc Natl Acad Sci U S A. Nov. 3, 2009;106(44):18825-30. Epub Oct. 21, 2009.

(56) References Cited

OTHER PUBLICATIONS

Vaughan, et al. Genetics of Parkinsonism: a review. Ann Hum Genet. Mar. 2001;65(Pt 2):111-26.

Veensra-Vanderweele, et al. Networking in autism: leveraging genetic, biomarker and model system findings in the search for new treatments. Neuropsychopharmacology. Jan. 2012;37(1):196-212. doi: 10.1038/npp.2011.185. Epub Sep. 21, 2011.

Vickers, et al. Efficient reduction of target RNAs by small interfering RNA and RNase H-dependent antisense agents. A comparative analysis. J Biol Chem. Feb. 28, 2003;278(9):7108-18. Epub Dec. 23, 2002.

Vissers, et al. Array-based comparative genomic hybridization for the genomewide detection of submicroscopic chromosomal abnormalities. Am. J. Hum. Genet. 2003; 73:1261-70.

Vissers, et al. Identification of disease genes by whole genome CGH arrays. Hum Mol Genet. Oct. 15, 2005;14 Spec No. 2:R215-223.

Walker, et al. Genetic analysis of attractin homologs. Genesis. 2007; 45(12):744-756.

Walsh, et al. Detection of inherited mutations for breast and ovarian cancer using genomic capture and massively parallel sequencing. Proc Natl Acad Sci U S A. Jul. 13, 2010;107(28):12629-33. Epub Jun. 28, 2010.

Walsh, et al. Spectrum of mutations in BRCA1, BRCA2, CHEK2, and TP53 in families at high risk of breast cancer. JAMA. Mar. 22, 2006;295(12):1379-88.

Walters, et al. A novel highly penetrant form of obesity due to deletions on chromosome 16p11.2. Nature. Feb. 4, 2010;463(7281):671-5.

Wang, et al. Antisense anticancer oligonucleotide therapeutics. Curr Cancer Drug Targets. Nov. 2001;1(3):177-96.

Weiss, et al. Association between microdeletion and microduplication at 16p11.2 and autism. N Engl J Med. Feb. 14, 2008;358(7):667-75.

Westmark, C. What's hAPPening at synapses? The role of amyloid β-protein precursor and β-amyloid in neurological disorders. Mol Psychiatry. Aug. 28, 2012. doi: 10.1038/mp.2012.122.

Wilson, et al. DNA copy-number analysis in bipolar disorder and schizophrenia reveals aberrations in genes involved in glutamate signaling. Hum Mol Genet. Mar. 1, 2006;15(5):743-9. Epub Jan. 24, 2006.

Xia, et al. siRNA-mediated gene silencing in vitro and in vivo. Nat Biotechnol. Oct. 2002;20(10):1006-10. Epub Sep. 16, 2002.

Xiao, et al., Identification and optimization of small-molecule agonists of the human relaxin hormone receptor RXFP1. Nat Commun. 2013;4:1953. doi:10.1038/ncomms2953.

Xie, et al. CNV-seq, a new method to detect copy number variation using high-throughput sequencing. BMC Bioinformatics. Mar. 6, 2009;10:80.

Yusa, et al. Targeted gene correction of α1-antitrypsin deficiency in induced pluripotent stem cells. Nature. Oct. 12, 2011;478(7369):391-4. doi: 10.1038/nature10424.

Zapala, et al. Humanins, the neuroprotective and cytoprotective peptides with antiapoptotic and anti-inflammatory properties. Pharmacol Rep. Sep.-Oct. 2010;62(5):767-77.

Zhang, et al. Copy number variation in human health, disease, and evolution. Annu Rev Genomics Hum Genet. 2009;10:451-81. doi: 10.1146/annurev.genom.9.081307.164217.

Zhang, et al. Detection of copy number variation from array intensity and sequencing read depth using a stepwise Bayesian model. BMC Bioinformatics. Oct. 31, 2010;11:539.

Zhao et al. (eds), Bacterial Artificial Chromosomes: Methods Protocols Methods in Molecular Biology, Humana Press, 2004.

Ziats, et al. Expression profiling of autism candidate genes during human brain development implicates central immune signaling pathways. PLoS One. 2011;6(9):e24691. doi: 10.1371/journal.pone.0024691. Epub Sep. 15, 2011.

Langston, et al., Multisystem Lewy body disease and the other parkinsonian disorders. Nature Genetics. Dec. 2015; 47(12):1378-1385.

Poewe, et al., Parkinson disease. Nature Review:Disease Primers. Mar. 23, 2017.vol. 3, Article 17013: 1-21.

\* cited by examiner

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 2 | 99201125 | 99281387 | 80262 | gain | 2362 | LYG1, LYG2 | 1 |
| 2 | 99199627 | 99281387 | 81760 | gain | 2829 | LYG1, LYG2 | 2 |
| 2 | 99201125 | 99289171 | 88046 | gain | 1015 | LYG1, LYG2 | 3 |
| 12 | 63383870 | 63387188 | 3318 | loss | 2185 | | 4 |
| 12 | 63383870 | 63385104 | 1234 | loss | 2219 | | 5 |
| 12 | 63383870 | 63385104 | 1234 | loss | 2260 | | 5 |
| 12 | 63383870 | 63387188 | 3318 | loss | 2439 | | 4 |
| 12 | 63383870 | 63385104 | 1234 | loss | 2591 | | 5 |
| 8 | 16240739 | 16690107 | 449368 | loss | 2199 | | 6 |
| 8 | 16508165 | 16684709 | 176544 | gain | 2245 | | 7 |
| 8 | 16490177 | 16593482 | 103305 | loss | 2494 | | 8 |
| 8 | 16490177 | 16569810 | 79633 | loss | 2626 | | 9 |
| 10 | 92142758 | 92324088 | 181330 | loss | 2323 | | 10 |
| 10 | 92079548 | 92595197 | 515649 | gain | 2431 | | 11 |
| 10 | 92079548 | 92595197 | 515649 | gain | 2614 | | 11 |
| 10 | 92079548 | 92595197 | 515649 | gain | 2431 | HTR7 | 11 |
| 10 | 92079548 | 92595197 | 515649 | gain | 2614 | HTR7 | 11 |
| 3 | 185220747 | 185231271 | 10524 | gain | 2288 | | 12 |
| 3 | 185220747 | 185231271 | 10524 | gain | 2320 | | 12 |
| 3 | 185220747 | 185231271 | 10524 | gain | 2433 | | 12 |
| 3 | 185220747 | 185231271 | 10524 | gain | 2443 | | 12 |
| 3 | 3979406 | 4189063 | 209657 | loss | 2218 | | 13 |
| 3 | 3876049 | 4156590 | 280541 | loss | 2467 | | 14 |
| 3 | 4334602 | 4398938 | 64336 | loss | 2178 | SUMF1 | 15 |
| 15 | 52149940 | 52154416 | 4476 | gain | 2487 | UNC13C | 16 |
| 15 | 52301382 | 52309859 | 8477 | gain | 2407 | UNC13C | 17 |
| 15 | 52301382 | 52309859 | 8477 | gain | 2533 | UNC13C | 17 |
| 15 | 52694896 | 52710467 | 15571 | loss | 2424 | UNC13C | 18 |
| 15 | 52697607 | 52828647 | 131040 | loss | 2571 | UNC13C | 19 |
| 10 | 108944672 | 110098402 | 1153730 | gain | 2353 | | 20 |

Figure 8A

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 10 | 108944672 | 110098402 | 1153730 | gain | 2453 | | 20 |
| 2 | 62049841 | 62084882 | 35041 | loss | 2282 | COMMD1 | 21 |
| 2 | 62108133 | 62132094 | 23961 | loss | 2319 | COMMD1 | 22 |
| 23 | 15425168 | 15654135 | 228967 | gain | 2219 | ACE2,BMX,TMEM27 | 23 |
| 22 | 17562619 | 18589233 | 1026614 | loss | 2319 | HIRA | 24 |
| 22 | 17519027 | 17765355 | 246328 | gain | 2533 | HIRA | 25 |
| 20 | 40230903 | 40244704 | 13801 | loss | 2382 | PTPRT | 26 |
| 20 | 30319299 | 48847084 | 18527785 | loss | 2434 | PTPRT | 27 |
| 20 | 40622703 | 40736791 | 114088 | loss | 2276 | PTPRT | 28 |
| 20 | 40611992 | 40675931 | 63939 | loss | 2385 | PTPRT | 29 |
| 20 | 30319299 | 48847084 | 18527785 | loss | 2434 | PTPRT | 27 |
| 20 | 40683935 | 40702229 | 18294 | loss | 2199 | PTPRT | 30 |
| 20 | 40622703 | 40736791 | 114088 | loss | 2276 | PTPRT | 28 |
| 20 | 30319299 | 48847084 | 18527785 | loss | 2434 | PTPRT | 27 |
| 8 | 13709571 | 14055348 | 345777 | loss | 2527 | SGCZ | 31 |
| 8 | 14055128 | 14112705 | 57577 | loss | 2622 | SGCZ | 32 |
| 8 | 14461650 | 14472201 | 10551 | loss | 2487 | SGCZ | 33 |
| 8 | 14486018 | 14588976 | 102958 | loss | 2432 | SGCZ | 34 |
| 8 | 15074365 | 15077735 | 3370 | loss | 2203 | SGCZ | 35 |
| 22 | 17519027 | 17560202 | 41175 | loss | 2319 | CLTCL1,SLC25A1 | 36 |
| 22 | 17519027 | 17765355 | 246328 | gain | 2533 | CLTCL1,SLC25A1 | 25 |
| 16 | 87850526 | 87877204 | 26678 | gain | 2350 | ANKRD11 | 37 |
| 16 | 88039987 | 88042486 | 2499 | gain | 2358 | ANKRD11 | 38 |
| 16 | 88039987 | 88042486 | 2499 | gain | 2378 | ANKRD11 | 38 |
| 16 | 88039987 | 88042486 | 2499 | gain | 2412 | ANKRD11 | 38 |
| 16 | 88039987 | 88042486 | 2499 | gain | 2433 | ANKRD11 | 38 |
| 5 | 147081728 | 147300611 | 218883 | gain | 2537 | C5orf46,JAKMIP2,SCGB3A2,SPINK1 | 39 |
| 2 | 191869063 | 191874236 | 5173 | loss | 2053 | MYO1B | 40 |
| 2 | 191869063 | 191874236 | 5173 | loss | 2057 | MYO1B | 40 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 2 | 191867698 | 191874236 | 6538 | loss | 2185 | MYO1B | 41 |
| 2 | 191867698 | 191874236 | 6538 | loss | 2188 | MYO1B | 41 |
| 2 | 191869063 | 191874236 | 5173 | loss | 2203 | MYO1B | 40 |
| 2 | 191869063 | 191874236 | 5173 | loss | 2208 | MYO1B | 40 |
| 2 | 191869063 | 191874236 | 5173 | loss | 2211 | MYO1B | 40 |
| 2 | 191867698 | 191874236 | 6538 | loss | 2214 | MYO1B | 41 |
| 2 | 191869063 | 191874236 | 5173 | loss | 2221 | MYO1B | 40 |
| 2 | 191869063 | 191874236 | 5173 | loss | 2223 | MYO1B | 40 |
| 2 | 191869063 | 191874236 | 5173 | gain | 2261 | MYO1B | 40 |
| 2 | 191869063 | 191874236 | 5173 | gain | 2267 | MYO1B | 40 |
| 2 | 191869063 | 191874236 | 5173 | gain | 2280 | MYO1B | 40 |
| 2 | 191869063 | 191874236 | 5173 | gain | 2290 | MYO1B | 40 |
| 2 | 191869063 | 191874236 | 5173 | gain | 2294 | MYO1B | 40 |
| 2 | 191869063 | 191874236 | 5173 | gain | 2295 | MYO1B | 40 |
| 2 | 191869063 | 191874236 | 5173 | gain | 2299 | MYO1B | 40 |
| 2 | 191869063 | 191874236 | 5173 | gain | 2304 | MYO1B | 40 |
| 2 | 191869063 | 191874236 | 5173 | gain | 2339 | MYO1B | 40 |
| 2 | 191869063 | 191874236 | 5173 | gain | 2340 | MYO1B | 40 |
| 2 | 191869063 | 191874236 | 5173 | gain | 2348 | MYO1B | 40 |
| 2 | 191869063 | 191874236 | 5173 | gain | 2373 | MYO1B | 40 |
| 2 | 191869063 | 191874236 | 5173 | gain | 2376 | MYO1B | 40 |
| 2 | 191869063 | 191874236 | 5173 | gain | 2377 | MYO1B | 40 |
| 2 | 191869063 | 191874236 | 5173 | gain | 2393 | MYO1B | 40 |
| 2 | 191869063 | 191874236 | 5173 | gain | 2396 | MYO1B | 40 |
| 2 | 191869063 | 191874236 | 5173 | gain | 2400 | MYO1B | 40 |
| 2 | 191869063 | 191874236 | 5173 | gain | 2401 | MYO1B | 40 |
| 2 | 191869063 | 191874236 | 5173 | gain | 2402 | MYO1B | 40 |
| 2 | 191869063 | 191874236 | 5173 | gain | 2403 | MYO1B | 40 |
| 2 | 191869063 | 191874236 | 5173 | gain | 2411 | MYO1B | 40 |
| 2 | 191869063 | 191874236 | 5173 | gain | 2428 | MYO1B | 40 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 2 | 191869063 | 191874236 | 5173 | gain | 2429 | MYO1B | 40 |
| 2 | 191869063 | 191874236 | 5173 | gain | 2434 | MYO1B | 40 |
| 2 | 191869063 | 191874236 | 5173 | gain | 2444 | MYO1B | 40 |
| 2 | 191869063 | 191874236 | 5173 | loss | 2450 | MYO1B | 40 |
| 2 | 191869063 | 191874236 | 5173 | loss | 2459 | MYO1B | 40 |
| 2 | 191867698 | 191874236 | 6538 | loss | 2465 | MYO1B | 41 |
| 2 | 191869063 | 191874236 | 5173 | loss | 2481 | MYO1B | 40 |
| 2 | 191869063 | 191874236 | 5173 | loss | 2491 | MYO1B | 40 |
| 2 | 191867698 | 191874236 | 6538 | loss | 2512 | MYO1B | 41 |
| 2 | 191869063 | 191874236 | 5173 | loss | 2514 | MYO1B | 40 |
| 2 | 191869063 | 191874236 | 5173 | loss | 2531 | MYO1B | 40 |
| 2 | 191867698 | 191874236 | 6538 | loss | 2535 | MYO1B | 41 |
| 2 | 191869063 | 191874236 | 5173 | loss | 2539 | MYO1B | 40 |
| 2 | 191869063 | 191874236 | 5173 | gain | 2546 | MYO1B | 40 |
| 2 | 191869063 | 191874236 | 5173 | gain | 2550 | MYO1B | 40 |
| 2 | 191869063 | 191874236 | 5173 | gain | 2559 | MYO1B | 40 |
| 2 | 191869063 | 191874236 | 5173 | gain | 2575 | MYO1B | 40 |
| 2 | 191869063 | 191874236 | 5173 | gain | 2577 | MYO1B | 40 |
| 2 | 191869063 | 191874236 | 5173 | gain | 2586 | MYO1B | 40 |
| 2 | 191869063 | 191874236 | 5173 | gain | 2591 | MYO1B | 40 |
| 2 | 191869063 | 191874236 | 5173 | gain | 2625 | MYO1B | 40 |
| 2 | 191867698 | 191874236 | 6538 | loss | 2635 | MYO1B | 41 |
| 5 | 75890947 | 75892204 | 1257 | gain | 2054 | IQGAP2 | 42 |
| 5 | 75890947 | 75892204 | 1257 | gain | 2251 | IQGAP2 | 42 |
| 5 | 75890947 | 75892204 | 1257 | gain | 2254 | IQGAP2 | 42 |
| 5 | 75890947 | 75892204 | 1257 | gain | 2269 | IQGAP2 | 42 |
| 5 | 75890947 | 75892204 | 1257 | gain | 2270 | IQGAP2 | 42 |
| 5 | 75890947 | 75892204 | 1257 | gain | 2283 | IQGAP2 | 42 |
| 5 | 75890947 | 75892204 | 1257 | gain | 2292 | IQGAP2 | 42 |
| 5 | 75890947 | 75892204 | 1257 | gain | 2334 | IQGAP2 | 42 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 5 | 75890947 | 75892204 | 1257 | gain | 2335 | IQGAP2 | 42 |
| 5 | 75890947 | 75892204 | 1257 | gain | 2344 | IQGAP2 | 42 |
| 5 | 75890947 | 75892204 | 1257 | gain | 2348 | IQGAP2 | 42 |
| 5 | 75890947 | 75892204 | 1257 | gain | 2360 | IQGAP2 | 42 |
| 5 | 75890947 | 75892204 | 1257 | gain | 2366 | IQGAP2 | 42 |
| 5 | 75890947 | 75892204 | 1257 | gain | 2370 | IQGAP2 | 42 |
| 5 | 75890947 | 75892204 | 1257 | gain | 2374 | IQGAP2 | 42 |
| 5 | 75890947 | 75892204 | 1257 | gain | 2375 | IQGAP2 | 42 |
| 5 | 75890947 | 75892204 | 1257 | gain | 2390 | IQGAP2 | 42 |
| 5 | 75890947 | 75892204 | 1257 | gain | 2399 | IQGAP2 | 42 |
| 5 | 75890947 | 75892204 | 1257 | gain | 2401 | IQGAP2 | 42 |
| 5 | 75890947 | 75892204 | 1257 | gain | 2409 | IQGAP2 | 42 |
| 5 | 75890947 | 75892204 | 1257 | gain | 2412 | IQGAP2 | 42 |
| 5 | 75890947 | 75892204 | 1257 | gain | 2434 | IQGAP2 | 42 |
| 5 | 75890947 | 75892204 | 1257 | gain | 2548 | IQGAP2 | 42 |
| 5 | 75890947 | 75892204 | 1257 | gain | 2578 | IQGAP2 | 42 |
| 5 | 75890947 | 75892204 | 1257 | gain | 2588 | IQGAP2 | 42 |
| 5 | 75890947 | 75892204 | 1257 | gain | 2599 | IQGAP2 | 42 |
| 5 | 75890947 | 75892204 | 1257 | gain | 2602 | IQGAP2 | 42 |
| 5 | 75890947 | 75892204 | 1257 | gain | 2604 | IQGAP2 | 42 |
| 5 | 75890947 | 75892204 | 1257 | gain | 2608 | IQGAP2 | 42 |
| 5 | 75890947 | 75892204 | 1257 | gain | 2609 | IQGAP2 | 42 |
| 5 | 75890947 | 75892204 | 1257 | gain | 2627 | IQGAP2 | 42 |
| 5 | 75890947 | 75892204 | 1257 | gain | 2642 | IQGAP2 | 42 |
| 18 | 3485718 | 3790299 | 304581 | gain | 2338 | DLGAP1 | 43 |
| 18 | 3707709 | 3714325 | 6616 | loss | 2423 | DLGAP1 | 44 |
| 14 | 54693682 | 54758853 | 65171 | gain | 2444 | DLGAP5 | 45 |
| 14 | 54683508 | 54695022 | 11514 | loss | 2520 | DLGAP5 | 46 |
| 3 | 857456 | 1111648 | 254192 | gain | 2246 | CNTN6 | 47 |
| 3 | 641257 | 1327726 | 686469 | gain | 2277 | CNTN6 | 48 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 3 | 1100700 | 1287892 | 187192 | gain | 2362 | CNTN6 | 49 |
| 3 | 857456 | 1111648 | 254192 | gain | 2440 | CNTN6 | 47 |
| 3 | 1329332 | 2206357 | 877025 | gain | 2386 | CNTN6 | 50 |
| 2 | 187807252 | 187811424 | 4172 | loss | 2408 | | 51 |
| 2 | 187807252 | 187811424 | 4172 | loss | 2409 | | 51 |
| 2 | 187811424 | 187859213 | 47789 | loss | 2383 | | 52 |
| 2 | 187811424 | 187859213 | 47789 | loss | 2628 | | 52 |
| 2 | 187940149 | 187947864 | 7715 | loss | 2313 | CALCRL | 53 |
| 16 | 86251331 | 86262922 | 11591 | gain | 2213 | JPH3 | 54 |
| 16 | 86228199 | 86314299 | 86100 | gain | 2291 | JPH3 | 55 |
| 16 | 86251331 | 86262922 | 11591 | gain | 2316 | JPH3 | 54 |
| 16 | 86251331 | 86262922 | 11591 | gain | 2357 | JPH3 | 54 |
| 16 | 86251331 | 86262922 | 11591 | gain | 2569 | JPH3 | 54 |
| 5 | 58832358 | 59098459 | 266101 | loss | 2278 | PDE4D | 56 |
| 5 | 59226196 | 59300771 | 74575 | loss | 2382 | PDE4D | 57 |
| 12 | 123880351 | 123881951 | 1600 | loss | 2052 | SCARB1 | 58 |
| 12 | 123880351 | 123881951 | 1600 | loss | 2631 | SCARB1 | 58 |
| 7 | 132556508 | 132562410 | 5902 | gain | 2530 | | 59 |
| 7 | 133261876 | 133433384 | 171508 | gain | 2280 | EXOC4 | 60 |
| 7 | 133332735 | 133337522 | 4787 | loss | 2046 | EXOC4 | 61 |
| 7 | 133261876 | 133433384 | 171508 | gain | 2280 | EXOC4 | 60 |
| 6 | 146479425 | 146480848 | 1423 | gain | 2385 | GRM1 | 62 |
| 6 | 146535737 | 146537005 | 1268 | loss | 2620 | GRM1 | 63 |
| 6 | 146576017 | 146587408 | 11391 | loss | 2293 | GRM1 | 64 |
| 12 | 65197400 | 65201495 | 4095 | gain | 2425 | GRIP1 | 65 |
| 12 | 65346329 | 65663755 | 317426 | loss | 2314 | GRIP1 | 66 |
| 11 | 14828676 | 14859461 | 30785 | gain | 2052 | CYP2R1,PDE3B | 67 |
| 11 | 14828676 | 14859461 | 30785 | gain | 2461 | CYP2R1,PDE3B | 67 |
| 15 | 91724801 | 91826047 | 101246 | loss | 2374 | | 68 |
| 15 | 91724801 | 91826047 | 101246 | loss | 2379 | | 68 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 15 | 91815727 | 91819844 | 4117 | loss | 2395 | | 69 |
| 3 | 147874434 | 148257978 | 383544 | gain | 2287 | | 70 |
| 3 | 147874434 | 148257978 | 383544 | gain | 2562 | | 70 |
| 8 | 53834519 | 54012598 | 178079 | gain | 2188 | | 71 |
| 8 | 53814949 | 53903530 | 88581 | gain | 2527 | | 72 |
| 10 | 67627258 | 67751642 | 124384 | loss | 2511 | CTNNA3 | 73 |
| 10 | 68234436 | 68253916 | 19480 | loss | 2431 | CTNNA3 | 74 |
| 10 | 35348062 | 35492204 | 144142 | gain | 2175 | CREM | 75 |
| 10 | 35466684 | 35553563 | 86879 | gain | 2587 | CREM | 76 |
| 10 | 35348062 | 35492204 | 144142 | gain | 2175 | CUL2 | 75 |
| 10 | 35191189 | 35355542 | 164353 | gain | 2587 | CUL2 | 77 |
| 5 | 113625639 | 113683448 | 57809 | loss | 2253 | | 78 |
| 5 | 113624028 | 113630429 | 6401 | loss | 2524 | | 79 |
| 5 | 113625639 | 113683448 | 57809 | loss | 2627 | | 78 |
| 5 | 113828411 | 113833132 | 4721 | loss | 2487 | KCNN2 | 80 |
| 20 | 42957116 | 43003149 | 46033 | gain | 2250 | PABPC1L,YWHAB | 81 |
| 20 | 30319299 | 48847084 | 18527785 | loss | 2434 | PABPC1L,YWHAB | 27 |
| 20 | 30319299 | 48847084 | 18527785 | loss | 2434 | STK4,STK4-AS1,TOMM34 | 27 |
| 2 | 132841126 | 133073531 | 232405 | gain | 2192 | GPR39 | 82 |
| 2 | 132750789 | 133073531 | 322742 | gain | 2257 | GPR39 | 83 |
| 21 | 36406529 | 36541621 | 135092 | gain | 2425 | CBR3,CBR3-AS1,DOPEY2 | 84 |
| 21 | 36406529 | 36541621 | 135092 | gain | 2562 | CBR3,CBR3-AS1,DOPEY2 | 84 |
| 21 | 36406529 | 36541621 | 135092 | gain | 2594 | CBR3,CBR3-AS1,DOPEY2 | 84 |
| 2 | 237598087 | 237611737 | 13650 | loss | 2302 | | 85 |
| 2 | 237598087 | 237611737 | 13650 | loss | 2576 | | 85 |
| 7 | 88700521 | 90272345 | 1571824 | gain | 2407 | C7orf63,DPY19L2P4,S | 86 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| | | | | | | TEAP1,STEAP2 | |
| 7 | 88480645 | 89722512 | 1241867 | gain | 2414 | C7orf63,DPY19L2P4,S TEAP1,STEAP2 | 87 |
| 13 | 83002653 | 83050863 | 48210 | loss | 2198 | | 88 |
| 13 | 83002653 | 83050863 | 48210 | loss | 2404 | | 88 |
| 13 | 83002653 | 83050863 | 48210 | loss | 2616 | | 88 |
| 1 | 190868384 | 190949255 | 80871 | loss | 2374 | RGS13 | 89 |
| 1 | 190868384 | 190949255 | 80871 | loss | 2379 | RGS13 | 89 |
| 12 | 71449263 | 71727215 | 277952 | gain | 2433 | | 90 |
| 12 | 71444573 | 71727215 | 282642 | gain | 2443 | | 91 |
| 12 | 76988327 | 76993905 | 5578 | loss | 2353 | NAV3 | 92 |
| 12 | 76916356 | 76996209 | 79853 | gain | 2599 | NAV3 | 93 |
| 12 | 77067661 | 77071720 | 4059 | gain | 2488 | NAV3 | 94 |
| 12 | 77070369 | 77071720 | 1351 | gain | 2502 | NAV3 | 95 |
| 12 | 77056359 | 77163307 | 106948 | gain | 2599 | NAV3 | 96 |
| 14 | 27578780 | 27592484 | 13704 | gain | 2360 | | 97 |
| 14 | 27536351 | 27587830 | 51479 | loss | 2520 | | 98 |
| 14 | 27536351 | 27587830 | 51479 | loss | 2603 | | 98 |
| 7 | 88700521 | 90272345 | 1571824 | gain | 2407 | CDK14 | 86 |
| 7 | 90481345 | 90483589 | 2244 | loss | 2254 | CDK14 | 99 |
| 7 | 90481345 | 90483589 | 2244 | loss | 2542 | CDK14 | 99 |
| 18 | 23888647 | 23894591 | 5944 | loss | 2197 | CDH2 | 100 |
| 18 | 24005554 | 24021722 | 16168 | gain | 2227 | CDH2 | 101 |
| 6 | 44952593 | 44954183 | 1590 | loss | 2543 | SUPT3H | 102 |
| 6 | 45248986 | 45257622 | 8636 | gain | 2318 | SUPT3H | 103 |
| 6 | 45274453 | 45354217 | 79764 | loss | 2493 | SUPT3H | 104 |
| 2 | 55626865 | 55630604 | 3739 | loss | 2524 | SMEK2 | 105 |
| 2 | 55535289 | 55665622 | 130333 | gain | 2171 | SMEK2 | 106 |
| 7 | 21473797 | 21586526 | 112729 | gain | 2247 | DNAH11,SP4 | 107 |
| 7 | 21879785 | 21949880 | 70095 | gain | 2372 | CDCA7L,DNAH11 | 108 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 4 | 175871609 | 176211042 | 339433 | gain | 2202 | ADAM29,GLRA3 | 109 |
| 4 | 175900638 | 175901419 | 781 | loss | 2204 | GLRA3 | 110 |
| 4 | 175903222 | 175905511 | 2289 | loss | 1001 | GLRA3 | 111 |
| 4 | 20248905 | 20361961 | 113056 | gain | 2260 | KCNIP4,PACRGL | 112 |
| 4 | 21129054 | 21183240 | 54186 | loss | 2186 | KCNIP4 | 113 |
| 6 | 163145133 | 163226084 | 80951 | loss | 2481 | PACRG | 114 |
| 6 | 163236692 | 163239980 | 3288 | gain | 2549 | PACRG | 115 |
| 15 | 53288438 | 53291249 | 2811 | loss | 2299 | RAB27A | 116 |
| 15 | 53294146 | 53296511 | 2365 | loss | 2583 | RAB27A | 117 |
| 5 | 60236661 | 60322623 | 85962 | loss | 2396 | ERCC8,NDUFAF2 | 118 |
| 5 | 60334124 | 60336373 | 2249 | loss | 2578 | NDUFAF2 | 119 |
| 4 | 77252837 | 77331259 | 78422 | gain | 2459 | NUP54,SCARB2 | 120 |
| 10 | 73262822 | 73480140 | 217318 | gain | 2477 | CHST3,PSAP | 121 |
| 2 | 130399977 | 130867198 | 467221 | gain | 2356 | CCDC74B,CCDC74B-AS1,LOC440905,POTEF,SMPD4 | 122 |
| 5 | 78312409 | 78313924 | 1515 | gain | 2470 | ARSB | 123 |
| 22 | 36857573 | 36869386 | 11813 | gain | 2608 | PLA2G6 | 124 |
| 20 | 29609631 | 29767994 | 158363 | gain | 2299 | BCL2L1,COX4I2,HM13,HM13-AS1,ID1,MIR3193 | 125 |
| 16 | 87418867 | 87626174 | 207307 | gain | 2333 | CBFA2T3,GALNS,PABPN1L,TRAPPC2L | 126 |
| 16 | 68304615 | 68314645 | 10030 | loss | 2359 | NQO1 | 127 |
| 11 | 47473954 | 47620969 | 147015 | gain | 2478 | C1QTNF4,FAM180B,MTCH2 | 128 |
| 5 | 52947658 | 52952260 | 4602 | loss | 2266 | NDUFS4 | 129 |
| 9 | 70809673 | 70997408 | 187735 | gain | 2616 | FXN,PIP5K1B,PRKACG,TJP2 | 130 |
| 5 | 137617658 | 137682772 | 65114 | gain | 2218 | CDC25C,GFRA3 | 131 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 23 | 122378954 | 122486760 | 107806 | gain | 2593 | GRIA3 | 132 |
| 11 | 67101848 | 67330919 | 229071 | gain | 2346 | ACY3,ALDH3B2,DOC2GP,FAM86C2P,GSTP1,NDUFV1,NUDT8,TBX10 | 133 |
| 1 | 144093719 | 144458571 | 364852 | gain | 2478 | ANKRD34A,ANKRD35,GNRHR2,HFE2,ITGA10,LIX1L,NUDT17,PEX11B,PIAS3,POLR3C,POLR3GL,RBM8A,RNF115,TXNIP | 134 |
| 1 | 151567338 | 151700811 | 133473 | gain | 2339 | PGLYRP4,S100A7,S100A7A,S100A7L2,S100A8,S100A9,S100A12 | 135 |
| 2 | 31453743 | 31707588 | 253845 | gain | 2583 | XDH | 136 |
| 2 | 31453743 | 31707588 | 253845 | gain | 2583 | SRD5A2 | 136 |
| 2 | 55105225 | 55112274 | 7049 | gain | 2226 | RTN4 | 137 |
| 5 | 40821401 | 40893568 | 72167 | gain | 2334 | CARD6,LOC100506548,PRKAA1,RPL37,SNORD72 | 138 |
| 7 | 151138075 | 151140124 | 2049 | loss | 2238 | PRKAG2 | 139 |
| 12 | 51828389 | 52008781 | 180392 | gain | 2207 | AAAS,C12orf10,CSAD,ESPL1,ITGB7,MFSD5,PFDN5,RARG,ZNF740 | 140 |
| 17 | 6547639 | 6553756 | 6117 | loss | 2271 | SLC13A5 | 141 |
| 23 | 15708102 | 15719415 | 11313 | gain | 2641 | CA5B,INE2,ZRSR2 | 142 |
| 12 | 2274118 | 2280757 | 6639 | loss | 2617 | CACNA1C | 143 |
| 22 | 18618206 | 19794060 | 1175854 | loss | 2319 | DGCR6L,KLHL22,LOC729444,MED15,PI4KAP1,RIMBP3,RTN4R,S | 144 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| | | | | | | CARF2,TMEM191B,ZNF74 | |
| 11 | 77404906 | 77409447 | 4541 | loss | 2518 | KCTD14,NDUFC2-KCTD14 | 145 |
| 12 | 119355352 | 119372494 | 17142 | gain | 2048 | COX6A1,GATC,TRIAP1 | 146 |
| 2 | 97379946 | 97640710 | 260764 | gain | 2307 | ACTR1B,ANKRD36B,COX5B | 147 |
| 2 | 97379946 | 97640710 | 260764 | gain | 2317 | ACTR1B,ANKRD36B,COX5B | 147 |
| 12 | 110665203 | 110799506 | 134303 | gain | 2322 | ACAD10,ALDH2,MAPKAPK5,MAPKAPK5-AS1 | 148 |
| 11 | 6926478 | 9212517 | 2286039 | gain | 2489 | NLRP14 | 149 |
| 1 | 245632608 | 245990401 | 357793 | gain | 2549 | NLRP3 | 150 |
| 23 | 96600761 | 96816526 | 215765 | gain | 2297 | DIAPH2 | 151 |
| 13 | 59324281 | 59581884 | 257603 | loss | 2319 | DIAPH3 | 152 |
| 8 | 38204506 | 38240266 | 35760 | loss | 2191 | DDHD2,PPAPDC1B | 153 |
| 7 | 122112008 | 122160357 | 48349 | loss | 2200 | CADPS2,RNF133,RNF148 | 154 |
| 13 | 19042791 | 19249745 | 206954 | gain | 2227 | MPHOSPH8,PSPC1 | 155 |
| 12 | 69559974 | 69653136 | 93162 | loss | 2363 | PTPRR | 156 |
| 15 | 30701373 | 30873303 | 171930 | gain | 2452 | ARHGAP11A,SCG5 | 157 |
| 3 | 122766784 | 122876107 | 109323 | gain | 2630 | ARGFX,FBXO40,GOLGB1,HCLS1 | 158 |
| 22 | 22504477 | 22586421 | 81944 | gain | 2617 | DERL3,LOC284889,MIF,SLC2A11,SMARCB1 | 159 |
| 15 | 30701373 | 30873303 | 171930 | gain | 2452 | FMN1 | 157 |
| 11 | 74265911 | 74775744 | 509833 | gain | 2191 | NEU3,SPCS2,XRRA1 | 160 |
| 15 | 38248407 | 38312698 | 64291 | loss | 2519 | BUB1B,PAK6 | 161 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 14 | 101853463 | 102250716 | 397253 | gain | 2378 | RCOR1 | 162 |
| 5 | 136320037 | 136407927 | 87890 | loss | 2392 | SPOCK1 | 163 |
| 11 | 74265911 | 74775744 | 509833 | gain | 2191 | ARRB1,MIR326 | 160 |
| 15 | 26805834 | 27170967 | 365133 | gain | 2452 | APBA2 | 164 |
| 21 | 36783398 | 36822143 | 38745 | gain | 2185 | CLDN14 | 165 |
| 2 | 233864383 | 234004039 | 139656 | gain | 2488 | DGKD | 166 |
| 15 | 30701373 | 30873303 | 171930 | gain | 2452 | GREM1 | 157 |
| 21 | 37080782 | 37347439 | 266657 | gain | 2267 | HLCS | 167 |
| 7 | 119962649 | 120036540 | 73891 | loss | 2253 | KCND2 | 168 |
| 2 | 112333620 | 112628177 | 294557 | gain | 2216 | FBLN7,MERTK,TMEM87B | 169 |
| 9 | 70228702 | 70774604 | 545902 | gain | 2314 | PGM5,PIP5K1B,TMEM252 | 170 |
| 14 | 72660748 | 72737170 | 76422 | gain | 2331 | PSEN1 | 171 |
| 13 | 50381620 | 50570709 | 189089 | loss | 2615 | GUCY1B2,RNASEH2B,RNASEH2B-AS1 | 172 |
| 14 | 101853463 | 102250716 | 397253 | gain | 2378 | CINP,TECPR2,ZNF839 | 162 |
| 11 | 6926478 | 9212517 | 2286039 | gain | 2489 | TUB | 149 |
| 1 | 28656279 | 28748021 | 91742 | gain | 2471 | PHACTR4,RCC1,SNHG3 | 173 |
| 1 | 153872608 | 153992044 | 119436 | loss | 2206 | DAP3,YY1AP1 | 174 |
| 1 | 221658208 | 222013960 | 355752 | loss | 2261 | CAPN2,CAPN8 | 175 |
| 2 | 32200039 | 32481148 | 281109 | gain | 2306 | NLRC4,SLC30A6,SPAST,YIPF4 | 176 |
| 2 | 222117216 | 222123097 | 5881 | gain | 2053 | EPHA4 | 177 |
| 2 | 233864383 | 234004039 | 139656 | gain | 2488 | ATG16L1,SAG | 166 |
| 3 | 11454506 | 11511697 | 57191 | loss | 2382 | ATG7 | 178 |
| 7 | 5173548 | 5252229 | 78681 | loss | 2410 | WIPI2 | 179 |
| 7 | 106511676 | 106514719 | 3043 | loss | 2304 | PRKAR2B | 180 |
| 7 | 106511676 | 106514719 | 3043 | loss | 2361 | PRKAR2B | 180 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 9 | 139521467 | 139572463 | 50996 | gain | 2582 | MRPL41,PNPLA7,WDR85 | 181 |
| 10 | 12126119 | 12302394 | 176275 | gain | 2255 | DHTKD1,SEC61A2 | 182 |
| 11 | 82269399 | 82384109 | 114710 | gain | 2364 | C11orf82,PRCP,RAB30 | 183 |
| 11 | 93451074 | 93529413 | 78339 | gain | 2322 | HEPHL1,PANX1 | 184 |
| 12 | 121985500 | 121986227 | 727 | loss | 2227 | ABCB9 | 185 |
| 12 | 121974089 | 122222496 | 248407 | loss | 2304 | ABCB9 | 186 |
| 13 | 34521247 | 34527508 | 6261 | gain | 2403 | NBEA | 187 |
| 15 | 63053972 | 63133302 | 79330 | gain | 2514 | MTFMT,RASL12,SLC51B,SPG21 | 188 |
| 15 | 88639588 | 88806981 | 167393 | gain | 2260 | GABARAPL3,IQGAP1,ZNF774 | 189 |
| 18 | 37877518 | 37966336 | 88818 | gain | 2602 | PIK3C3 | 190 |
| 20 | 57680390 | 57694510 | 14120 | loss | 2187 | PHACTR3 | 191 |
| 20 | 57692392 | 57694510 | 2118 | loss | 2506 | PHACTR3 | 192 |
| 20 | 57731345 | 57748610 | 17265 | loss | 2204 | PHACTR3 | 193 |
| 20 | 57731345 | 57748610 | 17265 | loss | 2249 | PHACTR3 | 193 |
| 20 | 57731345 | 57748610 | 17265 | loss | 2254 | PHACTR3 | 193 |
| 20 | 57731345 | 57748610 | 17265 | loss | 2318 | PHACTR3 | 193 |
| 20 | 57731345 | 57748610 | 17265 | loss | 2361 | PHACTR3 | 193 |
| 20 | 57731345 | 57748610 | 17265 | loss | 2469 | PHACTR3 | 193 |
| 20 | 57731345 | 57748610 | 17265 | loss | 2485 | PHACTR3 | 193 |
| 20 | 57731345 | 57748610 | 17265 | loss | 2576 | PHACTR3 | 193 |
| 20 | 57731345 | 57748610 | 17265 | loss | 2634 | PHACTR3 | 193 |
| 21 | 32869796 | 33019712 | 149916 | gain | 2609 | C21orf59,SYNJ1,TCP10L | 194 |
| 21 | 34646173 | 34826979 | 180806 | gain | 2209 | KCNE1,RCAN1,SMIM11 | 195 |
| 21 | 34666916 | 34844413 | 177497 | gain | 2297 | KCNE1,RCAN1,SMIM11 | 196 |

Figure 8A (Continued)

| Figure 8A | | | | | | |
|---|---|---|---|---|---|---|
| Chr | Original CNV Start | Original CNV Stop | Original CNV Size | CNV Type | PD Case ID | RefSeq Gene Symbol | SEQ ID |
| 23 | 2749116 | 2814330 | 65214 | gain | 2333 | GYG2 | 197 |

Figure 8A (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 14 | 31189082 | 31191639 | 2557 | loss | 2295 | NUBPL | 16.61 | Genic; OR > 6 | 1059 |
| 14 | 31189082 | 31191639 | 2557 | loss | 2301 | NUBPL | 16.61 | Genic; OR > 6 | 1059 |
| 14 | 31189082 | 31191639 | 2557 | loss | 2317 | NUBPL | 16.61 | Genic; OR > 6 | 1059 |
| 14 | 31189082 | 31191639 | 2557 | loss | 2342 | NUBPL | 16.61 | Genic; OR > 6 | 1059 |
| 14 | 31189082 | 31191639 | 2557 | loss | 2346 | NUBPL | 16.61 | Genic; OR > 6 | 1059 |
| 14 | 31189082 | 31191639 | 2557 | loss | 2389 | NUBPL | 16.61 | Genic; OR > 6 | 1059 |
| 14 | 31189082 | 31191639 | 2557 | loss | 2392 | NUBPL | 16.61 | Genic; OR > 6 | 1059 |
| 14 | 31189082 | 31191639 | 2557 | loss | 2418 | NUBPL | 16.61 | Genic; OR > 6 | 1059 |
| 14 | 31189082 | 31191639 | 2557 | loss | 2540 | NUBPL | 16.61 | Genic; OR > 6 | 1059 |
| 14 | 31189082 | 31191639 | 2557 | loss | 2563 | NUBPL | 16.61 | Genic; OR > 6 | 1059 |
| 14 | 31189082 | 31191639 | 2557 | loss | 2591 | NUBPL | 16.61 | Genic; OR > 6 | 1059 |
| 14 | 31189082 | 31191639 | 2557 | loss | 2612 | NUBPL | 16.61 | Genic; OR > 6 | 1059 |
| 14 | 31189082 | 31191639 | 2557 | loss | 2622 | NUBPL | 16.61 | Genic; OR > 6 | 1059 |
| 14 | 31189082 | 31191639 | 2557 | loss | 2627 | NUBPL | 16.61 | Genic; OR > 6 | 1059 |
| 14 | 30937580 | 31191639 | 254059 | loss | 2494 | NUBPL | 16.61 | Genic; OR > 6 | 1060 |
| 3 | 172536723 | 172538075 | 1352 | gain | 2279 | TNIK | 19.69 | Genic; OR > 6 | 1061 |
| 3 | 172536723 | 172539488 | 2765 | gain | 2054 | TNIK | 19.69 | Genic; OR > 6 | 1062 |
| 3 | 172536723 | 172539488 | 2765 | gain | 2283 | TNIK | 19.69 | Genic; OR > 6 | 1062 |
| 3 | 172536723 | 172539488 | 2765 | gain | 2421 | TNIK | 19.69 | Genic; OR > 6 | 1062 |
| 3 | 172536723 | 172539488 | 2765 | gain | 2594 | TNIK | 19.69 | Genic; OR > 6 | 1062 |
| 3 | 172536723 | 172539488 | 2765 | gain | 2601 | TNIK | 19.69 | Genic; OR > 6 | 1062 |
| 3 | 172536723 | 172539488 | 2765 | gain | 2610 | TNIK | 19.69 | Genic; OR > 6 | 1062 |
| 3 | 172536723 | 172539488 | 2765 | gain | 2614 | TNIK | 19.69 | Genic; OR > 6 | 1062 |
| 3 | 172536723 | 172539488 | 2765 | gain | 2645 | TNIK | 19.69 | Genic; OR > 6 | 1062 |
| 3 | 172536723 | 172539488 | 2765 | gain | 2054 | TNIK | 17.46 | Genic; OR > 6 | 1062 |
| 3 | 172536723 | 172539488 | 2765 | gain | 2283 | TNIK | 17.46 | Genic; OR > 6 | 1062 |

Figure 8B

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 3 | 172536723 | 172539488 | 2765 | gain | 2421 | TNIK | 17.46 | Genic; OR > 6 | 1062 |
| 3 | 172536723 | 172539488 | 2765 | gain | 2594 | TNIK | 17.46 | Genic; OR > 6 | 1062 |
| 3 | 172536723 | 172539488 | 2765 | gain | 2601 | TNIK | 17.46 | Genic; OR > 6 | 1062 |
| 3 | 172536723 | 172539488 | 2765 | gain | 2610 | TNIK | 17.46 | Genic; OR > 6 | 1062 |
| 3 | 172536723 | 172539488 | 2765 | gain | 2614 | TNIK | 17.46 | Genic; OR > 6 | 1062 |
| 3 | 172536723 | 172539488 | 2765 | gain | 2645 | TNIK | 17.46 | Genic; OR > 6 | 1062 |
| 6 | 107108807 | 107111183 | 2376 | gain | 2181 | AIM1 | 26.42 | Genic; OR > 6 | 1063 |
| 6 | 107108807 | 107111183 | 2376 | gain | 2240 | AIM1 | 26.42 | Genic; OR > 6 | 1063 |
| 6 | 107108807 | 107111183 | 2376 | gain | 2286 | AIM1 | 26.42 | Genic; OR > 6 | 1063 |
| 6 | 107108807 | 107111183 | 2376 | gain | 2305 | AIM1 | 26.42 | Genic; OR > 6 | 1063 |
| 6 | 107108807 | 107111183 | 2376 | gain | 2336 | AIM1 | 26.42 | Genic; OR > 6 | 1063 |
| 6 | 107108807 | 107111183 | 2376 | gain | 2342 | AIM1 | 26.42 | Genic; OR > 6 | 1063 |
| 6 | 107108807 | 107111183 | 2376 | gain | 2410 | AIM1 | 26.42 | Genic; OR > 6 | 1063 |
| 6 | 107108807 | 107111183 | 2376 | gain | 2413 | AIM1 | 26.42 | Genic; OR > 6 | 1063 |
| 6 | 107108807 | 107111183 | 2376 | gain | 2513 | AIM1 | 26.42 | Genic; OR > 6 | 1063 |
| 6 | 107108807 | 107111183 | 2376 | gain | 2563 | AIM1 | 26.42 | Genic; OR > 6 | 1063 |
| 6 | 107108807 | 107111183 | 2376 | gain | 2565 | AIM1 | 26.42 | Genic; OR > 6 | 1063 |
| 6 | 107108807 | 107111183 | 2376 | gain | 2643 | AIM1 | 26.42 | Genic; OR > 6 | 1063 |
| 16 | 4616587 | 4616982 | 395 | gain | 2049 | MGRN1 | 19.69 | Genic; OR > 6 | 1064 |
| 16 | 4616587 | 4616982 | 395 | gain | 2176 | MGRN1 | 19.69 | Genic; OR > 6 | 1064 |
| 16 | 4616587 | 4616982 | 395 | gain | 2192 | MGRN1 | 19.69 | Genic; OR > 6 | 1064 |
| 16 | 4616587 | 4616982 | 395 | gain | 2222 | MGRN1 | 19.69 | Genic; OR > 6 | 1064 |
| 16 | 4616587 | 4616982 | 395 | gain | 2462 | MGRN1 | 19.69 | Genic; OR > 6 | 1064 |
| 16 | 4616587 | 4616982 | 395 | gain | 2470 | MGRN1 | 19.69 | Genic; OR > 6 | 1064 |
| 16 | 4616587 | 4616982 | 395 | gain | 2484 | MGRN1 | 19.69 | Genic; OR > 6 | 1064 |
| 16 | 4616587 | 4616982 | 395 | gain | 2490 | MGRN1 | 19.69 | Genic; OR > 6 | 1064 |
| 16 | 4616587 | 4616982 | 395 | gain | 2497 | MGRN1 | 19.69 | Genic; OR > 6 | 1064 |
| 4 | 9563784 | 9567377 | 3593 | loss | 2048 | SLC2A9 | 8 | Genic; OR > 6 | 1065 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 4 | 9563784 | 9567377 | 3593 | loss | 2050 | SLC2A9 | 8 | Genic; OR > 6 | 1065 |
| 4 | 9563784 | 9567377 | 3593 | loss | 2051 | SLC2A9 | 8 | Genic; OR > 6 | 1065 |
| 4 | 9563784 | 9567377 | 3593 | loss | 2172 | SLC2A9 | 8 | Genic; OR > 6 | 1065 |
| 4 | 9563784 | 9567377 | 3593 | loss | 2257 | SLC2A9 | 8 | Genic; OR > 6 | 1065 |
| 4 | 9563784 | 9567377 | 3593 | loss | 2288 | SLC2A9 | 8 | Genic; OR > 6 | 1065 |
| 4 | 9563784 | 9567377 | 3593 | loss | 2332 | SLC2A9 | 8 | Genic; OR > 6 | 1065 |
| 4 | 9563784 | 9567377 | 3593 | loss | 2365 | SLC2A9 | 8 | Genic; OR > 6 | 1065 |
| 4 | 9563784 | 9567377 | 3593 | loss | 2405 | SLC2A9 | 8 | Genic; OR > 6 | 1065 |
| 4 | 9563784 | 9567377 | 3593 | loss | 2406 | SLC2A9 | 8 | Genic; OR > 6 | 1065 |
| 4 | 9563784 | 9567377 | 3593 | loss | 2419 | SLC2A9 | 8 | Genic; OR > 6 | 1065 |
| 4 | 9563784 | 9567377 | 3593 | loss | 2428 | SLC2A9 | 8 | Genic; OR > 6 | 1065 |
| 4 | 9563784 | 9567377 | 3593 | loss | 2435 | SLC2A9 | 8 | Genic; OR > 6 | 1065 |
| 4 | 9563784 | 9567377 | 3593 | loss | 2501 | SLC2A9 | 8 | Genic; OR > 6 | 1065 |
| 4 | 9563784 | 9567377 | 3593 | loss | 2519 | SLC2A9 | 8 | Genic; OR > 6 | 1065 |
| 4 | 9563784 | 9567377 | 3593 | loss | 2568 | SLC2A9 | 8 | Genic; OR > 6 | 1065 |
| 4 | 9563784 | 9567377 | 3593 | loss | 2596 | SLC2A9 | 8 | Genic; OR > 6 | 1065 |
| 4 | 9563784 | 9567377 | 3593 | loss | 2615 | SLC2A9 | 8 | Genic; OR > 6 | 1065 |
| 12 | 9117468 | 9125246 | 7778 | loss | 2054 | A2M | 14.33 | Genic; OR > 6 | 1066 |
| 12 | 9117468 | 9125246 | 7778 | loss | 2251 | A2M | 14.33 | Genic; OR > 6 | 1066 |
| 12 | 9117468 | 9125246 | 7778 | loss | 2261 | A2M | 14.33 | Genic; OR > 6 | 1066 |
| 12 | 9117468 | 9125246 | 7778 | loss | 2264 | A2M | 14.33 | Genic; OR > 6 | 1066 |
| 12 | 9117468 | 9125246 | 7778 | loss | 2280 | A2M | 14.33 | Genic; OR > 6 | 1066 |
| 12 | 9117468 | 9125246 | 7778 | loss | 2288 | A2M | 14.33 | Genic; OR > 6 | 1066 |
| 12 | 9117468 | 9125246 | 7778 | loss | 2372 | A2M | 14.33 | Genic; OR > 6 | 1066 |
| 12 | 9117468 | 9125246 | 7778 | loss | 2378 | A2M | 14.33 | Genic; OR > 6 | 1066 |
| 12 | 9117468 | 9125246 | 7778 | loss | 2405 | A2M | 14.33 | Genic; OR > 6 | 1066 |
| 12 | 9117468 | 9125246 | 7778 | loss | 2552 | A2M | 14.33 | Genic; OR > 6 | 1066 |
| 12 | 9117468 | 9125246 | 7778 | loss | 2561 | A2M | 14.33 | Genic; OR > 6 | 1066 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 12 | 9117468 | 9125246 | 7778 | loss | 2598 | A2M | 14.33 | Genic; OR > 6 | 1066 |
| 12 | 9117468 | 9132070 | 14602 | loss | 2408 | A2M | 14.33 | Genic; OR > 6 | 1067 |
| 8 | 75802283 | 75804852 | 2569 | loss | 2048 | FLJ39080 | 63.89 | Genic; OR > 6 | 1068 |
| 8 | 75802283 | 75804852 | 2569 | loss | 2248 | FLJ39080 | 63.89 | Genic; OR > 6 | 1068 |
| 8 | 75802283 | 75804852 | 2569 | loss | 2261 | FLJ39080 | 63.89 | Genic; OR > 6 | 1068 |
| 8 | 75802283 | 75804852 | 2569 | loss | 2264 | FLJ39080 | 63.89 | Genic; OR > 6 | 1068 |
| 8 | 75802283 | 75804852 | 2569 | loss | 2288 | FLJ39080 | 63.89 | Genic; OR > 6 | 1068 |
| 8 | 75802283 | 75804852 | 2569 | loss | 2292 | FLJ39080 | 63.89 | Genic; OR > 6 | 1068 |
| 8 | 75802283 | 75804852 | 2569 | loss | 2296 | FLJ39080 | 63.89 | Genic; OR > 6 | 1068 |
| 8 | 75802283 | 75804852 | 2569 | loss | 2340 | FLJ39080 | 63.89 | Genic; OR > 6 | 1068 |
| 8 | 75802283 | 75804852 | 2569 | loss | 2350 | FLJ39080 | 63.89 | Genic; OR > 6 | 1068 |
| 8 | 75802283 | 75804852 | 2569 | loss | 2376 | FLJ39080 | 63.89 | Genic; OR > 6 | 1068 |
| 8 | 75802283 | 75804852 | 2569 | loss | 2379 | FLJ39080 | 63.89 | Genic; OR > 6 | 1068 |
| 8 | 75802283 | 75804852 | 2569 | loss | 2415 | FLJ39080 | 63.89 | Genic; OR > 6 | 1068 |
| 8 | 75802283 | 75804852 | 2569 | loss | 2417 | FLJ39080 | 63.89 | Genic; OR > 6 | 1068 |
| 8 | 75802283 | 75804852 | 2569 | loss | 2421 | FLJ39080 | 63.89 | Genic; OR > 6 | 1068 |
| 8 | 75802283 | 75804852 | 2569 | loss | 2424 | FLJ39080 | 63.89 | Genic; OR > 6 | 1068 |
| 8 | 75802283 | 75804852 | 2569 | loss | 2426 | FLJ39080 | 63.89 | Genic; OR > 6 | 1068 |
| 8 | 75802283 | 75804852 | 2569 | loss | 2430 | FLJ39080 | 63.89 | Genic; OR > 6 | 1068 |
| 8 | 75802283 | 75804852 | 2569 | loss | 2544 | FLJ39080 | 63.89 | Genic; OR > 6 | 1068 |
| 8 | 75802283 | 75804852 | 2569 | loss | 2548 | FLJ39080 | 63.89 | Genic; OR > 6 | 1068 |
| 8 | 75802283 | 75804852 | 2569 | loss | 2555 | FLJ39080 | 63.89 | Genic; OR > 6 | 1068 |
| 8 | 75802283 | 75804852 | 2569 | loss | 2561 | FLJ39080 | 63.89 | Genic; OR > 6 | 1068 |
| 8 | 75802283 | 75804852 | 2569 | loss | 2572 | FLJ39080 | 63.89 | Genic; OR > 6 | 1068 |
| 8 | 75802283 | 75804852 | 2569 | loss | 2589 | FLJ39080 | 63.89 | Genic; OR > 6 | 1068 |
| 8 | 75802283 | 75804852 | 2569 | loss | 2595 | FLJ39080 | 63.89 | Genic; OR > 6 | 1068 |
| 8 | 75802283 | 75804852 | 2569 | loss | 2602 | FLJ39080 | 63.89 | Genic; OR > 6 | 1068 |

| Chr | Original CNV Start | Original CNV Stop | Original CNV Size | CNV Type | PD Case ID(s) | RefSeq Gene Symbol(s) | OR | Category | SEQ_ID |
|---|---|---|---|---|---|---|---|---|---|
| 8 | 75802283 | 75804852 | 2569 | loss | 2633 | FLJ39080 | 63.89 | Genic; OR > 6 | 1068 |
| 8 | 75797477 | 75804852 | 7375 | loss | 2445 | FLJ39080 | 63.89 | Genic; OR > 6 | 1069 |
| 8 | 75797477 | 75804852 | 7375 | loss | 2611 | FLJ39080 | 63.89 | Genic; OR > 6 | 1069 |
| 2 | 46430798 | 46434943 | 4145 | gain | 2268 | EPAS1 | 14.91 | Genic; OR > 6 | 1070 |
| 2 | 46430798 | 46434943 | 4145 | gain | 2283 | EPAS1 | 14.91 | Genic; OR > 6 | 1070 |
| 2 | 46430798 | 46434943 | 4145 | gain | 2290 | EPAS1 | 14.91 | Genic; OR > 6 | 1070 |
| 2 | 46430798 | 46434943 | 4145 | gain | 2297 | EPAS1 | 14.91 | Genic; OR > 6 | 1070 |
| 2 | 46430798 | 46434943 | 4145 | gain | 2298 | EPAS1 | 14.91 | Genic; OR > 6 | 1070 |
| 2 | 46430798 | 46434943 | 4145 | gain | 2312 | EPAS1 | 14.91 | Genic; OR > 6 | 1070 |
| 2 | 46430798 | 46434943 | 4145 | gain | 2314 | EPAS1 | 14.91 | Genic; OR > 6 | 1070 |
| 2 | 46430798 | 46434943 | 4145 | gain | 2359 | EPAS1 | 14.91 | Genic; OR > 6 | 1070 |
| 2 | 46430798 | 46434943 | 4145 | gain | 2365 | EPAS1 | 14.91 | Genic; OR > 6 | 1070 |
| 2 | 46430798 | 46434943 | 4145 | gain | 2367 | EPAS1 | 14.91 | Genic; OR > 6 | 1070 |
| 2 | 46430798 | 46434943 | 4145 | gain | 2382 | EPAS1 | 14.91 | Genic; OR > 6 | 1070 |
| 2 | 46430798 | 46434943 | 4145 | gain | 2391 | EPAS1 | 14.91 | Genic; OR > 6 | 1070 |
| 2 | 46430798 | 46434943 | 4145 | gain | 2445 | EPAS1 | 14.91 | Genic; OR > 6 | 1070 |
| 2 | 46430798 | 46434943 | 4145 | gain | 2542 | EPAS1 | 14.91 | Genic; OR > 6 | 1070 |
| 2 | 46430798 | 46434943 | 4145 | gain | 2569 | EPAS1 | 14.91 | Genic; OR > 6 | 1070 |
| 2 | 46430798 | 46434943 | 4145 | gain | 2579 | EPAS1 | 14.91 | Genic; OR > 6 | 1070 |
| 2 | 46430798 | 46434943 | 4145 | gain | 2580 | EPAS1 | 14.91 | Genic; OR > 6 | 1070 |
| 2 | 46430798 | 46434943 | 4145 | gain | 2584 | EPAS1 | 14.91 | Genic; OR > 6 | 1070 |
| 2 | 46430798 | 46434943 | 4145 | gain | 2595 | EPAS1 | 14.91 | Genic; OR > 6 | 1070 |
| 2 | 46430798 | 46434943 | 4145 | gain | 2627 | EPAS1 | 14.91 | Genic; OR > 6 | 1070 |
| 8 | 120694397 | 120696229 | 1832 | gain | 2055 | ENPP2 | 7.03 | Genic; OR > 6 | 1071 |
| 8 | 120694397 | 120696229 | 1832 | gain | 2266 | ENPP2 | 7.03 | Genic; OR > 6 | 1071 |
| 8 | 120694397 | 120696229 | 1832 | gain | 2271 | ENPP2 | 7.03 | Genic; OR > 6 | 1071 |
| 8 | 120694397 | 120696229 | 1832 | gain | 2291 | ENPP2 | 7.03 | Genic; OR > 6 | 1071 |
| 8 | 120694397 | 120696229 | 1832 | gain | 2312 | ENPP2 | 7.03 | Genic; OR > 6 | 1071 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 8 | 120694397 | 120696229 | 1832 | gain | 2325 | ENPP2 | 7.03 | Genic; OR > 6 | 1071 |
| 8 | 120694397 | 120696229 | 1832 | gain | 2358 | ENPP2 | 7.03 | Genic; OR > 6 | 1071 |
| 8 | 120694397 | 120696229 | 1832 | gain | 2379 | ENPP2 | 7.03 | Genic; OR > 6 | 1071 |
| 8 | 120694397 | 120696229 | 1832 | gain | 2384 | ENPP2 | 7.03 | Genic; OR > 6 | 1071 |
| 8 | 120694397 | 120696229 | 1832 | gain | 2409 | ENPP2 | 7.03 | Genic; OR > 6 | 1071 |
| 8 | 120694397 | 120696229 | 1832 | gain | 2425 | ENPP2 | 7.03 | Genic; OR > 6 | 1071 |
| 8 | 120694397 | 120696229 | 1832 | gain | 2431 | ENPP2 | 7.03 | Genic; OR > 6 | 1071 |
| 8 | 120694397 | 120696229 | 1832 | gain | 2438 | ENPP2 | 7.03 | Genic; OR > 6 | 1071 |
| 8 | 120694397 | 120696229 | 1832 | gain | 2439 | ENPP2 | 7.03 | Genic; OR > 6 | 1071 |
| 8 | 120694397 | 120696229 | 1832 | gain | 2444 | ENPP2 | 7.03 | Genic; OR > 6 | 1071 |
| 8 | 120694397 | 120696229 | 1832 | gain | 2546 | ENPP2 | 7.03 | Genic; OR > 6 | 1071 |
| 8 | 120694397 | 120696229 | 1832 | gain | 2551 | ENPP2 | 7.03 | Genic; OR > 6 | 1071 |
| 8 | 120694397 | 120696229 | 1832 | gain | 2578 | ENPP2 | 7.03 | Genic; OR > 6 | 1071 |
| 8 | 120694397 | 120696229 | 1832 | gain | 2588 | ENPP2 | 7.03 | Genic; OR > 6 | 1071 |
| 8 | 120694397 | 120696229 | 1832 | gain | 2602 | ENPP2 | 7.03 | Genic; OR > 6 | 1071 |
| 8 | 120694397 | 120696229 | 1832 | gain | 2633 | ENPP2 | 7.03 | Genic; OR > 6 | 1071 |
| 8 | 120694397 | 120696229 | 1832 | gain | 2643 | ENPP2 | 7.03 | Genic; OR > 6 | 1071 |
| 6 | 65921701 | 65951879 | 30178 | loss | 2350 | EYS | 10.84 | Genic; OR > 6 | 1072 |
| 6 | 65921701 | 65951879 | 30178 | loss | 2350 | EYS | 10.84 | Genic; OR > 6 | 1072 |
| 6 | 65886117 | 65968154 | 82037 | loss | 2402 | EYS | 10.84 | Genic; OR > 6 | 1073 |
| 6 | 65886117 | 65968154 | 82037 | loss | 2403 | EYS | 10.84 | Genic; OR > 6 | 1073 |
| 6 | 65886117 | 65968154 | 82037 | loss | 2416 | EYS | 10.84 | Genic; OR > 6 | 1073 |
| 6 | 65886117 | 65968154 | 8203 | loss | 2402 | EYS | 10.84 | Genic; OR > 6 | 1073 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 6 | 65886117 | 65968154 | 82037 | loss | 2403 | EYS | 10.84 | Genic; OR > 6 | 1073 |
| 6 | 65886117 | 65968154 | 82037 | loss | 2416 | EYS | 10.84 | Genic; OR > 6 | 1073 |
| 6 | 65886117 | 65968154 | 82037 | loss | 2402 | EYS | 8.66 | Genic; OR > 6 | 1073 |
| 6 | 65886117 | 65968154 | 82037 | loss | 2403 | EYS | 8.66 | Genic; OR > 6 | 1073 |
| 6 | 65886117 | 65968154 | 82037 | loss | 2416 | EYS | 8.66 | Genic; OR > 6 | 1073 |
| 6 | 65886117 | 65968154 | 82037 | loss | 2402 | EYS | 8.66 | Genic; OR > 6 | 1073 |
| 6 | 65886117 | 65968154 | 82037 | loss | 2403 | EYS | 8.66 | Genic; OR > 6 | 1073 |
| 6 | 65886117 | 65968154 | 82037 | loss | 2416 | EYS | 8.66 | Genic; OR > 6 | 1073 |
| 6 | 65243439 | 66453686 | 1210247 | loss | 2292 | EYS | 10.84 | Genic; OR > 6 | 1074 |
| 6 | 65243439 | 66453686 | 1210247 | loss | 2292 | EYS | 10.84 | Genic; OR > 6 | 1074 |
| 6 | 65243439 | 66453686 | 1210247 | loss | 2292 | EYS | 8.66 | Genic; OR > 6 | 1074 |
| 6 | 65243439 | 66453686 | 1210247 | loss | 2292 | EYS | 8.66 | Genic; OR > 6 | 1074 |
| 7 | 7363907 | 7366996 | 3089 | loss | 2387 | COL28A1 | 7.08 | Genic; OR > 6 | 1075 |
| 7 | 7363907 | 7368896 | 4989 | loss | 2048 | COL28A1 | 7.08 | Genic; OR > 6 | 1076 |
| 7 | 7363907 | 7368896 | 4989 | loss | 2052 | COL28A1 | 7.08 | Genic; OR > 6 | 1076 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 7 | 7363907 | 7368896 | 4989 | loss | 2263 | COL28A1 | 7.08 | Genic; OR > 6 | 1076 |
| 7 | 7363907 | 7368896 | 4989 | loss | 2264 | COL28A1 | 7.08 | Genic; OR > 6 | 1076 |
| 7 | 7363907 | 7368896 | 4989 | loss | 2284 | COL28A1 | 7.08 | Genic; OR > 6 | 1076 |
| 7 | 7363907 | 7368896 | 4989 | loss | 2315 | COL28A1 | 7.08 | Genic; OR > 6 | 1076 |
| 7 | 7363907 | 7368896 | 4989 | loss | 2337 | COL28A1 | 7.08 | Genic; OR > 6 | 1076 |
| 7 | 7363907 | 7368896 | 4989 | loss | 2348 | COL28A1 | 7.08 | Genic; OR > 6 | 1076 |
| 7 | 7363907 | 7368896 | 4989 | loss | 2388 | COL28A1 | 7.08 | Genic; OR > 6 | 1076 |
| 7 | 7363907 | 7368896 | 4989 | loss | 2429 | COL28A1 | 7.08 | Genic; OR > 6 | 1076 |
| 7 | 7363907 | 7368896 | 4989 | loss | 2563 | COL28A1 | 7.08 | Genic; OR > 6 | 1076 |
| 7 | 7363907 | 7368896 | 4989 | loss | 2571 | COL28A1 | 7.08 | Genic; OR > 6 | 1076 |
| 7 | 7363907 | 7368896 | 4989 | loss | 2585 | COL28A1 | 7.08 | Genic; OR > 6 | 1076 |
| 7 | 7363907 | 7368896 | 4989 | loss | 2611 | COL28A1 | 7.08 | Genic; OR > 6 | 1076 |
| 7 | 6837409 | 8031205 | 1193796 | gain | 2514 | COL28A1 | 7.08 | Genic; OR > 6 | 1077 |
| 7 | 6837409 | 8031205 | 1193796 | gain | 2514 | LOC729852 | 6.48 | Genic (distinct CNV-subregions); OR > 6 | 1077 |
| 7 | 6837409 | 8031205 | 1193796 | gain | 2514 | LOC729852 | 6.48 | Genic (distinct CNV-subregions); OR > 6 | 1077 |
| 7 | 6837409 | 8031205 | 1193796 | gain | 2514 | LOC729852 | 6.48 | Genic (distinct CNV-subregions); OR > 6 | 1077 |
| 7 | 6837409 | 8031205 | 1193796 | gain | 2514 | LOC729852,RPA3 | 6.48 | Genic (distinct CNV- | 1077 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | subregions); OR > 6 | |
| 7 | 6837409 | 8031205 | 1193796 | gain | 2514 | LOC729852,RPA3 | 6.48 | Genic (distinct CNV-subregions); OR > 6 | 1077 |
| 7 | 6837409 | 8031205 | 1193796 | gain | 2514 | MIOS,LOC729852,COL28A1,RPA3 | 6.48 | Genic (distinct CNV-subregions); OR > 6 | 1077 |
| 2 | 205501455 | 205502769 | 1314 | loss | 2280 | PARD3B | 15.25 | Genic; OR > 6 | 1078 |
| 2 | 205501455 | 205502769 | 1314 | loss | 2341 | PARD3B | 15.25 | Genic; OR > 6 | 1078 |
| 2 | 205501455 | 205502769 | 1314 | loss | 2365 | PARD3B | 15.25 | Genic; OR > 6 | 1078 |
| 2 | 205501455 | 205502769 | 1314 | loss | 2377 | PARD3B | 15.25 | Genic; OR > 6 | 1078 |
| 2 | 205501455 | 205502769 | 1314 | loss | 2393 | PARD3B | 15.25 | Genic; OR > 6 | 1078 |
| 2 | 205501455 | 205502769 | 1314 | loss | 2429 | PARD3B | 15.25 | Genic; OR > 6 | 1078 |
| 2 | 205501455 | 205502769 | 1314 | loss | 2566 | PARD3B | 15.25 | Genic; OR > 6 | 1078 |
| 11 | 1625056 | 1630240 | 5184 | loss | 2281 | MOB2 | 8.66 | Genic; OR > 6 | 1079 |
| 11 | 1625056 | 1630240 | 5184 | loss | 2589 | MOB2 | 8.66 | Genic; OR > 6 | 1079 |
| 11 | 1625056 | 1630240 | 5184 | loss | 2625 | MOB2 | 8.66 | Genic; OR > 6 | 1079 |
| 11 | 1625056 | 1630240 | 5184 | loss | 2629 | MOB2 | 8.66 | Genic; OR > 6 | 1079 |
| 12 | 760146 | 765502 | 5356 | gain | 2254 | WNK1 | 8.66 | Genic; OR > 6 | 1080 |
| 12 | 760146 | 765502 | 5356 | gain | 2369 | WNK1 | 8.66 | Genic; OR > 6 | 1080 |
| 12 | 760146 | 765502 | 5356 | gain | 2447 | WNK1 | 8.66 | Genic; OR > 6 | 1080 |
| 12 | 760146 | 765502 | 5356 | gain | 2614 | WNK1 | 8.66 | Genic; OR > 6 | 1080 |
| 15 | 48674235 | 48675832 | 1597 | loss | 2046 | TRPM7 | 6.48 | Genic; OR > 6 | 1081 |
| 15 | 48674235 | 48675832 | 1597 | loss | 2473 | TRPM7 | 6.48 | Genic; OR > 6 | 1081 |
| 15 | 48674235 | 48675832 | 1597 | loss | 2626 | TRPM7 | 6.48 | Genic; OR > 6 | 1081 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 1 | 59558536 | 59603781 | 45245 | loss | 2615 | FGGY | 6.48 | Genic (distinct CNV-subregions); OR > 6 | 1082 |
| 1 | 59770306 | 59825004 | 54698 | loss | 2643 | FGGY | 6.48 | Genic (distinct CNV-subregions); OR > 6 | 1083 |
| 1 | 59770306 | 59825004 | 54698 | loss | 2643 | FGGY | 6.48 | Genic (distinct CNV-subregions); OR > 6 | 1083 |
| 1 | 59770306 | 59825004 | 54698 | loss | 2643 | FGGY | 6.48 | Genic (distinct CNV-subregions); OR > 6 | 1083 |
| 1 | 59625013 | 59825004 | 199991 | loss | 2636 | FGGY | 6.48 | Genic (distinct CNV-subregions); OR > 6 | 1084 |
| 1 | 59625013 | 59825004 | 199991 | loss | 2636 | FGGY | 6.48 | Genic (distinct CNV-subregions); OR > 6 | 1084 |
| 1 | 59625013 | 59825004 | 199991 | loss | 2636 | FGGY | 6.48 | Genic (distinct CNV-subregions); OR > 6 | 1084 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 1 | 59625013 | 59825004 | 199991 | loss | 2636 | FGGY | 6.48 | Genic (distinct CNV-subregions); OR > 6 | 1084 |
| 16 | 24114284 | 24119097 | 4813 | loss | 2574 | PRKCB | 6.48 | Genic; OR > 6 | 1085 |
| 16 | 24114284 | 24121574 | 7290 | gain | 2354 | PRKCB | 6.48 | Genic; OR > 6 | 1086 |
| 16 | 24114284 | 24121574 | 7290 | gain | 2462 | PRKCB | 6.48 | Genic; OR > 6 | 1086 |
| 6 | 167120986 | 167121009 | 23 | loss | 2047 | RPS6KA2 | 6.55 | Genic; OR > 6 | 1087 |
| 6 | 167120986 | 167121009 | 23 | loss | 2050 | RPS6KA2 | 6.55 | Genic; OR > 6 | 1087 |
| 6 | 167120986 | 167121009 | 23 | gain | 2339 | RPS6KA2 | 6.55 | Genic; OR > 6 | 1087 |
| 6 | 167120986 | 167121009 | 23 | loss | 2474 | RPS6KA2 | 6.55 | Genic; OR > 6 | 1087 |
| 6 | 167120986 | 167121009 | 23 | loss | 2510 | RPS6KA2 | 6.55 | Genic; OR > 6 | 1087 |
| 6 | 167120986 | 167128528 | 7542 | gain | 2261 | RPS6KA2 | 6.55 | Genic; OR > 6 | 1088 |
| 6 | 167120986 | 167128528 | 7542 | gain | 2359 | RPS6KA2 | 6.55 | Genic; OR > 6 | 1088 |
| 6 | 167120986 | 167128528 | 7542 | gain | 2384 | RPS6KA2 | 6.55 | Genic; OR > 6 | 1088 |
| 6 | 167120986 | 167128528 | 7542 | gain | 2625 | RPS6KA2 | 6.55 | Genic; OR > 6 | 1088 |
| 6 | 2678569 | 2680370 | 1801 | loss | 2448 | MYLK4 | 6.48 | Genic; OR > 6 | 1089 |
| 6 | 2678569 | 2680370 | 1801 | loss | 2475 | MYLK4 | 6.48 | Genic; OR > 6 | 1089 |
| 6 | 2678569 | 2680370 | 1801 | loss | 2637 | MYLK4 | 6.48 | Genic; OR > 6 | 1089 |
| 11 | 21380486 | 21381731 | 1245 | loss | 2302 | NELL1 | 6.48 | Genic; OR > 6 | 1090 |
| 11 | 21380486 | 21381731 | 1245 | loss | 2424 | NELL1 | 6.48 | Genic; OR > 6 | 1090 |
| 11 | 21380486 | 21381731 | 1245 | loss | 2561 | NELL1 | 6.48 | Genic; OR > 6 | 1090 |
| 5 | 137482548 | 137488409 | 5861 | gain | 2228 | NME5 | 6.48 | Genic; OR > 6 | 1091 |
| 5 | 137482548 | 137488409 | 5861 | gain | 2519 | NME5 | 6.48 | Genic; OR > 6 | 1091 |
| 5 | 137482548 | 137489561 | 7013 | gain | 2604 | NME5 | 6.48 | Genic; OR > 6 | 1092 |
| 1 | 9775177 | 9776903 | 1726 | loss | 2244 | CLSTN1 | 13.04 | Genic; OR > 6 | 1093 |
| 1 | 9769722 | 9775177 | 5455 | loss | 2616 | CLSTN1 | 13.04 | Genic; OR > 6 | 1094 |
| 1 | 9769722 | 9776903 | 7181 | loss | 2178 | CLSTN1 | 13.04 | Genic; OR > 6 | 1095 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 1 | 9769722 | 9776903 | 7181 | loss | 2448 | CLSTN1 | 13.04 | Genic; OR > 6 | 1095 |
| 1 | 9769722 | 9776903 | 7181 | loss | 2534 | CLSTN1 | 13.04 | Genic; OR > 6 | 1095 |
| 1 | 9769722 | 9776903 | 7181 | loss | 2549 | CLSTN1 | 13.04 | Genic; OR > 6 | 1095 |
| 1 | 9769722 | 9776903 | 7181 | loss | 2610 | CLSTN1 | 13.04 | Genic; OR > 6 | 1095 |
| 1 | 9769722 | 9776903 | 7181 | loss | 2178 | CLSTN1 | 13.04 | Genic; OR > 6 | 1095 |
| 1 | 9769722 | 9776903 | 7181 | loss | 2448 | CLSTN1 | 13.04 | Genic; OR > 6 | 1095 |
| 1 | 9769722 | 9776903 | 7181 | loss | 2534 | CLSTN1 | 13.04 | Genic; OR > 6 | 1095 |
| 1 | 9769722 | 9776903 | 7181 | loss | 2549 | CLSTN1 | 13.04 | Genic; OR > 6 | 1095 |
| 1 | 9769722 | 9776903 | 7181 | loss | 2610 | CLSTN1 | 13.04 | Genic; OR > 6 | 1095 |
| 6 | 2077106 | 2093566 | 16460 | loss | 2520 | GMDS | 6.48 | Genic; OR > 6 | 1096 |
| 6 | 2077106 | 2093566 | 16460 | loss | 2636 | GMDS | 6.48 | Genic; OR > 6 | 1096 |
| 6 | 2073228 | 2095416 | 22188 | loss | 2519 | GMDS | 6.48 | Genic; OR > 6 | 1097 |
| 7 | 3409718 | 3435568 | 25850 | gain | 2455 | SDK1 | 6.48 | Genic; OR > 6 | 1098 |
| 7 | 3320972 | 3378114 | 57142 | loss | 2573 | SDK1 | 6.48 | Genic; OR > 6 | 1099 |
| 7 | 3320972 | 3378114 | 57142 | loss | 2573 | SDK1 | 6.48 | Genic; OR > 6 | 1099 |
| 7 | 3320972 | 3378114 | 57142 | loss | 2573 | SDK1 | 6.48 | Genic; OR > 6 | 1099 |
| 7 | 3324678 | 3425767 | 101089 | loss | 2535 | SDK1 | 6.48 | Genic; OR > 6 | 1100 |
| 7 | 3324678 | 3425767 | 101089 | loss | 2535 | SDK1 | 6.48 | Genic; OR > 6 | 1100 |
| 7 | 3324678 | 3425767 | 1010 | loss | 2535 | SDK1 | 6.48 | Genic; OR > 6 | 1100 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | 89 | | | | | |
| 7 | 3324678 | 3425767 | 101089 | loss | 2535 | SDK1 | 6.48 | Genic; OR > 6 | 1100 |
| 7 | 3071715 | 3464541 | 392826 | gain | 2597 | SDK1 | 6.48 | Genic; OR > 6 | 1101 |
| 7 | 3071715 | 3464541 | 392826 | gain | 2597 | SDK1 | 6.48 | Genic; OR > 6 | 1101 |
| 7 | 3071715 | 3464541 | 392826 | gain | 2597 | SDK1 | 6.48 | Genic; OR > 6 | 1101 |
| 7 | 3071715 | 3464541 | 392826 | gain | 2597 | SDK1 | 6.48 | Genic; OR > 6 | 1101 |
| 8 | 100286992 | 100295053 | 8061 | gain | 2200 | VPS13B | 6.48 | Genic; OR > 6 | 1102 |
| 8 | 100286992 | 100295053 | 8061 | gain | 2316 | VPS13B | 6.48 | Genic; OR > 6 | 1102 |
| 8 | 100286992 | 100295053 | 8061 | gain | 2540 | VPS13B | 6.48 | Genic; OR > 6 | 1102 |
| 6 | 81097222 | 81102939 | 5717 | gain | 2175 | BCKDHB | 10.84 | Genic; OR > 6 | 1103 |
| 6 | 81097222 | 81102939 | 5717 | loss | 2342 | BCKDHB | 10.84 | Genic; OR > 6 | 1103 |
| 6 | 81097222 | 81102939 | 5717 | loss | 2403 | BCKDHB | 10.84 | Genic; OR > 6 | 1103 |
| 6 | 81097222 | 81102939 | 5717 | loss | 2438 | BCKDHB | 10.84 | Genic; OR > 6 | 1103 |
| 6 | 81097222 | 81102939 | 5717 | loss | 2507 | BCKDHB | 10.84 | Genic; OR > 6 | 1103 |
| 14 | 99328538 | 99330427 | 1889 | gain | 2363 | EML1 | 10.84 | Genic; OR > 6 | 1104 |
| 14 | 99328538 | 99330427 | 1889 | gain | 2364 | EML1 | 10.84 | Genic; OR > 6 | 1104 |
| 14 | 99328538 | 99330427 | 1889 | loss | 2541 | EML1 | 10.84 | Genic; OR > 6 | 1104 |
| 14 | 99328538 | 99330427 | 1889 | gain | 2550 | EML1 | 10.84 | Genic; OR > 6 | 1104 |
| 14 | 99326047 | 99330427 | 4380 | gain | 2318 | EML1 | 10.84 | Genic; OR > 6 | 1105 |
| 2 | 54958291 | 54961012 | 2721 | loss | 2192 | EML6 | 8.66 | Genic (distinct CNV-subregions); OR > 6 | 1106 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 2 | 54958291 | 54961012 | 2721 | gain | 2565 | EML6 | 8.66 | Genic (distinct CNV-subregions); OR > 6 | 1106 |
| 2 | 55017498 | 55028174 | 10676 | gain | 2350 | EML6 | 8.66 | Genic (distinct CNV-subregions); OR > 6 | 1107 |
| 2 | 54869538 | 54913661 | 44123 | loss | 2370 | EML6 | 8.66 | Genic (distinct CNV-subregions); OR > 6 | 1108 |
| 15 | 40028045 | 40029547 | 1502 | loss | 2402 | EHD4 | 8.66 | Genic; OR > 6 | 1109 |
| 15 | 40028045 | 40029547 | 1502 | loss | 2403 | EHD4 | 8.66 | Genic; OR > 6 | 1109 |
| 15 | 40028045 | 40029547 | 1502 | loss | 2573 | EHD4 | 8.66 | Genic; OR > 6 | 1109 |
| 15 | 39944612 | 40101323 | 156711 | gain | 2235 | EHD4 | 8.66 | Genic; OR > 6 | 1110 |
| 6 | 102076000 | 102077559 | 1559 | loss | 2048 | GRIK2 | 6.48 | Genic; OR > 6 | 1111 |
| 6 | 102076000 | 102077559 | 1559 | loss | 2051 | GRIK2 | 6.48 | Genic; OR > 6 | 1111 |
| 6 | 102076000 | 102077559 | 1559 | loss | 2333 | GRIK2 | 6.48 | Genic; OR > 6 | 1111 |
| 20 | 47586063 | 47612159 | 26096 | loss | 2484 | PTGIS | 6.48 | Genic; OR > 6 | 1112 |
| 20 | 47581422 | 47666154 | 84732 | loss | 2630 | PTGIS | 6.48 | Genic; OR > 6 | 1113 |
| 20 | 30319299 | 48847084 | 18527785 | loss | 2434 | PTGIS | 6.48 | Genic; OR > 6 | 1114 |
| 1 | 235489497 | 235490959 | 1462 | loss | 2184 | RYR2 | 6.48 | Genic (distinct CNV- | 1115 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | subregions); OR > 6 | |
| 1 | 235341008 | 235345656 | 4648 | loss | 2365 | RYR2 | 6.48 | Genic (distinct CNV-subregions); OR > 6 | 1116 |
| 1 | 235341008 | 235345656 | 4648 | loss | 2632 | RYR2 | 6.48 | Genic (distinct CNV-subregions); OR > 6 | 1116 |
| 2 | 50639070 | 50642429 | 3359 | loss | 2204 | NRXN1 | 17.46 | Genic; OR > 6 | 1117 |
| 2 | 50639070 | 50642429 | 3359 | loss | 2225 | NRXN1 | 17.46 | Genic; OR > 6 | 1117 |
| 2 | 50639070 | 50642429 | 3359 | loss | 2228 | NRXN1 | 17.46 | Genic; OR > 6 | 1117 |
| 2 | 50639070 | 50642429 | 3359 | loss | 2482 | NRXN1 | 17.46 | Genic; OR > 6 | 1117 |
| 2 | 50636634 | 50642429 | 5795 | loss | 2208 | NRXN1 | 17.46 | Genic; OR > 6 | 1118 |
| 2 | 50636634 | 50642429 | 5795 | loss | 2365 | NRXN1 | 17.46 | Genic; OR > 6 | 1118 |
| 2 | 50636634 | 50642429 | 5795 | loss | 2453 | NRXN1 | 17.46 | Genic; OR > 6 | 1118 |
| 2 | 50636634 | 50642429 | 5795 | loss | 2208 | NRXN1 | 8.66 | Genic; OR > 6 | 1118 |
| 2 | 50636634 | 50642429 | 5795 | loss | 2365 | NRXN1 | 8.66 | Genic; OR > 6 | 1118 |
| 2 | 50636634 | 50642429 | 5795 | loss | 2453 | NRXN1 | 8.66 | Genic; OR > 6 | 1118 |
| 2 | 50636634 | 50644041 | 7407 | loss | 2620 | NRXN1 | 17.46 | Genic; OR > 6 | 1119 |
| 2 | 50636634 | 50644041 | 7407 | loss | 2620 | NRXN1 | 8.66 | Genic; OR > 6 | 1119 |
| 6 | 162574081 | 162639680 | 65599 | loss | 2514 | PARK2 | 8.66 | Genic; OR > 6 | 1120 |
| 6 | 162574081 | 162639680 | 65599 | loss | 2514 | PARK2 | 8.66 | Genic; OR > 6 | 1120 |
| 6 | 162434935 | 162593309 | 158374 | loss | 2610 | PARK2 | 8.66 | Genic; OR > 6 | 1121 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 6 | 162434935 | 162593309 | 158374 | loss | 2610 | PARK2 | 8.66 | Genic; OR > 6 | 1121 |
| 6 | 162434935 | 162593309 | 158374 | loss | 2610 | PARK2 | 6.48 | Genic; OR > 6 | 1121 |
| 6 | 162434935 | 162593309 | 158374 | loss | 2610 | PARK2 | 6.48 | Genic; OR > 6 | 1121 |
| 6 | 162434935 | 162593309 | 158374 | loss | 2610 | PARK2 | 6.48 | Genic; OR > 6 | 1121 |
| 6 | 162434935 | 162593309 | 158374 | loss | 2610 | PARK2 | 6.48 | Genic; OR > 6 | 1121 |
| 6 | 162434935 | 162593309 | 158374 | loss | 2610 | PARK2 | 6.48 | Genic; OR > 6 | 1121 |
| 6 | 162448858 | 162617618 | 168760 | loss | 2355 | PARK2 | 8.66 | Genic; OR > 6 | 1122 |
| 6 | 162448858 | 162617618 | 168760 | loss | 2355 | PARK2 | 8.66 | Genic; OR > 6 | 1122 |
| 6 | 162448858 | 162617618 | 168760 | loss | 2355 | PARK2 | 6.48 | Genic; OR > 6 | 1122 |
| 6 | 162448858 | 162617618 | 168760 | loss | 2355 | PARK2 | 6.48 | Genic; OR > 6 | 1122 |
| 6 | 162448858 | 162617618 | 168760 | loss | 2355 | PARK2 | 6.48 | Genic; OR > 6 | 1122 |
| 6 | 162448858 | 162617618 | 168760 | loss | 2355 | PARK2 | 6.48 | Genic; OR > 6 | 1122 |
| 6 | 162448858 | 162617618 | 168760 | loss | 2355 | PARK2 | 6.48 | Genic; OR > 6 | 1122 |
| 6 | 162473616 | 162716462 | 242846 | loss | 2237 | PARK2 | 8.66 | Genic; OR > 6 | 1123 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 6 | 162473616 | 162716462 | 242846 | loss | 2237 | PARK2 | 8.66 | Genic; OR > 6 | 1123 |
| 6 | 162473616 | 162716462 | 242846 | loss | 2237 | PARK2 | 6.48 | Genic; OR > 6 | 1123 |
| 6 | 162473616 | 162716462 | 242846 | loss | 2237 | PARK2 | 6.48 | Genic; OR > 6 | 1123 |
| 6 | 162473616 | 162716462 | 242846 | loss | 2237 | PARK2 | 6.48 | Genic; OR > 6 | 1123 |
| 6 | 162473616 | 162716462 | 242846 | loss | 2237 | PARK2 | 6.48 | Genic; OR > 6 | 1123 |
| 6 | 162473616 | 162716462 | 242846 | loss | 2237 | PARK2 | 6.48 | Genic; OR > 6 | 1123 |
| 23 | 149901706 | 149904265 | 2559 | gain | 2047 | HMGB3 | 10.84 | Genic; OR > 6 | 1124 |
| 23 | 149901706 | 149904265 | 2559 | gain | 2411 | HMGB3 | 10.84 | Genic; OR > 6 | 1124 |
| 23 | 149901706 | 149904265 | 2559 | gain | 2458 | HMGB3 | 10.84 | Genic; OR > 6 | 1124 |
| 23 | 149901706 | 149904265 | 2559 | gain | 2551 | HMGB3 | 10.84 | Genic; OR > 6 | 1124 |
| 23 | 149901706 | 149904265 | 2559 | gain | 2597 | HMGB3 | 10.84 | Genic; OR > 6 | 1124 |
| 23 | 149901706 | 149904265 | 2559 | gain | 2047 | HMGB3 | 6.51 | Genic; OR > 6 | 1124 |
| 23 | 149901706 | 149904265 | 2559 | gain | 2411 | HMGB3 | 6.51 | Genic; OR > 6 | 1124 |
| 23 | 149901706 | 149904265 | 2559 | gain | 2458 | HMGB3 | 6.51 | Genic; OR > 6 | 1124 |
| 23 | 149901706 | 149904265 | 2559 | gain | 2551 | HMGB3 | 6.51 | Genic; OR > 6 | 1124 |
| 23 | 149901706 | 149904265 | 2559 | gain | 2597 | HMGB3 | 6.51 | Genic; OR > 6 | 1124 |
| 23 | 149902702 | 149905363 | 2661 | gain | 2048 | HMGB3 | 6.51 | Genic; OR > 6 | 1125 |
| 1 | 109520130 | 109523136 | 3006 | gain | 2359 | KIAA1324 | 15.25 | Genic; OR > 6 | 1126 |
| 1 | 109520130 | 109523136 | 3006 | gain | 2368 | KIAA1324 | 15.25 | Genic; OR > 6 | 1126 |
| 1 | 109520130 | 109523136 | 3006 | gain | 2386 | KIAA1324 | 15.25 | Genic; OR > 6 | 1126 |
| 1 | 109520130 | 109523136 | 3006 | gain | 2444 | KIAA1324 | 15.25 | Genic; OR > 6 | 1126 |
| 1 | 109520130 | 109523136 | 3006 | gain | 2604 | KIAA1324 | 15.25 | Genic; OR > 6 | 1126 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 1 | 109520130 | 109523136 | 3006 | gain | 2605 | KIAA1324 | 15.25 | Genic; OR > 6 | 1126 |
| 1 | 109520130 | 109523136 | 3006 | gain | 2628 | KIAA1324 | 15.25 | Genic; OR > 6 | 1126 |
| 7 | 147441927 | 147443119 | 1192 | loss | 2266 | MIR548T, CNTNAP2 | 15.25 | Genic; OR > 6 | 1127 |
| 7 | 147441927 | 147443119 | 1192 | loss | 2269 | MIR548T, CNTNAP2 | 15.25 | Genic; OR > 6 | 1127 |
| 7 | 147441927 | 147443119 | 1192 | loss | 2320 | MIR548T, CNTNAP2 | 15.25 | Genic; OR > 6 | 1127 |
| 7 | 147441927 | 147443119 | 1192 | loss | 2436 | MIR548T, CNTNAP2 | 15.25 | Genic; OR > 6 | 1127 |
| 7 | 147441927 | 147443119 | 1192 | loss | 2443 | MIR548T, CNTNAP2 | 15.25 | Genic; OR > 6 | 1127 |
| 7 | 147441927 | 147443119 | 1192 | loss | 2565 | MIR548T, CNTNAP2 | 15.25 | Genic; OR > 6 | 1127 |
| 7 | 147441927 | 147443119 | 1192 | loss | 2593 | MIR548T, CNTNAP2 | 15.25 | Genic; OR > 6 | 1127 |
| 8 | 26696889 | 26698739 | 1850 | loss | 2323 | ADRA1A | 8.72 | Genic; OR > 6 | 1128 |
| 8 | 26696889 | 26698739 | 1850 | loss | 2428 | ADRA1A | 8.72 | Genic; OR > 6 | 1128 |
| 8 | 26696889 | 26698739 | 1850 | loss | 2469 | ADRA1A | 8.72 | Genic; OR > 6 | 1128 |
| 8 | 26696889 | 26698739 | 1850 | loss | 2478 | ADRA1A | 8.72 | Genic; OR > 6 | 1128 |
| 8 | 26696889 | 26698739 | 1850 | loss | 2479 | ADRA1A | 8.72 | Genic; OR > 6 | 1128 |
| 8 | 26696889 | 26698739 | 1850 | loss | 2634 | ADRA1A | 8.72 | Genic; OR > 6 | 1128 |
| 8 | 26696889 | 26698739 | 1850 | loss | 2637 | ADRA1A | 8.72 | Genic; OR > 6 | 1128 |
| 8 | 26696889 | 26698739 | 1850 | loss | 2645 | ADRA1A | 8.72 | Genic; OR > 6 | 1128 |
| 5 | 125923359 | 125924811 | 1452 | gain | 2280 | ALDH7A1 | 13.04 | Genic; OR > 6 | 1129 |
| 5 | 125923359 | 125924811 | 1452 | gain | 2360 | ALDH7A1 | 13.04 | Genic; OR > 6 | 1129 |
| 5 | 125923359 | 125924811 | 1452 | gain | 2361 | ALDH7A1 | 13.04 | Genic; OR > 6 | 1129 |
| 5 | 125923359 | 125924811 | 1452 | gain | 2366 | ALDH7A1 | 13.04 | Genic; OR > 6 | 1129 |

| Chr | Original CNV Start | Original CNV Stop | Original CNV Size | CNV Type | PD Case ID(s) | RefSeq Gene Symbol(s) | OR | Category | SEQ_ID |
|---|---|---|---|---|---|---|---|---|---|
| 5 | 125923359 | 125924811 | 1452 | gain | 2395 | ALDH7A1 | 13.04 | Genic; OR > 6 | 1129 |
| 5 | 125923359 | 125924811 | 1452 | gain | 2418 | ALDH7A1 | 13.04 | Genic; OR > 6 | 1129 |
| 8 | 51389250 | 51390466 | 1216 | loss | 2187 | SNTG1 | 13.04 | Genic; OR > 6 | 1130 |
| 8 | 51389250 | 51390466 | 1216 | loss | 2288 | SNTG1 | 13.04 | Genic; OR > 6 | 1130 |
| 8 | 51389250 | 51390466 | 1216 | loss | 2412 | SNTG1 | 13.04 | Genic; OR > 6 | 1130 |
| 8 | 51389250 | 51390466 | 1216 | loss | 2452 | SNTG1 | 13.04 | Genic; OR > 6 | 1130 |
| 8 | 51389250 | 51390466 | 1216 | loss | 2549 | SNTG1 | 13.04 | Genic; OR > 6 | 1130 |
| 8 | 51389250 | 51390466 | 1216 | loss | 2590 | SNTG1 | 13.04 | Genic; OR > 6 | 1130 |
| 8 | 3986556 | 3987981 | 1425 | loss | 2227 | CSMD1 | 6.17 | Genic; OR > 6 | 1131 |
| 8 | 3986556 | 3987981 | 1425 | loss | 2237 | CSMD1 | 6.17 | Genic; OR > 6 | 1131 |
| 8 | 3986556 | 3987981 | 1425 | loss | 2342 | CSMD1 | 6.17 | Genic; OR > 6 | 1131 |
| 8 | 3986556 | 3987981 | 1425 | loss | 2427 | CSMD1 | 6.17 | Genic; OR > 6 | 1131 |
| 8 | 3986556 | 3987981 | 1425 | gain | 2471 | CSMD1 | 6.17 | Genic; OR > 6 | 1131 |
| 8 | 3986556 | 3987981 | 1425 | loss | 2562 | CSMD1 | 6.17 | Genic; OR > 6 | 1131 |
| 8 | 3983448 | 3987981 | 4533 | loss | 2212 | CSMD1 | 7.61 | Genic; OR > 6 | 1132 |
| 8 | 3983448 | 3987981 | 4533 | loss | 2292 | CSMD1 | 7.61 | Genic; OR > 6 | 1132 |
| 8 | 3983448 | 3987981 | 4533 | loss | 2380 | CSMD1 | 7.61 | Genic; OR > 6 | 1132 |
| 8 | 3983448 | 3987981 | 4533 | loss | 2411 | CSMD1 | 7.61 | Genic; OR > 6 | 1132 |
| 8 | 3983448 | 3987981 | 4533 | loss | 2436 | CSMD1 | 7.61 | Genic; OR > 6 | 1132 |
| 8 | 3983448 | 3987981 | 4533 | loss | 2465 | CSMD1 | 7.61 | Genic; OR > 6 | 1132 |
| 8 | 3983448 | 3987981 | 4533 | loss | 2212 | CSMD1 | 6.17 | Genic; OR > 6 | 1132 |
| 8 | 3983448 | 3987981 | 4533 | loss | 2292 | CSMD1 | 6.17 | Genic; OR > 6 | 1132 |
| 8 | 3983448 | 3987981 | 4533 | loss | 2380 | CSMD1 | 6.17 | Genic; OR > 6 | 1132 |
| 8 | 3983448 | 3987981 | 4533 | loss | 2411 | CSMD1 | 6.17 | Genic; OR > 6 | 1132 |
| 8 | 3983448 | 3987981 | 4533 | loss | 2436 | CSMD1 | 6.17 | Genic; OR > 6 | 1132 |
| 8 | 3983448 | 3987981 | 4533 | loss | 2465 | CSMD1 | 6.17 | Genic; OR > 6 | 1132 |
| 8 | 3984761 | 3991110 | 6349 | loss | 2423 | CSMD1 | 6.17 | Genic; OR > 6 | 1133 |
| 8 | 3966609 | 4005423 | 3881 | loss | 2498 | CSMD1 | 7.61 | Genic; OR > 6 | 1134 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 8 | 3966609 | 4005423 | 38814 | loss | 2498 | CSMD1 | 6.17 | Genic; OR > 6 | 1134 |
| 21 | 41140283 | 41141370 | 1087 | gain | 2055 | DSCAM | 7.61 | Genic; OR > 6 | 1135 |
| 21 | 41140283 | 41141370 | 1087 | gain | 2270 | DSCAM | 7.61 | Genic; OR > 6 | 1135 |
| 21 | 41140283 | 41141370 | 1087 | gain | 2363 | DSCAM | 7.61 | Genic; OR > 6 | 1135 |
| 21 | 41140283 | 41141370 | 1087 | gain | 2504 | DSCAM | 7.61 | Genic; OR > 6 | 1135 |
| 21 | 41140283 | 41141370 | 1087 | gain | 2597 | DSCAM | 7.61 | Genic; OR > 6 | 1135 |
| 21 | 41140283 | 41141370 | 1087 | gain | 2643 | DSCAM | 7.61 | Genic; OR > 6 | 1135 |
| 21 | 41139077 | 41141370 | 2293 | gain | 2226 | DSCAM | 7.61 | Genic; OR > 6 | 1136 |
| 4 | 73143133 | 73145178 | 2045 | gain | 2451 | NPFFR2 | 8.66 | Genic; OR > 6 | 1137 |
| 4 | 73143133 | 73145178 | 2045 | gain | 2475 | NPFFR2 | 8.66 | Genic; OR > 6 | 1137 |
| 4 | 73143133 | 73145178 | 2045 | gain | 2534 | NPFFR2 | 8.66 | Genic; OR > 6 | 1137 |
| 4 | 73143133 | 73145178 | 2045 | gain | 2536 | NPFFR2 | 8.66 | Genic; OR > 6 | 1137 |
| 14 | 52323151 | 52324282 | 1131 | loss | 2451 | GNPNAT1 | 8.66 | Genic; OR > 6 | 1138 |
| 14 | 52323151 | 52324282 | 1131 | loss | 2455 | GNPNAT1 | 8.66 | Genic; OR > 6 | 1138 |
| 14 | 52323151 | 52324282 | 1131 | loss | 2534 | GNPNAT1 | 8.66 | Genic; OR > 6 | 1138 |
| 14 | 52323151 | 52324282 | 1131 | loss | 2549 | GNPNAT1 | 8.66 | Genic; OR > 6 | 1138 |
| 16 | 48774875 | 48785482 | 10607 | gain | 2487 | PAPD5 | 8.66 | Genic; OR > 6 | 1139 |
| 16 | 48774875 | 48785482 | 10607 | gain | 2515 | PAPD5 | 8.66 | Genic; OR > 6 | 1139 |
| 16 | 48774875 | 48785482 | 10607 | gain | 2487 | PAPD5 | 8.66 | Genic; OR > 6 | 1139 |
| 16 | 48774875 | 48785482 | 10607 | gain | 2515 | PAPD5 | 8.66 | Genic; OR > 6 | 1139 |
| 16 | 48774875 | 48787454 | 12579 | gain | 2625 | PAPD5 | 8.66 | Genic; OR > 6 | 1140 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 16 | 48774875 | 48787454 | 12579 | gain | 2625 | PAPD5 | 8.66 | Genic; OR > 6 | 1140 |
| 16 | 48681817 | 48792607 | 110790 | gain | 2603 | PAPD5 | 8.66 | Genic; OR > 6 | 1141 |
| 16 | 48681817 | 48792607 | 110790 | gain | 2603 | PAPD5 | 8.66 | Genic; OR > 6 | 1141 |
| 8 | 107368178 | 107369802 | 1624 | loss | 2053 | OXR1 | 6.51 | Genic; OR > 6 | 1142 |
| 8 | 107368178 | 107369802 | 1624 | loss | 2325 | OXR1 | 6.51 | Genic; OR > 6 | 1142 |
| 8 | 107368178 | 107369802 | 1624 | loss | 2449 | OXR1 | 6.51 | Genic; OR > 6 | 1142 |
| 8 | 107368178 | 107369802 | 1624 | loss | 2472 | OXR1 | 6.51 | Genic; OR > 6 | 1142 |
| 8 | 107368178 | 107369802 | 1624 | loss | 2475 | OXR1 | 6.51 | Genic; OR > 6 | 1142 |
| 8 | 107368178 | 107369802 | 1624 | loss | 2507 | OXR1 | 6.51 | Genic; OR > 6 | 1142 |
| 9 | 123075181 | 123078271 | 3090 | loss | 2050 | GSN | 8.66 | Genic; OR > 6 | 1143 |
| 9 | 123075181 | 123078271 | 3090 | loss | 2414 | GSN | 8.66 | Genic; OR > 6 | 1143 |
| 9 | 123075181 | 123078271 | 3090 | loss | 2525 | GSN | 8.66 | Genic; OR > 6 | 1143 |
| 9 | 123075181 | 123078271 | 3090 | loss | 2530 | GSN | 8.66 | Genic; OR > 6 | 1143 |
| 8 | 108453218 | 108454560 | 1342 | loss | 2048 | ANGPT1 | 6.48 | Genic; OR > 6 | 1144 |
| 8 | 108453218 | 108454560 | 1342 | loss | 2359 | ANGPT1 | 6.48 | Genic; OR > 6 | 1144 |
| 8 | 108448006 | 108454560 | 6554 | loss | 2601 | ANGPT1 | 6.48 | Genic; OR > 6 | 1145 |
| 3 | 47960943 | 47976958 | 16015 | gain | 2563 | MAP4 | 6.48 | Genic; OR > 6 | 1146 |
| 3 | 47960943 | 47976958 | 16015 | gain | 2603 | MAP4 | 6.48 | Genic; OR > 6 | 1146 |
| 3 | 47960943 | 47976958 | 16015 | gain | 2563 | MAP4 | 6.48 | Genic; OR > 6 | 1146 |
| 3 | 47960943 | 47976958 | 16015 | gain | 2603 | MAP4 | 6.48 | Genic; OR > 6 | 1146 |
| 3 | 47953977 | 47976958 | 2298 | gain | 2617 | MAP4 | 6.48 | Genic; OR > 6 | 1147 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 3 | 47953977 | 47976958 | 22981 | gain | 2617 | MAP4 | 6.48 | Genic; OR > 6 | 1147 |
| 15 | 57438505 | 57444905 | 6400 | loss | 2048 | MYO1E | 6.48 | Genic; OR > 6 | 1148 |
| 15 | 57438505 | 57444905 | 6400 | loss | 2283 | MYO1E | 6.48 | Genic; OR > 6 | 1148 |
| 15 | 57438505 | 57444905 | 6400 | loss | 2620 | MYO1E | 6.48 | Genic; OR > 6 | 1148 |
| 5 | 167051094 | 167054549 | 3455 | gain | 2265 | ODZ2 | 6.48 | Genic; OR > 6 | 1149 |
| 5 | 167051094 | 167054549 | 3455 | gain | 2348 | ODZ2 | 6.48 | Genic; OR > 6 | 1149 |
| 5 | 167048349 | 167054549 | 6200 | gain | 2620 | ODZ2 | 6.48 | Genic; OR > 6 | 1150 |
| 14 | 69914777 | 69920550 | 5773 | loss | 2192 | SYNJ2BP-COX16,SYNJ2BP | 6.48 | Genic; OR > 6 | 1151 |
| 14 | 69912531 | 69920550 | 8019 | loss | 2495 | SYNJ2BP-COX16,SYNJ2BP | 6.48 | Genic; OR > 6 | 1152 |
| 14 | 69912531 | 69920550 | 8019 | loss | 2499 | SYNJ2BP-COX16,SYNJ2BP | 6.48 | Genic; OR > 6 | 1152 |
| 19 | 46032427 | 46060523 | 28096 | gain | 2052 | CYP2A6 | 6.48 | Genic; OR > 6 | 1153 |
| 19 | 46032427 | 46063357 | 30930 | gain | 2374 | CYP2A6 | 6.48 | Genic; OR > 6 | 1154 |
| 19 | 46032427 | 46063357 | 30930 | gain | 2413 | CYP2A6 | 6.48 | Genic; OR > 6 | 1154 |
| 17 | 26546113 | 26546197 | 84 | loss | 2365 | NF1 | 6.48 | Genic; OR > 6 | 1155 |
| 17 | 26546113 | 26546197 | 84 | loss | 2371 | NF1 | 6.48 | Genic; OR > 6 | 1155 |
| 17 | 26546113 | 26546197 | 84 | loss | 2610 | NF1 | 6.48 | Genic; OR > 6 | 1155 |
| 12 | 98606972 | 98613364 | 6392 | loss | 2426 | ANKS1B | 6.48 | Genic; OR > 6 | 1156 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 12 | 98606972 | 98617503 | 10531 | gain | 2227 | ANKS1B | 6.48 | Genic; OR > 6 | 1157 |
| 12 | 98568764 | 99024830 | 456066 | loss | 2326 | ANKS1B | 6.48 | Genic; OR > 6 | 1158 |
| 23 | 70692387 | 70693450 | 1063 | loss | 2544 | OGT | 6.48 | Genic; OR > 6 | 1159 |
| 23 | 70692387 | 70693450 | 1063 | loss | 2628 | OGT | 6.48 | Genic; OR > 6 | 1159 |
| 23 | 70692387 | 70693450 | 1063 | loss | 2633 | OGT | 6.48 | Genic; OR > 6 | 1159 |
| 9 | 111606594 | 111609722 | 3128 | gain | 2175 | PALM2-AKAP2,PALM2 | 6.48 | Genic; OR > 6 | 1160 |
| 9 | 111606594 | 111609722 | 3128 | gain | 2192 | PALM2-AKAP2,PALM2 | 6.48 | Genic; OR > 6 | 1160 |
| 9 | 111606594 | 111609722 | 3128 | gain | 2462 | PALM2-AKAP2,PALM2 | 6.48 | Genic; OR > 6 | 1160 |
| 12 | 80629297 | 80630527 | 1230 | loss | 2452 | PPFIA2 | 6.48 | Genic; OR > 6 | 1161 |
| 12 | 80629297 | 80630527 | 1230 | loss | 2455 | PPFIA2 | 6.48 | Genic; OR > 6 | 1161 |
| 12 | 80629297 | 80630527 | 1230 | loss | 2631 | PPFIA2 | 6.48 | Genic; OR > 6 | 1161 |
| 16 | 3697516 | 3702559 | 5043 | loss | 2203 | TRAP1 | 6.48 | Genic (distinct CNV-subregions); OR > 6 | 1162 |
| 16 | 3697516 | 3702559 | 5043 | loss | 2547 | TRAP1 | 6.48 | Genic (distinct CNV-subregions); OR > 6 | 1162 |
| 16 | 3644964 | 3659399 | 1443 | loss | 2499 | DNASE1,T | 6.48 | Genic (distinct | 1163 |

| Chr | Original CNV Start | Original CNV Stop | Original CNV Size | CNV Type | PD Case ID(s) | RefSeq Gene Symbol(s) | OR | Category | SEQ_ID |
|---|---|---|---|---|---|---|---|---|---|
| | | | 5 | | | RAP1 | | CNV-subregions); OR > 6 | |
| 15 | 82050059 | 82051184 | 1125 | loss | 2238 | SH3GL3 | 8.66 | Genic (distinct CNV-subregions); OR > 6 | 1164 |
| 15 | 81997263 | 81999540 | 2277 | loss | 2533 | SH3GL3 | 8.66 | Genic (distinct CNV-subregions); OR > 6 | 1165 |
| 15 | 81999540 | 82008936 | 9396 | gain | 2435 | SH3GL3 | 8.66 | Genic (distinct CNV-subregions); OR > 6 | 1166 |
| 15 | 81984070 | 81999540 | 15470 | loss | 2502 | SH3GL3 | 8.66 | Genic (distinct CNV-subregions); OR > 6 | 1167 |
| 15 | 81984070 | 81999540 | 15470 | loss | 2502 | SH3GL3 | 8.66 | Genic (distinct CNV-subregions); OR > 6 | 1167 |
| 2 | 231907943 | 231912318 | 4375 | loss | 2454 | ARMC9 | 6.48 | Genic (distinct CNV-subregions); OR > 6 | 1168 |
| 2 | 231907943 | 231912318 | 4375 | loss | 2484 | ARMC9 | 6.48 | Genic (distinct | 1168 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | CNV-subregions); OR > 6 | |
| 2 | 231867046 | 231873096 | 6050 | loss | 2350 | ARMC9 | 6.48 | Genic (distinct CNV-subregions); OR > 6 | 1169 |
| 17 | 47426055 | 47427190 | 1135 | loss | 2450 | CA10 | 6.48 | Genic (distinct CNV-subregions); OR > 6 | 1170 |
| 17 | 47472752 | 47480485 | 7733 | loss | 2180 | CA10 | 6.48 | Genic (distinct CNV-subregions); OR > 6 | 1171 |
| 17 | 47472752 | 47480485 | 7733 | loss | 2455 | CA10 | 6.48 | Genic (distinct CNV-subregions); OR > 6 | 1171 |
| 2 | 208341819 | 208343999 | 2180 | gain | 2316 | FZD5 | 6.48 | Genic (distinct CNV-subregions); OR > 6 | 1172 |
| 2 | 208339551 | 208341819 | 2268 | gain | 2269 | FZD5 | 6.48 | Genic (distinct CNV-subregions); OR > 6 | 1173 |
| 2 | 208339551 | 208341819 | 2268 | gain | 2319 | FZD5 | 6.48 | Genic (distinct | 1173 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | CNV-subregions); OR > 6 | |
| 1 | 169880120 | 169881278 | 1158 | loss | 2637 | MYOC | 6.48 | Genic (distinct CNV-subregions); OR > 6 | 1174 |
| 1 | 169843029 | 169877679 | 34650 | loss | 2402 | MYOC | 6.48 | Genic (distinct CNV-subregions); OR > 6 | 1175 |
| 1 | 169843029 | 169877679 | 34650 | loss | 2403 | MYOC | 6.48 | Genic (distinct CNV-subregions); OR > 6 | 1175 |
| 6 | 33140842 | 33147131 | 6289 | loss | 2534 | HLA-DPA1 | 8.66 | Genic; OR > 6 | 1176 |
| 6 | 33140842 | 33149024 | 8182 | loss | 2528 | HLA-DPA1 | 8.66 | Genic; OR > 6 | 1177 |
| 6 | 33140842 | 33149024 | 8182 | loss | 2637 | HLA-DPA1 | 8.66 | Genic; OR > 6 | 1177 |
| 6 | 33140842 | 33165700 | 24858 | loss | 2475 | HLA-DPA1 | 8.66 | Genic; OR > 6 | 1178 |
| 6 | 33140842 | 33165700 | 24858 | loss | 2475 | HLA-DPB1 | 6.48 | Genic; OR > 6 | 1178 |
| 16 | 15399028 | 16634863 | 1235835 | gain | 2344 | NOMO3,MIR3179-2,MIR3179 | 6.48 | Genic; OR > 6 | 1179 |

Figure 8B (Continued)

| Figure 8B | | | | | | | | | |
|---|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | -3,MIR3179-1,MIR3180-2,MIR3180-3,MIR3180-1,PKD1P1, ABCC6 | | | |
| 16 | 14876356 | 16634863 | 1758507 | gain | 2377 | NOMO3,MIR3179-2,MIR3179-3,MIR3179-1,MIR3180-2,MIR3180-3,MIR3180-1,PKD1P1, ABCC6 | 6.48 | Genic; OR > 6 | 1180 |
| 16 | 14876356 | 16634863 | 1758507 | gain | 2579 | NOMO3,MIR3179-2,MIR3179 | 6.48 | Genic; OR > 6 | 1180 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | -3,MIR3179-1,MIR3180-2,MIR3180-3,MIR3180-1,PKD1P1, ABCC6 | | | |
| 16 | 20378166 | 20396651 | 18485 | gain | 2503 | ACSM2A | 6.48 | Genic; OR > 6 | 1181 |
| 16 | 20378166 | 20396651 | 18485 | gain | 2503 | ACSM2A | 6.48 | Genic; OR > 6 | 1181 |
| 16 | 20378166 | 20403990 | 25824 | loss | 2187 | ACSM2A | 6.48 | Genic; OR > 6 | 1182 |
| 16 | 20378166 | 20403990 | 25824 | loss | 2320 | ACSM2A | 6.48 | Genic; OR > 6 | 1182 |
| 16 | 20378166 | 20403990 | 25824 | loss | 2187 | ACSM2A | 6.48 | Genic; OR > 6 | 1182 |
| 16 | 20378166 | 20403990 | 25824 | loss | 2320 | ACSM2A | 6.48 | Genic; OR > 6 | 1182 |
| 13 | 112546966 | 112555125 | 8159 | gain | 2472 | ATP11A | 6.48 | Genic; OR > 6 | 1183 |
| 13 | 112546966 | 112555125 | 8159 | gain | 2521 | ATP11A | 6.48 | Genic; OR > 6 | 1183 |
| 13 | 112528866 | 112804598 | 275732 | gain | 2333 | ATP11A | 6.48 | Genic; OR > 6 | 1184 |
| 20 | 19979618 | 19981548 | 1930 | loss | 2597 | C20orf26, | 8.66 | Genic; OR > 6 | 1185 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | CRNKL1 | | | |
| 20 | 19971492 | 19982732 | 11240 | gain | 2190 | C20orf26, CRNKL1 | 8.66 | Genic; OR > 6 | 1186 |
| 20 | 19971492 | 19982732 | 11240 | gain | 2474 | C20orf26, CRNKL1 | 8.66 | Genic; OR > 6 | 1186 |
| 20 | 19971492 | 19982732 | 11240 | gain | 2489 | C20orf26, CRNKL1 | 8.66 | Genic; OR > 6 | 1186 |
| 20 | 19971492 | 19982732 | 11240 | gain | 2190 | C20orf26, CRNKL1 | 6.48 | Genic; OR > 6 | 1186 |
| 20 | 19971492 | 19982732 | 11240 | gain | 2474 | C20orf26, CRNKL1 | 6.48 | Genic; OR > 6 | 1186 |
| 20 | 19971492 | 19982732 | 11240 | gain | 2489 | C20orf26, CRNKL1 | 6.48 | Genic; OR > 6 | 1186 |
| 20 | 19971492 | 19982732 | 11240 | gain | 2190 | CRNKL1 | 6.48 | Genic; OR > 6 | 1186 |
| 20 | 19971492 | 19982732 | 11240 | gain | 2474 | CRNKL1 | 6.48 | Genic; OR > 6 | 1186 |
| 20 | 19971492 | 19982732 | 11240 | gain | 2489 | CRNKL1 | 6.48 | Genic; OR > 6 | 1186 |
| 6 | 20640854 | 20646496 | 5642 | gain | 2364 | CDKAL1 | 6.48 | Genic; OR > 6 | 1187 |
| 6 | 20640854 | 20646496 | 5642 | gain | 2622 | CDKAL1 | 6.48 | Genic; OR > 6 | 1187 |
| 6 | 20640854 | 20650470 | 9616 | gain | 2566 | CDKAL1 | 6.48 | Genic; OR > 6 | 1188 |
| 19 | 56292782 | 56294669 | 1887 | loss | 2207 | CTU1 | 6.48 | Genic; OR > 6 | 1189 |
| 19 | 56292782 | 56294669 | 1887 | loss | 2439 | CTU1 | 6.48 | Genic; OR > 6 | 1189 |
| 19 | 56291585 | 56294669 | 3084 | loss | 2391 | CTU1 | 6.48 | Genic; OR > 6 | 1190 |
| 6 | 33160124 | 33164011 | 3887 | gain | 2379 | HLA-DPB1 | 6.48 | Genic; OR > 6 | 1191 |
| 6 | 33160124 | 33181235 | 2111 | loss | 2594 | HLA- | 6.48 | Genic; OR > 6 | 1192 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | 1 | | | DPB1 | | | |
| 8 | 92236650 | 92247179 | 10529 | loss | 2350 | LRRC69 | 6.48 | Genic; OR > 6 | 1193 |
| 8 | 92185155 | 92254749 | 69594 | loss | 2234 | LRRC69 | 6.48 | Genic; OR > 6 | 1194 |
| 8 | 92185155 | 92254749 | 69594 | loss | 2637 | LRRC69 | 6.48 | Genic; OR > 6 | 1194 |
| 20 | 14569192 | 14601662 | 32470 | loss | 2491 | MACROD2 | 6.48 | Genic; OR > 6 | 1195 |
| 20 | 14427309 | 14574538 | 147229 | loss | 2241 | MACROD2 | 6.48 | Genic; OR > 6 | 1196 |
| 20 | 14545964 | 14814436 | 268472 | loss | 2484 | MACROD2 | 6.48 | Genic; OR > 6 | 1197 |
| 2 | 109290141 | 109297575 | 7434 | gain | 2049 | SH3RF3,MIR4266 | 6.48 | Genic; OR > 6 | 1198 |
| 2 | 109290141 | 109297575 | 7434 | gain | 2487 | SH3RF3,MIR4266 | 6.48 | Genic; OR > 6 | 1198 |
| 2 | 109290141 | 109297575 | 7434 | gain | 2506 | SH3RF3,MIR4266 | 6.48 | Genic; OR > 6 | 1198 |
| 20 | 17283788 | 17285773 | 1985 | loss | 2440 | PCSK2 | 6.48 | Genic; OR > 6 | 1199 |
| 20 | 17279850 | 17285773 | 5923 | loss | 2544 | PCSK2 | 6.48 | Genic; OR > 6 | 1200 |
| 20 | 17278926 | 17285773 | 6847 | loss | 2541 | PCSK2 | 6.48 | Genic; OR > 6 | 1201 |
| 2 | 87926461 | 88038874 | 112413 | gain | 2591 | RGPD1 | 6.48 | Genic; OR > 6 | 1202 |
| 2 | 87131062 | 88038874 | 907812 | gain | 2378 | LOC285074 | 6.51 | Genic; OR > 6 | 1203 |
| 2 | 87131062 | 88038874 | 907812 | gain | 2378 | RGPD1 | 6.48 | Genic; OR > 6 | 1203 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 2 | 86984833 | 88008343 | 1023510 | loss | 2440 | LOC285074 | 6.51 | Genic; OR > 6 | 1204 |
| 2 | 86984833 | 88008343 | 1023510 | loss | 2440 | RGPD1 | 6.48 | Genic; OR > 6 | 1204 |
| 23 | 134801361 | 134839685 | 38324 | loss | 2334 | SAGE1 | 6.48 | Genic; OR > 6 | 1205 |
| 23 | 134801361 | 134839685 | 38324 | loss | 2502 | SAGE1 | 6.48 | Genic; OR > 6 | 1205 |
| 23 | 134801361 | 134839685 | 38324 | loss | 2588 | SAGE1 | 6.48 | Genic; OR > 6 | 1205 |
| 17 | 19924055 | 19935009 | 10954 | loss | 2227 | SPECC1 | 6.48 | Genic; OR > 6 | 1206 |
| 17 | 19924055 | 19935009 | 10954 | loss | 2461 | SPECC1 | 6.48 | Genic; OR > 6 | 1206 |
| 17 | 19924055 | 19935009 | 10954 | loss | 2511 | SPECC1 | 6.48 | Genic; OR > 6 | 1206 |
| 1 | 23613915 | 23617786 | 3871 | loss | 2530 | TCEA3 | 6.48 | Genic; OR > 6 | 1207 |
| 1 | 23613915 | 23617786 | 3871 | loss | 2561 | TCEA3 | 6.48 | Genic; OR > 6 | 1207 |
| 1 | 23613915 | 23617786 | 3871 | loss | 2641 | TCEA3 | 6.48 | Genic; OR > 6 | 1207 |
| 16 | 17334130 | 17341824 | 7694 | loss | 2447 | XYLT1 | 6.48 | Genic; OR > 6 | 1208 |
| 16 | 17332931 | 17341824 | 8893 | loss | 2547 | XYLT1 | 6.48 | Genic; OR > 6 | 1209 |
| 16 | 17332931 | 17341824 | 8893 | loss | 2600 | XYLT1 | 6.48 | Genic; OR > 6 | 1209 |
| 16 | 48086361 | 48090194 | 3833 | loss | 2279 | ZNF423 | 6.48 | Genic; OR > 6 | 1210 |
| 16 | 48086361 | 48090194 | 3833 | loss | 2441 | ZNF423 | 6.48 | Genic; OR > 6 | 1210 |
| 16 | 48086361 | 48090194 | 3833 | loss | 2572 | ZNF423 | 6.48 | Genic; OR > 6 | 1210 |
| 9 | 94660128 | 94662745 | 2617 | loss | 2297 | ZNF484 | 6.48 | Genic; OR > 6 | 1211 |
| 9 | 94660128 | 94662745 | 2617 | loss | 2368 | ZNF484 | 6.48 | Genic; OR > 6 | 1211 |
| 9 | 94660128 | 94662745 | 2617 | loss | 2548 | ZNF484 | 6.48 | Genic; OR > 6 | 1211 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 2 | 159999256 | 160001131 | 1875 | loss | 2058 | BAZ2B | 10.84 | Genic; OR > 6 | 1212 |
| 2 | 159999256 | 160001131 | 1875 | loss | 2219 | BAZ2B | 10.84 | Genic; OR > 6 | 1212 |
| 2 | 159999256 | 160001131 | 1875 | loss | 2497 | BAZ2B | 10.84 | Genic; OR > 6 | 1212 |
| 2 | 159999256 | 160001131 | 1875 | loss | 2615 | BAZ2B | 10.84 | Genic; OR > 6 | 1212 |
| 2 | 159999256 | 160001131 | 1875 | loss | 2628 | BAZ2B | 10.84 | Genic; OR > 6 | 1212 |
| 14 | 44043239 | 44045982 | 2743 | loss | 2227 | FSCB | 6.51 | Genic; OR > 6 | 1213 |
| 14 | 44043239 | 44045982 | 2743 | loss | 2273 | FSCB | 6.51 | Genic; OR > 6 | 1213 |
| 14 | 44043239 | 44045982 | 2743 | loss | 2284 | FSCB | 6.51 | Genic; OR > 6 | 1213 |
| 14 | 44043239 | 44045982 | 2743 | loss | 2328 | FSCB | 6.51 | Genic; OR > 6 | 1213 |
| 14 | 44043239 | 44045982 | 2743 | loss | 2366 | FSCB | 6.51 | Genic; OR > 6 | 1213 |
| 14 | 44043239 | 44045982 | 2743 | loss | 2577 | FSCB | 6.51 | Genic; OR > 6 | 1213 |
| 23 | 154456891 | 154456908 | 17 | loss | 2198 | TMLHE | 10.84 | Genic; OR > 6 | 1214 |
| 23 | 154456891 | 154456908 | 17 | loss | 2203 | TMLHE | 10.84 | Genic; OR > 6 | 1214 |
| 23 | 154456891 | 154456908 | 17 | loss | 2462 | TMLHE | 10.84 | Genic; OR > 6 | 1214 |
| 23 | 154456891 | 154456908 | 17 | loss | 2491 | TMLHE | 10.84 | Genic; OR > 6 | 1214 |
| 23 | 154456891 | 154456908 | 17 | loss | 2526 | TMLHE | 10.84 | Genic; OR > 6 | 1214 |
| 14 | 105481933 | 105554767 | 72834 | loss | 2515 | ADAM6 | 8.66 | Genic; OR > 6 | 1215 |
| 14 | 105481933 | 105554767 | 72834 | loss | 2515 |  | 17.46 | Non-genic; OR > 10 | 1215 |
| 14 | 105425440 | 105597555 | 172115 | loss | 2246 | ADAM6 | 8.66 | Genic; OR > 6 | 1216 |
| 14 | 105425440 | 105597555 | 172115 | loss | 2440 | ADAM6 | 8.66 | Genic; OR > 6 | 1216 |
| 14 | 105425440 | 105597555 | 172115 | loss | 2246 |  | 17.46 | Non-genic; OR > 10 | 1216 |
| 14 | 105425440 | 105597555 | 172115 | loss | 2440 |  | 17.46 | Non-genic; OR > 10 | 1216 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 14 | 105425440 | 105597555 | 172115 | loss | 2246 | | 13.04 | Non-genic; OR > 10 | 1216 |
| 14 | 105425440 | 105597555 | 172115 | loss | 2440 | | 13.04 | Non-genic; OR > 10 | 1216 |
| 14 | 105401413 | 105597555 | 196142 | loss | 2615 | ADAM6 | 8.66 | Genic; OR > 6 | 1217 |
| 14 | 105401413 | 105597555 | 196142 | loss | 2615 | | 17.46 | Non-genic; OR > 10 | 1217 |
| 14 | 105401413 | 105597555 | 196142 | loss | 2615 | | 13.04 | Non-genic; OR > 10 | 1217 |
| 11 | 93129448 | 93138702 | 9254 | loss | 2246 | C11orf54 | 8.66 | Genic; OR > 6 | 1218 |
| 11 | 93129448 | 93138702 | 9254 | loss | 2440 | C11orf54 | 8.66 | Genic; OR > 6 | 1218 |
| 11 | 93127981 | 93138702 | 10721 | loss | 2192 | C11orf54 | 8.66 | Genic; OR > 6 | 1219 |
| 11 | 93127981 | 93138702 | 10721 | loss | 2287 | C11orf54 | 8.66 | Genic; OR > 6 | 1219 |
| 19 | 53443125 | 53445054 | 1929 | gain | 2213 | CARD8 | 8.66 | Genic; OR > 6 | 1220 |
| 19 | 53443125 | 53445054 | 1929 | loss | 2294 | CARD8 | 8.66 | Genic; OR > 6 | 1220 |
| 19 | 53443125 | 53445054 | 1929 | gain | 2464 | CARD8 | 8.66 | Genic; OR > 6 | 1220 |
| 19 | 53443125 | 53445054 | 1929 | gain | 2524 | CARD8 | 8.66 | Genic; OR > 6 | 1220 |
| 11 | 5226853 | 5230363 | 3510 | loss | 2630 | HBG1 | 8.66 | Genic; OR > 6 | 1221 |
| 11 | 5226853 | 5231767 | 4914 | gain | 2299 | HBG1 | 8.66 | Genic; OR > 6 | 1222 |
| 11 | 5226853 | 5231767 | 4914 | gain | 2459 | HBG1 | 8.66 | Genic; OR > 6 | 1222 |
| 11 | 5226853 | 5231767 | 4914 | gain | 2616 | HBG1 | 8.66 | Genic; OR > 6 | 1222 |
| 19 | 39394208 | 39395957 | 1749 | loss | 2054 | LSM14A | 8.66 | Genic; OR > 6 | 1223 |
| 19 | 39394208 | 39395957 | 1749 | loss | 2401 | LSM14A | 8.66 | Genic; OR > 6 | 1223 |
| 19 | 39394208 | 39395957 | 1749 | loss | 2425 | LSM14A | 8.66 | Genic; OR > 6 | 1223 |
| 19 | 39394208 | 39395957 | 1749 | loss | 2428 | LSM14A | 8.66 | Genic; OR > 6 | 1223 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 19 | 6841333 | 7056541 | 215208 | gain | 2285 | MBD3L2, MBD3L3, MBD3L4, MBD3L5 | 8.66 | Genic; OR > 6 | 1224 |
| 19 | 6841333 | 7056541 | 215208 | gain | 2503 | MBD3L2, MBD3L3, MBD3L4, MBD3L5 | 8.66 | Genic; OR > 6 | 1224 |
| 19 | 6841333 | 7056541 | 215208 | gain | 2567 | MBD3L2, MBD3L3, MBD3L4, MBD3L5 | 8.66 | Genic; OR > 6 | 1224 |
| 19 | 6841333 | 7056541 | 215208 | gain | 2640 | MBD3L2, MBD3L3, MBD3L4, MBD3L5 | 8.66 | Genic; OR > 6 | 1224 |
| 7 | 76271458 | 76561367 | 289909 | gain | 2373 | LOC100132832 | 8.66 | Genic; OR > 6 | 1225 |
| 7 | 76271458 | 76561367 | 289909 | gain | 2566 | LOC100132832 | 8.66 | Genic; OR > 6 | 1225 |
| 7 | 76271458 | 76571953 | 300495 | gain | 2256 | LOC100132832 | 8.66 | Genic; OR > 6 | 1226 |
| 7 | 75974242 | 76561367 | 587125 | gain | 2302 | LOC100132832 | 8.66 | Genic; OR > 6 | 1227 |
| 19 | 41532062 | 41538649 | 6587 | gain | 2449 | ZFP14 | 8.66 | Genic; OR > 6 | 1228 |
| 19 | 41532062 | 41538649 | 6587 | gain | 2494 | ZFP14 | 8.66 | Genic; OR > 6 | 1228 |
| 19 | 41532062 | 41538649 | 6587 | gain | 2528 | ZFP14 | 8.66 | Genic; OR > 6 | 1228 |
| 19 | 41530835 | 41538649 | 7814 | loss | 2559 | ZFP14 | 8.66 | Genic; OR > 6 | 1229 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 7 | 88424519 | 88433128 | 8609 | loss | 2496 | ZNF804B | 8.66 | Genic; OR > 6 | 1230 |
| 7 | 88424519 | 88433128 | 8609 | loss | 2638 | ZNF804B | 8.66 | Genic; OR > 6 | 1230 |
| 7 | 88422711 | 88441099 | 18388 | loss | 2350 | ZNF804B | 8.66 | Genic; OR > 6 | 1231 |
| 7 | 88180741 | 88480606 | 299865 | gain | 2414 | ZNF804B | 8.66 | Genic; OR > 6 | 1232 |
| 15 | 84564856 | 84571354 | 6498 | loss | 2214 | AGBL1 | 6.48 | Genic; OR > 6 | 1233 |
| 15 | 84564856 | 84571354 | 6498 | loss | 2273 | AGBL1 | 6.48 | Genic; OR > 6 | 1233 |
| 15 | 84564856 | 84571354 | 6498 | loss | 2488 | AGBL1 | 6.48 | Genic; OR > 6 | 1233 |
| 2 | 144135530 | 144141642 | 6112 | gain | 2169 | ARHGAP15 | 6.48 | Genic; OR > 6 | 1234 |
| 2 | 144135530 | 144141642 | 6112 | gain | 2548 | ARHGAP15 | 6.48 | Genic; OR > 6 | 1234 |
| 2 | 144135530 | 144141642 | 6112 | gain | 2639 | ARHGAP15 | 6.48 | Genic; OR > 6 | 1234 |
| 5 | 78410921 | 78425666 | 14745 | gain | 2377 | BHMT2 | 6.48 | Genic; OR > 6 | 1235 |
| 5 | 78410921 | 78425666 | 14745 | gain | 2529 | BHMT2 | 6.48 | Genic; OR > 6 | 1235 |
| 5 | 78410921 | 78427395 | 16474 | gain | 2523 | BHMT2 | 6.48 | Genic; OR > 6 | 1236 |
| 6 | 159244580 | 159262694 | 18114 | loss | 2290 | C6orf99 | 6.48 | Genic; OR > 6 | 1237 |
| 6 | 159244580 | 159262694 | 18114 | loss | 2612 | C6orf99 | 6.48 | Genic; OR > 6 | 1237 |
| 6 | 159244580 | 159262694 | 18114 | loss | 2622 | C6orf99 | 6.48 | Genic; OR > 6 | 1237 |
| 7 | 112227340 | 112265575 | 3823 | gain | 2328 | C7orf60 | 6.48 | Genic; OR > 6 | 1238 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 7 | 112221312 | 112265575 | 44263 | gain | 2271 | C7orf60 | 6.48 | Genic; OR > 6 | 1239 |
| 7 | 112221312 | 112265575 | 44263 | gain | 2512 | C7orf60 | 6.48 | Genic; OR > 6 | 1239 |
| 3 | 56583582 | 56594585 | 11003 | loss | 2051 | CCDC66 | 6.48 | Genic; OR > 6 | 1240 |
| 3 | 56583582 | 56594585 | 11003 | loss | 2389 | CCDC66 | 6.48 | Genic; OR > 6 | 1240 |
| 3 | 56357796 | 56715373 | 357577 | gain | 2191 | CCDC66 | 6.48 | Genic; OR > 6 | 1241 |
| 18 | 62362980 | 62365683 | 2703 | loss | 2260 | CDH19 | 6.48 | Genic; OR > 6 | 1242 |
| 18 | 62362980 | 62365683 | 2703 | loss | 2286 | CDH19 | 6.48 | Genic; OR > 6 | 1242 |
| 18 | 62327381 | 62430905 | 103524 | gain | 2541 | CDH19 | 6.48 | Genic; OR > 6 | 1243 |
| 13 | 109911515 | 109916950 | 5435 | gain | 2046 | COL4A2 | 6.48 | Genic; OR > 6 | 1244 |
| 13 | 109911515 | 109916950 | 5435 | gain | 2055 | COL4A2 | 6.48 | Genic; OR > 6 | 1244 |
| 13 | 109911515 | 109916950 | 5435 | gain | 2622 | COL4A2 | 6.48 | Genic; OR > 6 | 1244 |
| 5 | 109094597 | 109100436 | 5839 | gain | 2409 | MAN2A1, MIR548Z, MIR548C | 6.48 | Genic; OR > 6 | 1245 |
| 5 | 109094597 | 109100436 | 5839 | gain | 2433 | MAN2A1, MIR548Z, MIR548C | 6.48 | Genic; OR > 6 | 1245 |
| 5 | 109094597 | 109101681 | 7084 | gain | 2603 | MAN2A1, MIR548Z, MIR548C | 6.48 | Genic; OR > 6 | 1246 |
| 1 | 246713340 | 246794552 | 8121 | gain | 2204 | OR2T29 | 6.48 | Genic; OR > 6 | 1247 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 1 | 246573165 | 246941904 | 368739 | gain | 2433 | OR2T29 | 6.48 | Genic; OR > 6 | 1248 |
| 1 | 246573165 | 246941904 | 368739 | gain | 2443 | OR2T29 | 6.48 | Genic; OR > 6 | 1248 |
| 4 | 129851236 | 129997476 | 146240 | gain | 2590 | PHF17 | 6.48 | Genic; OR > 6 | 1249 |
| 4 | 129993002 | 130147307 | 154305 | gain | 2454 | PHF17 | 6.48 | Genic; OR > 6 | 1250 |
| 4 | 129993002 | 130147307 | 154305 | gain | 2578 | PHF17 | 6.48 | Genic; OR > 6 | 1250 |
| 6 | 84286088 | 84287655 | 1567 | loss | 2325 | PRSS35 | 6.48 | Genic; OR > 6 | 1251 |
| 6 | 84286088 | 84287655 | 1567 | loss | 2367 | PRSS35 | 6.48 | Genic; OR > 6 | 1251 |
| 6 | 84286088 | 84287655 | 1567 | loss | 2449 | PRSS35 | 6.48 | Genic; OR > 6 | 1251 |
| 15 | 22682129 | 22684804 | 2675 | loss | 2381 | SNRPN | 6.48 | Genic; OR > 6 | 1252 |
| 15 | 22682129 | 22684804 | 2675 | loss | 2389 | SNRPN | 6.48 | Genic; OR > 6 | 1252 |
| 15 | 22682129 | 22684804 | 2675 | loss | 2561 | SNRPN | 6.48 | Genic; OR > 6 | 1252 |
| 22 | 28477025 | 28481680 | 4655 | gain | 2590 | ZMAT5 | 6.48 | Genic; OR > 6 | 1253 |
| 22 | 28473177 | 28481680 | 8503 | gain | 2263 | ZMAT5 | 6.48 | Genic; OR > 6 | 1254 |
| 22 | 28473177 | 28481680 | 8503 | gain | 2427 | ZMAT5 | 6.48 | Genic; OR > 6 | 1254 |
| 4 | 106681766 | 106712855 | 31089 | loss | 2428 | ARHGEF38 | 6.48 | Genic (distinct CNV-subregions); OR > 6 | 1255 |
| 4 | 106681766 | 106712855 | 31089 | loss | 2457 | ARHGEF38 | 6.48 | Genic (distinct CNV-subregions); OR > 6 | 1255 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 4 | 106733769 | 106778760 | 44991 | loss | 2603 | ARHGEF38 | 6.48 | Genic (distinct CNV-subregions); OR > 6 | 1256 |
| 5 | 53256559 | 53257616 | 1057 | loss | 2626 | ARL15 | 8.66 | Genic (distinct CNV-subregions); OR > 6 | 1257 |
| 5 | 53351698 | 53355998 | 4300 | loss | 2191 | ARL15 | 8.66 | Genic (distinct CNV-subregions); OR > 6 | 1258 |
| 5 | 53351698 | 53355998 | 4300 | loss | 2489 | ARL15 | 8.66 | Genic (distinct CNV-subregions); OR > 6 | 1258 |
| 5 | 53358703 | 53851975 | 493272 | gain | 2534 | ARL15 | 8.66 | Genic (distinct CNV-subregions); OR > 6 | 1259 |
| 5 | 53358703 | 53851975 | 493272 | gain | 2534 | ARL15 | 8.66 | Genic (distinct CNV-subregions); OR > 6 | 1259 |
| 5 | 53358703 | 53851975 | 493272 | gain | 2534 | ARL15,HSPB3,SNX18 | 6.48 | Genic (distinct CNV-subregions); OR > 6 | 1259 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 5 | 115607419 | 115614772 | 7353 | loss | 2350 | COMMD10 | 8.66 | Genic (distinct CNV-subregions); OR > 6 | 1260 |
| 5 | 115591372 | 115604790 | 13418 | loss | 2473 | COMMD10 | 8.66 | Genic (distinct CNV-subregions); OR > 6 | 1261 |
| 5 | 115491539 | 115512186 | 20647 | loss | 2350 | COMMD10 | 8.66 | Genic (distinct CNV-subregions); OR > 6 | 1262 |
| 5 | 115491539 | 115512186 | 20647 | loss | 2456 | COMMD10 | 8.66 | Genic (distinct CNV-subregions); OR > 6 | 1262 |
| 5 | 115560106 | 115636905 | 76799 | loss | 2642 | COMMD10 | 8.66 | Genic (distinct CNV-subregions); OR > 6 | 1263 |
| 5 | 115560106 | 115636905 | 76799 | loss | 2642 | COMMD10 | 8.66 | Genic (distinct CNV-subregions); OR > 6 | 1263 |
| 5 | 115560106 | 115636905 | 76799 | loss | 2642 | COMMD10 | 8.66 | Genic (distinct CNV-subregions); OR > 6 | 1263 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 5 | 115560106 | 115636905 | 76799 | loss | 2642 | COMMD10 | 8.66 | Genic (distinct CNV-subregions); OR > 6 | 1263 |
| 5 | 115560106 | 115636905 | 76799 | loss | 2642 | COMMD10 | 8.66 | Genic (distinct CNV-subregions); OR > 6 | 1263 |
| 2 | 236985613 | 236990568 | 4955 | loss | 2299 | IQCA1 | 6.48 | Genic (distinct CNV-subregions); OR > 6 | 1264 |
| 2 | 236985613 | 236993935 | 8322 | gain | 2603 | IQCA1 | 6.48 | Genic (distinct CNV-subregions); OR > 6 | 1265 |
| 2 | 236985613 | 236993935 | 8322 | gain | 2603 | IQCA1 | 6.48 | Genic (distinct CNV-subregions); OR > 6 | 1265 |
| 2 | 236964034 | 236981253 | 17219 | loss | 2182 | IQCA1 | 6.48 | Genic (distinct CNV-subregions); OR > 6 | 1266 |
| 1 | 33587183 | 33589045 | 1862 | gain | 2457 | PHC2 | 10.84 | Genic (distinct CNV-subregions); OR > 6 | 1267 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 1 | 33571827 | 33573694 | 1867 | gain | 2283 | PHC2 | 10.84 | Genic (distinct CNV-subregions); OR > 6 | 1268 |
| 1 | 33571827 | 33573694 | 1867 | gain | 2349 | PHC2 | 10.84 | Genic (distinct CNV-subregions); OR > 6 | 1268 |
| 1 | 33590327 | 33592389 | 2062 | gain | 2389 | PHC2 | 10.84 | Genic (distinct CNV-subregions); OR > 6 | 1269 |
| 1 | 33573694 | 33578277 | 4583 | gain | 2430 | PHC2 | 10.84 | Genic (distinct CNV-subregions); OR > 6 | 1270 |
| 1 | 181900399 | 181907383 | 6984 | loss | 2193 | RGL1 | 6.48 | Genic (distinct CNV-subregions); OR > 6 | 1271 |
| 1 | 181900399 | 181907383 | 6984 | loss | 2359 | RGL1 | 6.48 | Genic (distinct CNV-subregions); OR > 6 | 1271 |
| 1 | 182098193 | 182583365 | 485172 | gain | 2404 | RGL1,GLT25D2,TSEN15 | 6.48 | Genic (distinct CNV-subregions); OR > 6 | 1272 |

| Chr | Original CNV Start | Original CNV Stop | Original CNV Size | CNV Type | PD Case ID(s) | RefSeq Gene Symbol(s) | OR | Category | SEQ_ID |
|---|---|---|---|---|---|---|---|---|---|
| 17 | 1450981 | 1453281 | 2300 | loss | 2610 | SLC43A2 | 6.48 | Genic (distinct CNV-subregions); OR > 6 | 1273 |
| 17 | 1418207 | 1433148 | 14941 | gain | 2432 | SLC43A2 | 6.48 | Genic (distinct CNV-subregions); OR > 6 | 1274 |
| 17 | 1418207 | 1433148 | 14941 | gain | 2563 | SLC43A2 | 6.48 | Genic (distinct CNV-subregions); OR > 6 | 1274 |
| 6 | 96137816 | 96139590 | 1774 | gain | 2247 | MANEA | 7.15 | Genic; OR > 6 | 1275 |
| 6 | 96137816 | 96139590 | 1774 | gain | 2285 | MANEA | 7.15 | Genic; OR > 6 | 1275 |
| 6 | 96137816 | 96139590 | 1774 | gain | 2366 | MANEA | 7.15 | Genic; OR > 6 | 1275 |
| 6 | 96137816 | 96139590 | 1774 | gain | 2371 | MANEA | 7.15 | Genic; OR > 6 | 1275 |
| 6 | 96137816 | 96139590 | 1774 | gain | 2391 | MANEA | 7.15 | Genic; OR > 6 | 1275 |
| 6 | 96137816 | 96139590 | 1774 | gain | 2429 | MANEA | 7.15 | Genic; OR > 6 | 1275 |
| 6 | 96137816 | 96139590 | 1774 | gain | 2472 | MANEA | 7.15 | Genic; OR > 6 | 1275 |
| 6 | 96137816 | 96139590 | 1774 | gain | 2496 | MANEA | 7.15 | Genic; OR > 6 | 1275 |
| 6 | 96137816 | 96139590 | 1774 | gain | 2566 | MANEA | 7.15 | Genic; OR > 6 | 1275 |
| 6 | 96137816 | 96139590 | 1774 | gain | 2596 | MANEA | 7.15 | Genic; OR > 6 | 1275 |
| 6 | 96137816 | 96139590 | 1774 | gain | 2610 | MANEA | 7.15 | Genic; OR > 6 | 1275 |
| 6 | 96137816 | 96139590 | 1774 | gain | 2614 | MANEA | 7.15 | Genic; OR > 6 | 1275 |
| 6 | 96137816 | 96139590 | 1774 | gain | 2616 | MANEA | 7.15 | Genic; OR > 6 | 1275 |
| 1 | 111732268 | 111734021 | 1753 | loss | 2221 | PGCP1 | 6.48 | Genic (distinct CNV-subregions); OR | 1276 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 6 | |
| 1 | 111732268 | 111734021 | 1753 | loss | 2245 | PGCP1 | 6.48 | Genic (distinct CNV-subregions); OR > 6 | 1276 |
| 1 | 111732268 | 111734021 | 1753 | loss | 2256 | PGCP1 | 6.48 | Genic (distinct CNV-subregions); OR > 6 | 1276 |
| 1 | 111732268 | 111734021 | 1753 | loss | 2284 | PGCP1 | 6.48 | Genic (distinct CNV-subregions); OR > 6 | 1276 |
| 1 | 111732268 | 111734021 | 1753 | loss | 2292 | PGCP1 | 6.48 | Genic (distinct CNV-subregions); OR > 6 | 1276 |
| 1 | 111732268 | 111734021 | 1753 | loss | 2360 | PGCP1 | 6.48 | Genic (distinct CNV-subregions); OR > 6 | 1276 |
| 1 | 111732268 | 111734021 | 1753 | loss | 2362 | PGCP1 | 6.48 | Genic (distinct CNV-subregions); OR > 6 | 1276 |
| 1 | 111732268 | 111734021 | 1753 | loss | 2515 | PGCP1 | 6.48 | Genic (distinct CNV-subregions); OR | 1276 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 6 | |
| 1 | 111732268 | 111734021 | 1753 | loss | 2544 | PGCP1 | 6.48 | Genic (distinct CNV-subregions); OR > 6 | 1276 |
| 7 | 69834174 | 69839924 | 5750 | loss | 2621 | AUTS2 | 8.66 | Genic (distinct CNV-subregions); OR > 6 | 1277 |
| 7 | 69299632 | 69313141 | 13509 | loss | 2354 | AUTS2 | 8.66 | Genic (distinct CNV-subregions); OR > 6 | 1278 |
| 7 | 69511801 | 69590195 | 78394 | loss | 2361 | AUTS2 | 8.66 | Genic (distinct CNV-subregions); OR > 6 | 1279 |
| 7 | 69356304 | 69460357 | 104053 | loss | 2358 | AUTS2 | 8.66 | Genic (distinct CNV-subregions); OR > 6 | 1280 |
| 3 | 169911847 | 169915257 | 3410 | loss | 2469 | EGFEM1P | 6.48 | Genic (distinct CNV-subregions); OR > 6 | 1281 |
| 3 | 169807923 | 169824114 | 16191 | gain | 2616 | EGFEM1P | 6.48 | Genic (distinct CNV-subregions); OR | 1282 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 6 | |
| 3 | 169954218 | 170016745 | 62527 | loss | 2251 | EGFEM1P | 6.48 | Genic (distinct CNV-subregions); OR > 6 | 1283 |
| 6 | 73419032 | 73421405 | 2373 | loss | 2475 | KCNQ5 | 6.48 | Genic (distinct CNV-subregions); OR > 6 | 1284 |
| 6 | 73558441 | 73560954 | 2513 | loss | 2611 | KCNQ5 | 6.48 | Genic (distinct CNV-subregions); OR > 6 | 1285 |
| 6 | 73751296 | 73763854 | 12558 | gain | 2169 | KCNQ5 | 6.48 | Genic (distinct CNV-subregions); OR > 6 | 1286 |
| 8 | 97941620 | 97949919 | 8299 | loss | 2350 | PGCP | 6.48 | Genic (distinct CNV-subregions); OR > 6 | 1287 |
| 8 | 97917880 | 97934261 | 16381 | loss | 2468 | PGCP | 6.48 | Genic (distinct CNV-subregions); OR > 6 | 1288 |
| 8 | 97963755 | 97984669 | 20914 | loss | 2634 | PGCP | 6.48 | Genic (distinct CNV-subregions); OR | 1289 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 6 | |
| 6 | 32973734 | 32978015 | 4281 | loss | 2563 | LOC100294145 | 8.66 | Genic; OR > 6 | 1290 |
| 6 | 32973734 | 32978015 | 4281 | loss | 2629 | LOC100294145 | 8.66 | Genic; OR > 6 | 1290 |
| 6 | 32973734 | 32979975 | 6241 | loss | 2430 | LOC100294145 | 8.66 | Genic; OR > 6 | 1291 |
| 6 | 32973734 | 32979975 | 6241 | loss | 2621 | LOC100294145 | 8.66 | Genic; OR > 6 | 1291 |
| 11 | 58572501 | 58603440 | 30939 | gain | 2053 | LOC283194 | 6.48 | Genic; OR > 6 | 1292 |
| 11 | 58572501 | 58603440 | 30939 | loss | 2226 | LOC283194 | 6.48 | Genic; OR > 6 | 1292 |
| 11 | 58566401 | 58603440 | 37039 | gain | 2488 | LOC283194 | 6.48 | Genic; OR > 6 | 1293 |
| 2 | 87131062 | 87721951 | 590889 | loss | 2242 | LOC285074 | 6.51 | Genic; OR > 6 | 1294 |
| 2 | 86964156 | 87721951 | 757795 | loss | 2246 | LOC285074 | 6.51 | Genic; OR > 6 | 1295 |
| 2 | 86954002 | 87721951 | 767949 | gain | 2282 | LOC285074 | 6.51 | Genic; OR > 6 | 1296 |
| 2 | 86964156 | 87926461 | 962305 | gain | 2190 | LOC285074 | 6.51 | Genic; OR > 6 | 1297 |
| 23 | 98627062 | 98628953 | 1891 | gain | 2207 | LOC442459 | 6.48 | Genic (distinct CNV-subregions); OR > 6 | 1298 |
| 23 | 98953337 | 98979358 | 2602 | loss | 2536 | LOC442459 | 6.48 | Genic (distinct | 1299 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | 1 | | | 9 | | CNV-subregions); OR > 6 | |
| 23 | 98753421 | 98853902 | 100481 | loss | 2350 | LOC442459 | 6.48 | Genic (distinct CNV-subregions); OR > 6 | 1300 |
| 7 | 7815875 | 7818993 | 3118 | loss | 2345 | LOC729852 | 6.48 | Genic (distinct CNV-subregions); OR > 6 | 1301 |
| 7 | 7837305 | 7894718 | 57413 | loss | 2176 | LOC729852 | 6.48 | Genic (distinct CNV-subregions); OR > 6 | 1302 |
| 19 | 22936377 | 22945553 | 9176 | loss | 2051 | | 21.92 | Non-genic; OR > 10 | 1303 |
| 19 | 22936377 | 22945553 | 9176 | loss | 2269 | | 21.92 | Non-genic; OR > 10 | 1303 |
| 19 | 22936377 | 22945553 | 9176 | loss | 2270 | | 21.92 | Non-genic; OR > 10 | 1303 |
| 19 | 22936377 | 22945553 | 9176 | loss | 2294 | | 21.92 | Non-genic; OR > 10 | 1303 |
| 19 | 22936377 | 22945553 | 9176 | loss | 2339 | | 21.92 | Non-genic; OR > 10 | 1303 |
| 19 | 22936377 | 22945553 | 9176 | loss | 2568 | | 21.92 | Non-genic; OR > 10 | 1303 |
| 19 | 22936377 | 22945553 | 9176 | loss | 2589 | | 21.92 | Non-genic; OR | 1303 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ _ID |
| | | | | | | | | > 10 | |
| 19 | 22936377 | 22945553 | 9176 | loss | 2597 | | 21.92 | Non-genic; OR > 10 | 1303 |
| 19 | 22936377 | 22945553 | 9176 | loss | 2599 | | 21.92 | Non-genic; OR > 10 | 1303 |
| 19 | 22936377 | 23012951 | 76574 | loss | 2440 | | 21.92 | Non-genic; OR > 10 | 1304 |
| 7 | 6636136 | 6638418 | 2282 | gain | 2263 | | 19.69 | Non-genic; OR > 10 | 1305 |
| 7 | 6636136 | 6638418 | 2282 | gain | 2338 | | 19.69 | Non-genic; OR > 10 | 1305 |
| 7 | 6636136 | 6638418 | 2282 | gain | 2346 | | 19.69 | Non-genic; OR > 10 | 1305 |
| 7 | 6636136 | 6638418 | 2282 | gain | 2357 | | 19.69 | Non-genic; OR > 10 | 1305 |
| 7 | 6636136 | 6638418 | 2282 | gain | 2427 | | 19.69 | Non-genic; OR > 10 | 1305 |
| 7 | 6636136 | 6638418 | 2282 | gain | 2556 | | 19.69 | Non-genic; OR > 10 | 1305 |
| 7 | 6636136 | 6638418 | 2282 | gain | 2559 | | 19.69 | Non-genic; OR > 10 | 1305 |
| 7 | 6636136 | 6638418 | 2282 | gain | 2590 | | 19.69 | Non-genic; OR > 10 | 1305 |
| 7 | 6636136 | 6638418 | 2282 | gain | 2614 | | 19.69 | Non-genic; OR > 10 | 1305 |
| 1 | 100819146 | 100820835 | 1689 | loss | 2046 | | 17.46 | Non-genic; OR > 10 | 1306 |
| 1 | 100819146 | 100820835 | 1689 | loss | 2218 | | 17.46 | Non-genic; OR | 1306 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 10 | |
| 1 | 100819146 | 100820835 | 1689 | loss | 2365 | | 17.46 | Non-genic; OR > 10 | 1306 |
| 1 | 100819146 | 100820835 | 1689 | loss | 2558 | | 17.46 | Non-genic; OR > 10 | 1306 |
| 1 | 100819146 | 100820835 | 1689 | loss | 2604 | | 17.46 | Non-genic; OR > 10 | 1306 |
| 1 | 100819146 | 100820835 | 1689 | loss | 2611 | | 17.46 | Non-genic; OR > 10 | 1306 |
| 1 | 100819146 | 100820835 | 1689 | loss | 2612 | | 17.46 | Non-genic; OR > 10 | 1306 |
| 1 | 100816034 | 100825130 | 9096 | loss | 2360 | | 17.46 | Non-genic; OR > 10 | 1307 |
| 14 | 105520895 | 105554767 | 33872 | gain | 2367 | | 17.46 | Non-genic; OR > 10 | 1308 |
| 14 | 105520895 | 105556724 | 35829 | gain | 2286 | | 17.46 | Non-genic; OR > 10 | 1309 |
| 14 | 105520895 | 105556724 | 35829 | gain | 2567 | | 17.46 | Non-genic; OR > 10 | 1309 |
| 14 | 105520895 | 105556724 | 35829 | gain | 2286 | | 13.04 | Non-genic; OR > 10 | 1309 |
| 14 | 105520895 | 105556724 | 35829 | gain | 2567 | | 13.04 | Non-genic; OR > 10 | 1309 |
| 14 | 105520895 | 105560526 | 39631 | gain | 2583 | | 17.46 | Non-genic; OR > 10 | 1310 |
| 14 | 105520895 | 105560526 | 39631 | gain | 2583 | | 13.04 | Non-genic; OR > 10 | 1310 |
| 21 | 39694333 | 39697029 | 2696 | gain | 2372 | | 15.25 | Non-genic; OR | 1311 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 10 | |
| 21 | 39694333 | 39697029 | 2696 | gain | 2507 | | 15.25 | Non-genic; OR > 10 | 1311 |
| 21 | 39694333 | 39697029 | 2696 | gain | 2519 | | 15.25 | Non-genic; OR > 10 | 1311 |
| 21 | 39694333 | 39697029 | 2696 | gain | 2596 | | 15.25 | Non-genic; OR > 10 | 1311 |
| 21 | 39694333 | 39697029 | 2696 | gain | 2604 | | 15.25 | Non-genic; OR > 10 | 1311 |
| 7 | 108521547 | 108526147 | 4600 | loss | 2424 | | 15.25 | Non-genic; OR > 10 | 1312 |
| 7 | 108521547 | 108526147 | 4600 | loss | 2427 | | 15.25 | Non-genic; OR > 10 | 1312 |
| 7 | 108521547 | 108526147 | 4600 | loss | 2439 | | 15.25 | Non-genic; OR > 10 | 1312 |
| 7 | 108521547 | 108526147 | 4600 | loss | 2517 | | 15.25 | Non-genic; OR > 10 | 1312 |
| 7 | 108521547 | 108526147 | 4600 | loss | 2614 | | 15.25 | Non-genic; OR > 10 | 1312 |
| 21 | 39694333 | 39699694 | 5361 | gain | 2530 | | 15.25 | Non-genic; OR > 10 | 1313 |
| 7 | 108521547 | 108529291 | 7744 | loss | 2046 | | 15.25 | Non-genic; OR > 10 | 1314 |
| 7 | 108521547 | 108529291 | 7744 | loss | 2429 | | 15.25 | Non-genic; OR > 10 | 1314 |
| 8 | 28544961 | 28559698 | 14737 | loss | 2049 | | 15.25 | Non-genic; OR > 10 | 1315 |
| 8 | 28544961 | 28559698 | 1473 | loss | 2213 | | 15.25 | Non-genic; OR | 1315 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | 7 | | | | | > 10 | |
| 8 | 28544961 | 28559698 | 14737 | loss | 2267 | | 15.25 | Non-genic; OR > 10 | 1315 |
| 8 | 28544961 | 28559698 | 14737 | loss | 2479 | | 15.25 | Non-genic; OR > 10 | 1315 |
| 8 | 28544961 | 28559698 | 14737 | loss | 2505 | | 15.25 | Non-genic; OR > 10 | 1315 |
| 8 | 28544961 | 28559698 | 14737 | loss | 2509 | | 15.25 | Non-genic; OR > 10 | 1315 |
| 8 | 28544961 | 28559698 | 14737 | loss | 2519 | | 15.25 | Non-genic; OR > 10 | 1315 |
| 21 | 39669733 | 39707107 | 37374 | gain | 2312 | | 15.25 | Non-genic; OR > 10 | 1316 |
| 1 | 94922323 | 94925649 | 3326 | gain | 2048 | | 13.04 | Non-genic; OR > 10 | 1317 |
| 1 | 94922323 | 94925649 | 3326 | gain | 2223 | | 13.04 | Non-genic; OR > 10 | 1317 |
| 7 | 149379563 | 149383502 | 3939 | loss | 2048 | | 13.04 | Non-genic; OR > 10 | 1318 |
| 7 | 149379563 | 149383502 | 3939 | loss | 2256 | | 13.04 | Non-genic; OR > 10 | 1318 |
| 7 | 149379563 | 149383502 | 3939 | loss | 2257 | | 13.04 | Non-genic; OR > 10 | 1318 |
| 7 | 149378315 | 149383502 | 5187 | loss | 2221 | | 13.04 | Non-genic; OR > 10 | 1319 |
| 7 | 149378315 | 149383502 | 5187 | loss | 2289 | | 13.04 | Non-genic; OR > 10 | 1319 |
| 3 | 162734077 | 162742289 | 8212 | loss | 2358 | | 13.04 | Non-genic; OR | 1320 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 10 | |
| 3 | 162734077 | 162742289 | 8212 | loss | 2488 | | 13.04 | Non-genic; OR > 10 | 1320 |
| 3 | 162734077 | 162742289 | 8212 | loss | 2614 | | 13.04 | Non-genic; OR > 10 | 1320 |
| 3 | 162734077 | 162742289 | 8212 | loss | 2642 | | 13.04 | Non-genic; OR > 10 | 1320 |
| 7 | 149371923 | 149383502 | 11579 | loss | 2358 | | 13.04 | Non-genic; OR > 10 | 1321 |
| 1 | 94922323 | 94937002 | 14679 | gain | 2448 | | 13.04 | Non-genic; OR > 10 | 1322 |
| 1 | 94922323 | 94937002 | 14679 | gain | 2513 | | 13.04 | Non-genic; OR > 10 | 1322 |
| 3 | 162727107 | 162742289 | 15182 | loss | 2352 | | 13.04 | Non-genic; OR > 10 | 1323 |
| 1 | 94922323 | 94938880 | 16557 | gain | 2536 | | 13.04 | Non-genic; OR > 10 | 1324 |
| 1 | 94907642 | 94925649 | 18007 | loss | 2590 | | 13.04 | Non-genic; OR > 10 | 1325 |
| 3 | 162727107 | 162747917 | 20810 | loss | 2336 | | 13.04 | Non-genic; OR > 10 | 1326 |
| 19 | 14906155 | 14910693 | 4538 | loss | 2052 | | 11.33 | Non-genic; OR > 10 | 1327 |
| 19 | 14906155 | 14910693 | 4538 | gain | 2178 | | 11.33 | Non-genic; OR > 10 | 1327 |
| 19 | 14906155 | 14910693 | 4538 | gain | 2200 | | 11.33 | Non-genic; OR > 10 | 1327 |
| 19 | 14906155 | 14910693 | 4538 | gain | 2232 | | 11.33 | Non-genic; OR | 1327 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| 19 | 14906155 | 14910693 | 4538 | loss | 2268 | | 11.33 | Non-genic; OR > 10 | 1327 |
| 19 | 14906155 | 14910693 | 4538 | loss | 2273 | | 11.33 | Non-genic; OR > 10 | 1327 |
| 19 | 14906155 | 14910693 | 4538 | loss | 2275 | | 11.33 | Non-genic; OR > 10 | 1327 |
| 19 | 14906155 | 14910693 | 4538 | loss | 2278 | | 11.33 | Non-genic; OR > 10 | 1327 |
| 19 | 14906155 | 14910693 | 4538 | loss | 2301 | | 11.33 | Non-genic; OR > 10 | 1327 |
| 19 | 14906155 | 14910693 | 4538 | loss | 2305 | | 11.33 | Non-genic; OR > 10 | 1327 |
| 19 | 14906155 | 14910693 | 4538 | loss | 2355 | | 11.33 | Non-genic; OR > 10 | 1327 |
| 19 | 14906155 | 14910693 | 4538 | loss | 2364 | | 11.33 | Non-genic; OR > 10 | 1327 |
| 19 | 14906155 | 14910693 | 4538 | loss | 2373 | | 11.33 | Non-genic; OR > 10 | 1327 |
| 19 | 14906155 | 14910693 | 4538 | loss | 2375 | | 11.33 | Non-genic; OR > 10 | 1327 |
| 19 | 14906155 | 14910693 | 4538 | loss | 2378 | | 11.33 | Non-genic; OR > 10 | 1327 |
| 19 | 14906155 | 14910693 | 4538 | loss | 2384 | | 11.33 | Non-genic; OR > 10 | 1327 |
| 19 | 14906155 | 14910693 | 4538 | loss | 2395 | | 11.33 | Non-genic; OR > 10 | 1327 |
| 19 | 14906155 | 14910693 | 4538 | loss | 2397 | | 11.33 | Non-genic; OR | 1327 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 10 | |
| 19 | 14906155 | 14910693 | 4538 | loss | 2404 | | 11.33 | Non-genic; OR > 10 | 1327 |
| 19 | 14906155 | 14910693 | 4538 | loss | 2415 | | 11.33 | Non-genic; OR > 10 | 1327 |
| 19 | 14906155 | 14910693 | 4538 | loss | 2419 | | 11.33 | Non-genic; OR > 10 | 1327 |
| 19 | 14906155 | 14910693 | 4538 | loss | 2420 | | 11.33 | Non-genic; OR > 10 | 1327 |
| 19 | 14906155 | 14910693 | 4538 | loss | 2427 | | 11.33 | Non-genic; OR > 10 | 1327 |
| 19 | 14906155 | 14910693 | 4538 | loss | 2437 | | 11.33 | Non-genic; OR > 10 | 1327 |
| 19 | 14906155 | 14910693 | 4538 | gain | 2466 | | 11.33 | Non-genic; OR > 10 | 1327 |
| 19 | 14906155 | 14910693 | 4538 | gain | 2486 | | 11.33 | Non-genic; OR > 10 | 1327 |
| 19 | 14906155 | 14910693 | 4538 | loss | 2541 | | 11.33 | Non-genic; OR > 10 | 1327 |
| 19 | 14906155 | 14910693 | 4538 | loss | 2543 | | 11.33 | Non-genic; OR > 10 | 1327 |
| 19 | 14906155 | 14910693 | 4538 | loss | 2548 | | 11.33 | Non-genic; OR > 10 | 1327 |
| 19 | 14906155 | 14910693 | 4538 | loss | 2557 | | 11.33 | Non-genic; OR > 10 | 1327 |
| 19 | 14906155 | 14910693 | 4538 | loss | 2580 | | 11.33 | Non-genic; OR > 10 | 1327 |
| 19 | 14906155 | 14910693 | 4538 | loss | 2584 | | 11.33 | Non-genic; OR | 1327 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | | | | | | > 10 | |
| 19 | 14906155 | 14910693 | 4538 | loss | 2601 | | 11.33 | Non-genic; OR > 10 | 1327 |
| 19 | 14906155 | 14910693 | 4538 | loss | 2608 | | 11.33 | Non-genic; OR > 10 | 1327 |
| 19 | 14906155 | 14910693 | 4538 | loss | 2612 | | 11.33 | Non-genic; OR > 10 | 1327 |
| 19 | 14906155 | 14910693 | 4538 | loss | 2629 | | 11.33 | Non-genic; OR > 10 | 1327 |
| 19 | 14906155 | 14910693 | 4538 | loss | 2642 | | 11.33 | Non-genic; OR > 10 | 1327 |
| 19 | 14906155 | 14910693 | 4538 | loss | 2643 | | 11.33 | Non-genic; OR > 10 | 1327 |
| 19 | 14906155 | 14912127 | 5972 | loss | 2383 | | 11.33 | Non-genic; OR > 10 | 1328 |
| 7 | 107157268 | 107167915 | 10647 | loss | 2339 | | 10.95 | Non-genic; OR > 10 | 1329 |
| 7 | 107157268 | 107167915 | 10647 | loss | 2356 | | 10.95 | Non-genic; OR > 10 | 1329 |
| 7 | 107157268 | 107167915 | 10647 | loss | 2376 | | 10.95 | Non-genic; OR > 10 | 1329 |
| 7 | 107157268 | 107167915 | 10647 | loss | 2387 | | 10.95 | Non-genic; OR > 10 | 1329 |
| 7 | 107157268 | 107167915 | 10647 | loss | 2427 | | 10.95 | Non-genic; OR > 10 | 1329 |
| 7 | 107157268 | 107167915 | 10647 | loss | 2434 | | 10.95 | Non-genic; OR > 10 | 1329 |
| 7 | 107157268 | 107167915 | 10647 | loss | 2450 | | 10.95 | Non-genic; OR | 1329 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | 7 | | | | | > 10 | |
| 7 | 107157268 | 107167915 | 10647 | loss | 2477 | | 10.95 | Non-genic; OR > 10 | 1329 |
| 7 | 107157268 | 107167915 | 10647 | loss | 2509 | | 10.95 | Non-genic; OR > 10 | 1329 |
| 7 | 107157268 | 107167915 | 10647 | loss | 2550 | | 10.95 | Non-genic; OR > 10 | 1329 |
| 12 | 63383870 | 63385104 | 1234 | loss | 2219 | | 10.84 | Non-genic; OR > 10 | 1330 |
| 12 | 63383870 | 63385104 | 1234 | loss | 2260 | | 10.84 | Non-genic; OR > 10 | 1330 |
| 12 | 63383870 | 63385104 | 1234 | loss | 2591 | | 10.84 | Non-genic; OR > 10 | 1330 |
| 7 | 127716510 | 127717893 | 1383 | loss | 2626 | | 10.84 | Non-genic; OR > 10 | 1331 |
| 7 | 27467540 | 27469640 | 2100 | loss | 2359 | | 10.84 | Non-genic; OR > 10 | 1332 |
| 7 | 27467540 | 27469640 | 2100 | gain | 2453 | | 10.84 | Non-genic; OR > 10 | 1332 |
| 7 | 27467540 | 27469640 | 2100 | gain | 2509 | | 10.84 | Non-genic; OR > 10 | 1332 |
| 7 | 27467540 | 27469640 | 2100 | gain | 2527 | | 10.84 | Non-genic; OR > 10 | 1332 |
| 7 | 27467540 | 27469640 | 2100 | loss | 2612 | | 10.84 | Non-genic; OR > 10 | 1332 |
| 2 | 9773325 | 9776315 | 2990 | loss | 2176 | | 10.84 | Non-genic; OR > 10 | 1333 |
| 2 | 9773325 | 9776315 | 2990 | loss | 2188 | | 10.84 | Non-genic; OR | 1333 |

| Chr | Original CNV Start | Original CNV Stop | Original CNV Size | CNV Type | PD Case ID(s) | RefSeq Gene Symbol(s) | OR | Category | SEQ_ID |
|---|---|---|---|---|---|---|---|---|---|
| | | | | | | | | > 10 | |
| 2 | 9773325 | 9776315 | 2990 | loss | 2214 | | 10.84 | Non-genic; OR > 10 | 1333 |
| 2 | 9773325 | 9776315 | 2990 | loss | 2474 | | 10.84 | Non-genic; OR > 10 | 1333 |
| 2 | 9773325 | 9776315 | 2990 | loss | 2500 | | 10.84 | Non-genic; OR > 10 | 1333 |
| 3 | 2003576 | 2006650 | 3074 | gain | 2594 | | 10.84 | Non-genic; OR > 10 | 1334 |
| 12 | 63383870 | 63387188 | 3318 | loss | 2185 | | 10.84 | Non-genic; OR > 10 | 1335 |
| 12 | 63383870 | 63387188 | 3318 | loss | 2439 | | 10.84 | Non-genic; OR > 10 | 1335 |
| 3 | 2003576 | 2010018 | 6442 | gain | 2295 | | 10.84 | Non-genic; OR > 10 | 1336 |
| 3 | 2003576 | 2010018 | 6442 | gain | 2355 | | 10.84 | Non-genic; OR > 10 | 1336 |
| 3 | 2003576 | 2010018 | 6442 | gain | 2360 | | 10.84 | Non-genic; OR > 10 | 1336 |
| 7 | 127716510 | 127725845 | 9335 | loss | 2350 | | 10.84 | Non-genic; OR > 10 | 1337 |
| 7 | 127716510 | 127725845 | 9335 | loss | 2541 | | 10.84 | Non-genic; OR > 10 | 1337 |
| 7 | 127716510 | 127725845 | 9335 | loss | 2559 | | 10.84 | Non-genic; OR > 10 | 1337 |
| 6 | 120674750 | 120685941 | 11191 | loss | 2286 | | 10.84 | Non-genic; OR > 10 | 1338 |
| 6 | 120674750 | 120685941 | 11191 | loss | 2445 | | 10.84 | Non-genic; OR | 1338 |

Figure 8B (Continued)

| Figure 8B | | | | | | | | |
|---|---|---|---|---|---|---|---|---|
| Chr | Original CNV Start | Original CNV Stop | Original CNV Size | CNV Type | PD Case ID(s) | RefSeq Gene Symbol(s) | OR | Category | SEQ_ID |
| | | | 1 | | | | | > 10 | |
| 6 | 120674750 | 120685941 | 11191 | loss | 2461 | | 10.84 | Non-genic; OR > 10 | 1338 |
| 6 | 120674750 | 120685941 | 11191 | loss | 2559 | | 10.84 | Non-genic; OR > 10 | 1338 |
| 6 | 120674750 | 120685941 | 11191 | loss | 2571 | | 10.84 | Non-genic; OR > 10 | 1338 |
| 7 | 127716510 | 127733938 | 17428 | gain | 2193 | | 10.84 | Non-genic; OR > 10 | 1339 |
| 3 | 1329332 | 2206357 | 877025 | gain | 2386 | | 10.84 | Non-genic; OR > 10 | 1340 |

Figure 8B (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 10 | 117224281 | 117232646 | 8365 | gain | 1004 | ATRNL1 | N | 1621 |
| 10 | 117224281 | 117232646 | 8365 | gain | 1010 | ATRNL1 | N | 1621 |
| 10 | 117331013 | 117339297 | 8284 | loss | 2337 | ATRNL1 | N | 1622 |
| 10 | 117331013 | 117339297 | 8284 | loss | 2614 | ATRNL1 | N | 1622 |
| 10 | 117338366 | 117339297 | 931 | loss | 2294 | ATRNL1 | N | 1623 |
| 10 | 117338366 | 117339297 | 931 | loss | 2332 | ATRNL1 | N | 1623 |
| 10 | 117338366 | 117339297 | 931 | loss | 2404 | ATRNL1 | N | 1623 |
| 10 | 117338366 | 117339297 | 931 | loss | 2405 | ATRNL1 | N | 1623 |
| 10 | 117338366 | 117339297 | 931 | loss | 2447 | ATRNL1 | N | 1623 |
| 10 | 117338366 | 117339297 | 931 | loss | 2481 | ATRNL1 | N | 1623 |
| 10 | 117338366 | 117339297 | 931 | loss | 2610 | ATRNL1 | N | 1623 |
| 10 | 117338366 | 117339297 | 931 | loss | 2628 | ATRNL1 | N | 1623 |
| 7 | 146842506 | 146844392 | 1886 | gain | 2306 | CNTNAP2 | N | 1624 |
| 7 | 146842506 | 146844392 | 1886 | gain | 2408 | CNTNAP2 | N | 1624 |
| 7 | 146842506 | 146844392 | 1886 | gain | 2608 | CNTNAP2 | N | 1624 |
| 7 | 147697712 | 147710037 | 12325 | gain | 1017 | CNTNAP2 | N | 1625 |
| 7 | 147704200 | 147710037 | 5837 | gain | 1018 | CNTNAP2 | N | 1626 |
| 7 | 147707161 | 147710037 | 2876 | gain | 994 | CNTNAP2 | N | 1627 |
| 7 | 147441927 | 147443119 | 1192 | loss | 2266 | MIR548T,CNTNAP2 | N | 1628 |
| 7 | 147441927 | 147443119 | 1192 | loss | 2269 | MIR548T,CNTNAP2 | N | 1628 |
| 7 | 147441927 | 147443119 | 1192 | loss | 2320 | MIR548T,CNTNAP2 | N | 1628 |
| 7 | 147441927 | 147443119 | 1192 | loss | 2436 | MIR548T,CNTNAP2 | N | 1628 |
| 7 | 147441927 | 147443119 | 1192 | loss | 2443 | MIR548T,CNTNAP2 | N | 1628 |
| 7 | 147441927 | 147443119 | 1192 | loss | 2565 | MIR548T,CNTNAP2 | N | 1628 |
| 7 | 147441927 | 147443119 | 1192 | loss | 2593 | MIR548T,CNTNAP2 | N | 1628 |
| 2 | 112750646 | 112764889 | 14243 | loss | 996 | ZC3H6 | N | 1629 |
| 2 | 112750646 | 112764889 | 14243 | loss | 1022 | ZC3H6 | N | 1629 |
| 2 | 112750646 | 112764889 | 14243 | loss | 2327 | ZC3H6 | N | 1629 |
| 2 | 112750646 | 112764889 | 14243 | gain | 2515 | ZC3H6 | N | 1629 |
| 2 | 112752277 | 112764889 | 12612 | loss | 2342 | ZC3H6 | N | 1630 |
| 2 | 112752277 | 112764889 | 12612 | loss | 2360 | ZC3H6 | N | 1630 |
| 2 | 112752277 | 112764889 | 12612 | loss | 2426 | ZC3H6 | N | 1630 |
| 2 | 112752277 | 112764889 | 12612 | loss | 2587 | ZC3H6 | N | 1630 |
| 18 | 48127523 | 48131320 | 3797 | loss | 999 | DCC | N | 1631 |
| 18 | 48539033 | 48541815 | 2782 | gain | 1013 | DCC | N | 1632 |

Figure 8C

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 18 | 48616189 | 48620934 | 4745 | loss | 2054 | DCC | N | 1633 |
| 18 | 48616189 | 48620934 | 4745 | loss | 2265 | DCC | N | 1633 |
| 18 | 48616189 | 48620934 | 4745 | loss | 2412 | DCC | N | 1633 |
| 18 | 48616189 | 48620934 | 4745 | loss | 2428 | DCC | N | 1633 |
| 18 | 48616189 | 48620934 | 4745 | loss | 2615 | DCC | N | 1633 |
| 20 | 20043913 | 20061778 | 17865 | gain | 947 | C20orf26 | N | 1634 |
| 20 | 20043913 | 20061778 | 17865 | gain | 960 | C20orf26 | N | 1634 |
| 20 | 20043913 | 20061717 | 17804 | gain | 964 | C20orf26 | N | 1635 |
| 20 | 19971492 | 19982732 | 11240 | gain | 2190 | C20orf26,CRNKL1 | Y | 1636 |
| 20 | 19971492 | 19982732 | 11240 | gain | 2474 | C20orf26,CRNKL1 | Y | 1636 |
| 20 | 19971492 | 19982732 | 11240 | gain | 2489 | C20orf26,CRNKL1 | Y | 1636 |
| 20 | 19971492 | 19982732 | 11240 | gain | 2190 | C20orf26,CRNKL1 | Y | 1636 |
| 20 | 19971492 | 19982732 | 11240 | gain | 2474 | C20orf26,CRNKL1 | Y | 1636 |
| 20 | 19971492 | 19982732 | 11240 | gain | 2489 | C20orf26,CRNKL1 | Y | 1636 |
| 20 | 19979618 | 19981548 | 1930 | loss | 2597 | C20orf26,CRNKL1 | Y | 1637 |
| 3 | 193371224 | 193374127 | 2903 | gain | 1016 | FGF12 | N | 1638 |
| 3 | 193472185 | 193478807 | 6622 | gain | 2053 | FGF12 | N | 1639 |
| 3 | 193472185 | 193478807 | 6622 | gain | 2418 | FGF12 | N | 1639 |
| 3 | 193472185 | 193478807 | 6622 | gain | 2427 | FGF12 | N | 1639 |
| 3 | 193472185 | 193478807 | 6622 | gain | 2450 | FGF12 | N | 1639 |
| 3 | 193678496 | 193680012 | 1516 | loss | 1029 | FGF12 | N | 1640 |
| 3 | 193785530 | 193794411 | 8881 | gain | 1030 | FGF12 | N | 1641 |
| 3 | 193787655 | 193797190 | 9535 | gain | 947 | FGF12 | N | 1642 |
| 3 | 193787655 | 193797190 | 9535 | gain | 959 | FGF12 | N | 1642 |
| 5 | 44280749 | 44389035 | 108286 | gain | 966 | FGF10 | Y | 1643 |
| 1 | 74271266 | 74334696 | 63430 | loss | 2544 | LRRIQ3 | Y | 1644 |
| 1 | 74359462 | 74372201 | 12739 | gain | 2222 | LRRIQ3 | N | 1645 |
| 1 | 74361348 | 74372201 | 10853 | loss | 968 | LRRIQ3 | N | 1646 |
| 1 | 74361348 | 74372201 | 10853 | loss | 1010 | LRRIQ3 | N | 1646 |
| 1 | 74361348 | 74372201 | 10853 | loss | 1029 | LRRIQ3 | N | 1646 |
| 1 | 74421868 | 74434506 | 12638 | gain | 2539 | LRRIQ3 | Y | 1647 |
| 1 | 74421868 | 74434506 | 12638 | gain | 2610 | LRRIQ3 | Y | 1647 |
| 3 | 198119175 | 198124199 | 5024 | gain | 2322 | SENP5 | N | 1648 |
| 3 | 198119175 | 198124199 | 5024 | gain | 2345 | SENP5 | N | 1648 |
| 3 | 198119175 | 198124199 | 5024 | gain | 2366 | SENP5 | N | 1648 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 3 | 198119175 | 198124199 | 5024 | gain | 2427 | SENP5 | N | 1648 |
| 3 | 198027242 | 198132696 | 105454 | loss | 948 | SENP5,PAK2 | Y | 1649 |
| 3 | 198027242 | 198132696 | 105454 | loss | 950 | SENP5,PAK2 | Y | 1649 |
| 3 | 198027242 | 198132696 | 105454 | loss | 1020 | SENP5,PAK2 | Y | 1649 |
| 3 | 198027242 | 198132696 | 105454 | loss | 1034 | SENP5,PAK2 | Y | 1649 |
| 3 | 198036999 | 198125625 | 88626 | loss | 951 | SENP5,PAK2 | Y | 1650 |
| 3 | 30711659 | 30807514 | 95855 | gain | 2613 | GADL1 | Y | 1651 |
| 3 | 30711659 | 30807514 | 95855 | gain | 2613 | GADL1 | Y | 1651 |
| 3 | 30711659 | 30807514 | 95855 | gain | 2613 | GADL1 | Y | 1651 |
| 3 | 30739769 | 30751038 | 11269 | loss | 1017 | GADL1 | Y | 1652 |
| 3 | 30739769 | 30748426 | 8657 | loss | 1025 | GADL1 | Y | 1653 |
| 3 | 30743173 | 30748426 | 5253 | loss | 978 | GADL1 | Y | 1654 |
| 3 | 30768468 | 30770607 | 2139 | gain | 2577 | GADL1 | N | 1655 |
| 3 | 30845814 | 30896445 | 50631 | loss | 2603 | GADL1 | Y | 1656 |
| 12 | 85111072 | 85124672 | 13600 | gain | 2261 | MGAT4C | N | 1657 |
| 12 | 85111072 | 85124672 | 13600 | gain | 2425 | MGAT4C | N | 1657 |
| 12 | 85113258 | 85124672 | 11414 | gain | 2338 | MGAT4C | N | 1658 |
| 12 | 85411806 | 85413202 | 1396 | gain | 1027 | MGAT4C | N | 1659 |
| 12 | 85544596 | 85550905 | 6309 | gain | 976 | MGAT4C | N | 1660 |
| 12 | 85544596 | 85550905 | 6309 | gain | 978 | MGAT4C | N | 1660 |
| 12 | 85681656 | 85687967 | 6311 | loss | 948 | MGAT4C | N | 1661 |
| 12 | 85681656 | 85687967 | 6311 | gain | 971 | MGAT4C | N | 1661 |
| 12 | 85681656 | 85687967 | 6311 | loss | 989 | MGAT4C | N | 1661 |
| 2 | 198497294 | 198505239 | 7945 | loss | 2190 | PLCL1 | N | 1662 |
| 2 | 198497294 | 198505239 | 7945 | loss | 2298 | PLCL1 | N | 1662 |
| 2 | 198497294 | 198505239 | 7945 | loss | 2575 | PLCL1 | N | 1662 |
| 6 | 151310683 | 151318805 | 8122 | gain | 992 | MTHFD1L | Y | 1663 |
| 6 | 151310683 | 151318805 | 8122 | gain | 992 | MTHFD1L | Y | 1663 |
| 6 | 151312868 | 151318805 | 5937 | gain | 1013 | MTHFD1L | Y | 1664 |
| 6 | 151312868 | 151320671 | 7803 | gain | 2342 | MTHFD1L | Y | 1665 |
| 6 | 151312868 | 151317012 | 4144 | gain | 2583 | MTHFD1L | N | 1666 |
| 6 | 151312868 | 151317012 | 4144 | gain | 2631 | MTHFD1L | N | 1666 |
| 6 | 18532373 | 18537857 | 5484 | gain | 2372 | RNF144B | Y | 1667 |
| 6 | 18532373 | 18537857 | 5484 | gain | 2620 | RNF144B | Y | 1667 |
| 6 | 18532373 | 18537857 | 5484 | gain | 2629 | RNF144B | Y | 1667 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 6 | 18574467 | 18576632 | 2165 | loss | 1024 | RNF144B | Y | 1668 |
| 5 | 127434789 | 127443917 | 9128 | gain | 1029 | FLJ33630 | N | 1669 |
| 5 | 127434789 | 127436376 | 1587 | gain | 2315 | FLJ33630 | N | 1670 |
| 5 | 127434789 | 127436376 | 1587 | gain | 2350 | FLJ33630 | N | 1670 |
| 5 | 127434789 | 127436376 | 1587 | gain | 2563 | FLJ33630 | N | 1670 |
| 5 | 127436376 | 127439603 | 3227 | gain | 990 | FLJ33630 | N | 1671 |
| 7 | 153645525 | 153647352 | 1827 | loss | 2050 | DPP6 | N | 1672 |
| 7 | 153645525 | 153647352 | 1827 | loss | 2461 | DPP6 | N | 1672 |
| 7 | 153645525 | 153647352 | 1827 | loss | 2521 | DPP6 | N | 1672 |
| 7 | 153901057 | 154002117 | 101060 | loss | 957 | DPP6 | N | 1673 |
| 7 | 154028650 | 154032130 | 3480 | loss | 969 | DPP6 | N | 1674 |
| 7 | 154028650 | 154032130 | 3480 | loss | 993 | DPP6 | N | 1674 |
| 7 | 154028650 | 154032130 | 3480 | gain | 1031 | DPP6 | N | 1674 |
| 12 | 55879318 | 55922237 | 42919 | gain | 961 | NDUFA4L2,LRP1,SHMT2,NXPH4 | Y | 1675 |
| 12 | 55879318 | 55922237 | 42919 | gain | 984 | NDUFA4L2,LRP1,SHMT2,NXPH4 | Y | 1675 |
| 12 | 55880398 | 55922237 | 41839 | gain | 967 | NDUFA4L2,LRP1,SHMT2,NXPH4 | Y | 1676 |
| 12 | 130944468 | 130946248 | 1780 | loss | 995 | ULK1 | Y | 1677 |
| 12 | 130944468 | 130946248 | 1780 | loss | 998 | ULK1 | Y | 1677 |
| 12 | 130944468 | 130946248 | 1780 | gain | 1005 | ULK1 | Y | 1677 |
| 12 | 130944468 | 130946248 | 1780 | loss | 1009 | ULK1 | Y | 1677 |
| 12 | 130944468 | 130946248 | 1780 | loss | 1031 | ULK1 | Y | 1677 |
| 12 | 130944468 | 130946248 | 1780 | gain | 1033 | ULK1 | Y | 1677 |
| 12 | 130944468 | 130946248 | 1780 | gain | 1035 | ULK1 | Y | 1677 |
| 22 | 22721042 | 22735036 | 13994 | loss | 955 | GSTTP2 | Y | 1678 |
| 22 | 22721042 | 22735036 | 13994 | loss | 959 | GSTTP2 | Y | 1678 |
| 22 | 22721042 | 22735036 | 13994 | loss | 960 | GSTTP2 | Y | 1678 |
| 22 | 22721042 | 22735036 | 13994 | loss | 964 | GSTTP2 | Y | 1678 |
| 19 | 61081628 | 61083208 | 1580 | gain | 962 | NLRP4 | Y | 1679 |
| 19 | 61081628 | 61083208 | 1580 | gain | 963 | NLRP4 | Y | 1679 |
| 19 | 61081628 | 61083208 | 1580 | gain | 964 | NLRP4 | Y | 1679 |
| 19 | 61081628 | 61083208 | 1580 | gain | 1003 | NLRP4 | Y | 1679 |
| 19 | 61081628 | 61083208 | 1580 | gain | 1013 | NLRP4 | Y | 1679 |
| 19 | 61081628 | 61083208 | 1580 | gain | 1037 | NLRP4 | Y | 1679 |
| 19 | 60132603 | 60136910 | 4307 | loss | 1025 | NLRP7 | Y | 1680 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 15 | 99236636 | 99239178 | 2542 | loss | 1014 | ALDH1A3 | Y | 1681 |
| 15 | 99236636 | 99239178 | 2542 | loss | 1029 | ALDH1A3 | Y | 1681 |
| 18 | 65911512 | 65923901 | 12389 | gain | 955 | RTTN | N | 1682 |
| 18 | 65911512 | 65923901 | 12389 | gain | 964 | RTTN | N | 1682 |
| 18 | 65911512 | 65915539 | 4027 | loss | 1017 | RTTN | N | 1683 |
| 18 | 65916736 | 65938721 | 21985 | loss | 1028 | RTTN | Y | 1684 |
| 16 | 6597826 | 6632582 | 34756 | gain | 1014 | RBFOX1 | N | 1685 |
| 16 | 6810852 | 6907294 | 96442 | loss | 982 | RBFOX1 | N | 1686 |
| 10 | 5979772 | 5995714 | 15942 | gain | 1030 | FBXO18 | Y | 1687 |
| 10 | 5984217 | 5995714 | 11497 | gain | 1037 | FBXO18 | Y | 1688 |
| 10 | 5985730 | 5988631 | 2901 | gain | 1000 | FBXO18 | Y | 1689 |
| 5 | 171229766 | 171231310 | 1544 | loss | 967 | FBXW11 | Y | 1690 |
| 5 | 171335918 | 171339127 | 3209 | gain | 971 | FBXW11 | N | 1691 |
| 3 | 55514618 | 55517737 | 3119 | loss | 969 | ERC2 | Y | 1692 |
| 3 | 55514618 | 55517737 | 3119 | loss | 999 | ERC2 | Y | 1692 |
| 3 | 55514618 | 55517737 | 3119 | loss | 1005 | ERC2 | Y | 1692 |
| X | 150893705 | 150894325 | 620 | loss | 981 | GABRE | Y | 1693 |
| X | 150893705 | 150894325 | 620 | loss | 1016 | GABRE | Y | 1693 |
| 15 | 87999026 | 88001610 | 2584 | gain | 954 | KIF7 | Y | 1694 |
| 15 | 87999026 | 88000020 | 994 | gain | 994 | KIF7 | Y | 1695 |
| 14 | 104688404 | 104688435 | 31 | gain | 970 | JAG2 | Y | 1696 |
| 14 | 104688404 | 104688435 | 31 | gain | 980 | JAG2 | Y | 1696 |
| 14 | 104688404 | 104688435 | 31 | gain | 995 | JAG2 | Y | 1696 |
| 14 | 104688404 | 104688435 | 31 | gain | 999 | JAG2 | Y | 1696 |
| 14 | 104688404 | 104688435 | 31 | gain | 1013 | JAG2 | Y | 1696 |
| 14 | 104688404 | 104688435 | 31 | gain | 1035 | JAG2 | Y | 1696 |
| 1 | 204483717 | 204637883 | 154166 | loss | 988 | CTSE,SRGAP2 | Y | 1697 |
| 1 | 204483717 | 204637883 | 154166 | loss | 990 | CTSE,SRGAP2 | Y | 1697 |
| 3 | 199030475 | 199192026 | 161551 | loss | 967 | LMLN,IQCG,RPL35A,LRCH3 | Y | 1698 |
| 3 | 199032255 | 199188547 | 156292 | loss | 948 | LMLN,IQCG,RPL35A,LRCH3 | Y | 1699 |
| 3 | 199032255 | 199188547 | 156292 | loss | 1007 | LMLN,IQCG,RPL35A,LRCH3 | Y | 1699 |
| 3 | 199032255 | 199188547 | 156292 | loss | 1011 | LMLN,IQCG,RPL35A,LRCH3 | Y | 1699 |
| 3 | 199033913 | 199188547 | 154634 | loss | 1031 | LMLN,IQCG,RPL35A,LRCH3 | Y | 1700 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 3 | 199038163 | 199188547 | 150384 | loss | 970 | LMLN,IQCG,RPL35A,LRCH3 | Y | 1701 |
| 3 | 199038163 | 199187361 | 149198 | loss | 1034 | LMLN,IQCG,RPL35A,LRCH3 | Y | 1702 |
| 3 | 199040318 | 199188547 | 148229 | loss | 952 | LMLN,IQCG,RPL35A,LRCH3 | Y | 1703 |
| 3 | 199043844 | 199188547 | 144703 | loss | 974 | LMLN,IQCG,RPL35A,LRCH3 | Y | 1704 |
| 4 | 103960184 | 103968003 | 7819 | loss | 989 | UBE2D3 | Y | 1705 |
| 10 | 95534054 | 95536083 | 2029 | loss | 952 | LGI1 | N | 1706 |
| 10 | 95534054 | 95536083 | 2029 | loss | 961 | LGI1 | N | 1706 |
| 10 | 95534054 | 95536083 | 2029 | loss | 968 | LGI1 | N | 1706 |
| 12 | 55879318 | 55902123 | 22805 | gain | 1030 | LRP1,NXPH4 | Y | 1707 |
| 12 | 55880398 | 55902123 | 21725 | gain | 997 | LRP1,NXPH4 | Y | 1708 |
| 10 | 5965889 | 5995714 | 29825 | gain | 992 | ANKRD16,FBXO18 | Y | 1709 |
| 8 | 31639124 | 31642682 | 3558 | loss | 1029 | NRG1 | N | 1710 |
| 8 | 31811829 | 31815721 | 3892 | loss | 1034 | NRG1 | N | 1711 |
| 8 | 31814234 | 31815721 | 1487 | loss | 1017 | NRG1 | N | 1712 |
| 8 | 32551972 | 32553445 | 1473 | loss | 1029 | NRG1 | N | 1713 |
| 10 | 84165642 | 84171045 | 5403 | gain | 988 | NRG3 | N | 1714 |
| 10 | 84188750 | 84190301 | 1551 | gain | 977 | NRG3 | N | 1715 |
| 12 | 5390135 | 5414622 | 24487 | loss | 1026 | NTF3 | Y | 1716 |
| 12 | 5401060 | 5417862 | 16802 | loss | 1019 | NTF3 | Y | 1717 |
| 4 | 103310758 | 104753531 | 1442773 | gain | 965 | CISD2,MANBA,TACR3,CENPE,UBE2D3,SLC39A8,SLC9B1,NFKB1,SLC9B2,BDH2 | Y | 1718 |
| 4 | 103310758 | 104753531 | 1442773 | gain | 965 | CISD2,MANBA,TACR3,CENPE,UBE2D3,SLC39A8,SLC9B1,NFKB1,SLC9B2,BDH2 | Y | 1718 |
| 7 | 141413352 | 141442231 | 28879 | gain | 999 | MGAM | Y | 1719 |
| 7 | 141413352 | 141442231 | 28879 | gain | 1030 | MGAM | Y | 1719 |
| 5 | 140201609 | 140219465 | 17856 | loss | 1024 | PCDHA2,PCDHA3,PCDHA1,PCDHA6,PCDHA7,PCDHA4,PCDHA5,PCDHA8,PCDHA9,PCDHA10 | Y | 1720 |
| 5 | 140203440 | 140219465 | 16025 | loss | 1004 | PCDHA2,PCDHA3, | Y | 1721 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| | | | | | | PCDHA1,PCDHA6, PCDHA7,PCDHA4, PCDHA5,PCDHA8, PCDHA9,PCDHA10 | | |
| 5 | 140203440 | 140219465 | 16025 | loss | 1034 | PCDHA2,PCDHA3, PCDHA1,PCDHA6, PCDHA7,PCDHA4, PCDHA5,PCDHA8, PCDHA9,PCDHA10 | Y | 1721 |
| 22 | 42895171 | 42898071 | 2900 | gain | 992 | PARVB | Y | 1722 |
| 22 | 42895171 | 42898071 | 2900 | gain | 993 | PARVB | Y | 1722 |
| 22 | 42895171 | 42898071 | 2900 | gain | 1013 | PARVB | Y | 1722 |
| 12 | 15557675 | 15560873 | 3198 | loss | 990 | PTPRO | Y | 1723 |
| 12 | 15557675 | 15559369 | 1694 | loss | 991 | PTPRO | N | 1724 |
| 12 | 15557675 | 15560873 | 3198 | loss | 1011 | PTPRO | Y | 1723 |
| 1 | 108535814 | 108543860 | 8046 | loss | 959 | SLC25A24 | Y | 1725 |
| 1 | 108535814 | 108543860 | 8046 | loss | 1029 | SLC25A24 | Y | 1725 |
| 14 | 60544757 | 60553070 | 8313 | loss | 991 | SLC38A6 | Y | 1726 |
| 14 | 60544757 | 60553070 | 8313 | loss | 1034 | SLC38A6 | Y | 1726 |
| 14 | 60551981 | 60553070 | 1089 | gain | 951 | SLC38A6 | Y | 1727 |
| 14 | 60551981 | 60553070 | 1089 | loss | 954 | SLC38A6 | Y | 1727 |
| 14 | 60551981 | 60553070 | 1089 | loss | 1014 | SLC38A6 | Y | 1727 |
| 14 | 60551981 | 60553070 | 1089 | loss | 1019 | SLC38A6 | Y | 1727 |
| 4 | 47314693 | 47323346 | 8653 | loss | 1033 | CORIN | Y | 1728 |
| 4 | 47361851 | 47362999 | 1148 | gain | 978 | CORIN | Y | 1729 |
| 12 | 31132716 | 31298659 | 165943 | gain | 975 | DDX11 | Y | 1730 |
| 12 | 31132716 | 31237505 | 104789 | gain | 990 | DDX11 | Y | 1731 |
| 12 | 31132716 | 31237505 | 104789 | gain | 1004 | DDX11 | Y | 1731 |
| 12 | 31084265 | 31242528 | 158263 | gain | 977 | DDX11-AS1,DDX11 | Y | 1732 |
| 12 | 31098259 | 31237505 | 139246 | gain | 966 | DDX11-AS1,DDX11 | Y | 1733 |
| 12 | 31098259 | 31242528 | 144269 | gain | 992 | DDX11-AS1,DDX11 | Y | 1734 |
| 12 | 31098259 | 31237505 | 139246 | gain | 1011 | DDX11-AS1,DDX11 | Y | 1733 |
| 12 | 31098259 | 31237505 | 139246 | gain | 1031 | DDX11-AS1,DDX11 | Y | 1733 |
| 1 | 194977713 | 195065867 | 88154 | loss | 1028 | CFHR3,CFHR1,CFH | Y | 1735 |
| 1 | 194978218 | 195065867 | 87649 | loss | 961 | CFHR3,CFHR1,CFH | Y | 1736 |
| 1 | 194978218 | 195065867 | 87649 | loss | 990 | CFHR3,CFHR1,CFH | Y | 1736 |
| 1 | 194978218 | 195065867 | 87649 | loss | 996 | CFHR3,CFHR1,CFH | Y | 1736 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 1 | 194977713 | 195127881 | 150168 | loss | 1001 | CFHR3,CFHR1,CFHR4,CFH | Y | 1737 |
| 18 | 42831086 | 42836022 | 4936 | gain | 947 | KATNAL2 | Y | 1738 |
| 18 | 42831086 | 42836022 | 4936 | gain | 953 | KATNAL2 | Y | 1738 |
| 18 | 42831086 | 42836022 | 4936 | gain | 971 | KATNAL2 | Y | 1738 |
| 18 | 42831086 | 42836022 | 4936 | gain | 988 | KATNAL2 | Y | 1738 |
| 18 | 42831086 | 42836022 | 4936 | gain | 1006 | KATNAL2 | Y | 1738 |
| 19 | 54252049 | 54268744 | 16695 | loss | 992 | KCNA7,NTF4 | Y | 1739 |
| 4 | 57739809 | 57789510 | 49701 | loss | 976 | LOC255130 | Y | 1740 |
| 4 | 57739809 | 57789510 | 49701 | loss | 986 | LOC255130 | Y | 1740 |
| 4 | 57739809 | 57789510 | 49701 | loss | 1029 | LOC255130 | Y | 1740 |
| 4 | 57742531 | 57789510 | 46979 | loss | 951 | LOC255130 | Y | 1741 |
| 4 | 57742531 | 57783444 | 40913 | loss | 1019 | LOC255130 | Y | 1742 |
| 7 | 151726377 | 151747905 | 21528 | loss | 967 | MLL3 | N | 1743 |
| 7 | 151726377 | 151743145 | 16768 | loss | 995 | MLL3 | N | 1744 |
| 7 | 151726377 | 151743145 | 16768 | loss | 1002 | MLL3 | N | 1744 |
| 7 | 151726377 | 151743145 | 16768 | loss | 1019 | MLL3 | N | 1744 |
| 7 | 151728811 | 151743145 | 14334 | loss | 950 | MLL3 | N | 1745 |
| 7 | 151465378 | 151895559 | 430181 | gain | 958 | MLL3,FABP5P3,LOC100128822 | Y | 1746 |
| 18 | 31204187 | 31210105 | 5918 | gain | 947 | ZNF396 | Y | 1747 |
| 18 | 31204187 | 31210105 | 5918 | gain | 953 | ZNF396 | Y | 1747 |
| 18 | 31204187 | 31210105 | 5918 | gain | 958 | ZNF396 | Y | 1747 |
| 18 | 31204187 | 31210105 | 5918 | gain | 959 | ZNF396 | Y | 1747 |
| 18 | 31204187 | 31210105 | 5918 | gain | 973 | ZNF396 | Y | 1747 |
| 17 | 6399283 | 6401166 | 1883 | loss | 978 | PITPNM3 | Y | 1748 |
| 17 | 6399283 | 6401166 | 1883 | gain | 992 | PITPNM3 | Y | 1748 |
| 17 | 6399283 | 6401166 | 1883 | gain | 1013 | PITPNM3 | Y | 1748 |
| 17 | 6399283 | 6401166 | 1883 | gain | 1017 | PITPNM3 | Y | 1748 |
| 17 | 62868652 | 62873107 | 4455 | loss | 1009 | PITPNC1 | N | 1749 |
| 17 | 62869966 | 62877923 | 7957 | loss | 1007 | PITPNC1 | N | 1750 |
| 1 | 103899771 | 104012520 | 112749 | loss | 1003 | ACTG1P4,AMY2A,AMY2B,AMY1A,AMY1C,AMY1B | Y | 1751 |
| 1 | 103901454 | 104012520 | 111066 | loss | 1027 | ACTG1P4,AMY2A,AMY2B,AMY1A,AMY1C,AMY1B | Y | 1752 |
| 1 | 103839772 | 103904723 | 64951 | gain | 998 | AMY2B,RNPC3 | Y | 1753 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 5 | 126784243 | 126788155 | 3912 | loss | 1013 | MEGF10 | Y | 1754 |
| 5 | 126786974 | 126788155 | 1181 | loss | 986 | MEGF10 | N | 1755 |
| 5 | 126786974 | 126788155 | 1181 | loss | 1012 | MEGF10 | N | 1755 |
| 19 | 9134840 | 9144715 | 9875 | loss | 994 | ZNF317 | Y | 1756 |
| 19 | 9134840 | 9144715 | 9875 | loss | 1008 | ZNF317 | Y | 1756 |
| 19 | 9134840 | 9144715 | 9875 | loss | 1024 | ZNF317 | Y | 1756 |
| 8 | 94041443 | 94059962 | 18519 | loss | 1025 | TRIQK | Y | 1757 |
| 8 | 94043277 | 94045697 | 2420 | loss | 1018 | TRIQK | N | 1758 |
| 22 | 45468407 | 45474188 | 5781 | gain | 966 | CERK | Y | 1759 |
| 9 | 98831789 | 98831814 | 25 | gain | 999 | CTSL2 | Y | 1760 |
| 9 | 98831789 | 98831814 | 25 | gain | 1018 | CTSL2 | Y | 1760 |
| 10 | 88905200 | 89245881 | 340681 | gain | 969 | LOC439994,FAM22D,FAM22A,LOC728190,LOC728218,FAM35A | Y | 1761 |
| 10 | 88905200 | 89245881 | 340681 | gain | 999 | LOC439994,FAM22D,FAM22A,LOC728190,LOC728218,FAM35A | Y | 1761 |
| 6 | 160246670 | 160248266 | 1596 | loss | 986 | MAS1 | Y | 1762 |
| 6 | 160246670 | 160248266 | 1596 | loss | 1031 | MAS1 | Y | 1762 |
| 13 | 102137609 | 102142982 | 5373 | loss | 997 | METTL21C | Y | 1763 |
| 13 | 102139658 | 102142982 | 3324 | loss | 1004 | METTL21C | Y | 1764 |
| 7 | 156485711 | 156495904 | 10193 | loss | 1014 | MNX1 | Y | 1765 |
| 7 | 156485711 | 156490484 | 4773 | loss | 1016 | MNX1 | Y | 1766 |
| 1 | 211022043 | 211027746 | 5703 | loss | 1001 | NSL1 | Y | 1767 |
| 1 | 211022043 | 211027746 | 5703 | loss | 1036 | NSL1 | Y | 1767 |
| 3 | 198177030 | 198187875 | 10845 | gain | 967 | PIGZ | Y | 1768 |
| 3 | 198177030 | 198187875 | 10845 | gain | 975 | PIGZ | Y | 1768 |
| 16 | 70561211 | 70562690 | 1479 | gain | 948 | PKD1L3 | Y | 1769 |
| 16 | 70561211 | 70562690 | 1479 | gain | 1033 | PKD1L3 | Y | 1769 |
| 8 | 37754788 | 37755937 | 1149 | gain | 946 | PROSC | Y | 1770 |
| 8 | 37754788 | 37755937 | 1149 | gain | 1007 | PROSC | Y | 1770 |
| 8 | 85403103 | 85404716 | 1613 | gain | 954 | RALYL | N | 1771 |
| 8 | 85418745 | 85431319 | 12574 | gain | 1037 | RALYL | Y | 1772 |
| 8 | 85420037 | 85431319 | 11282 | gain | 1024 | RALYL | Y | 1773 |
| 8 | 85422157 | 85431319 | 9162 | gain | 957 | RALYL | N | 1774 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 8 | 85422157 | 85431319 | 9162 | gain | 992 | RALYL | N | 1774 |
| 8 | 85422157 | 85431319 | 9162 | gain | 997 | RALYL | N | 1774 |
| 8 | 85422157 | 85431319 | 9162 | gain | 1000 | RALYL | N | 1774 |
| 8 | 85422157 | 85431319 | 9162 | gain | 1003 | RALYL | N | 1774 |
| 8 | 85422157 | 85431319 | 9162 | gain | 1028 | RALYL | N | 1774 |
| 8 | 85422157 | 85431319 | 9162 | gain | 1030 | RALYL | N | 1774 |
| 8 | 85839690 | 85842807 | 3117 | loss | 949 | RALYL | N | 1775 |
| 13 | 113791151 | 113792974 | 1823 | loss | 951 | RASA3 | Y | 1776 |
| 13 | 113791151 | 113792974 | 1823 | loss | 972 | RASA3 | Y | 1776 |
| 13 | 113791151 | 113792974 | 1823 | loss | 973 | RASA3 | Y | 1776 |
| 13 | 113791151 | 113792974 | 1823 | loss | 980 | RASA3 | Y | 1776 |
| 13 | 113791151 | 113794669 | 3518 | loss | 989 | RASA3 | Y | 1777 |
| 13 | 113791151 | 113794669 | 3518 | loss | 991 | RASA3 | Y | 1777 |
| 5 | 145597802 | 145602068 | 4266 | gain | 980 | RBM27 | N | 1778 |
| 5 | 145627474 | 145645004 | 17530 | gain | 950 | RBM27 | Y | 1779 |
| 5 | 145627474 | 145628667 | 1193 | loss | 1004 | RBM27 | Y | 1780 |
| 14 | 72597009 | 72603806 | 6797 | loss | 1007 | RBM25 | N | 1781 |
| 14 | 72597009 | 72603806 | 6797 | loss | 1025 | RBM25 | N | 1781 |
| 5 | 33493254 | 33494402 | 1148 | loss | 992 | TARS | Y | 1782 |
| 5 | 33493254 | 33494402 | 1148 | loss | 1013 | TARS | Y | 1782 |
| 6 | 133004187 | 133008146 | 3959 | loss | 1017 | TAAR1 | Y | 1783 |
| 13 | 51954511 | 51973943 | 19432 | loss | 1009 | TPTE2P3 | Y | 1784 |
| 13 | 51954511 | 51973943 | 19432 | loss | 1014 | TPTE2P3 | Y | 1784 |
| 14 | 102401445 | 102414214 | 12769 | loss | 997 | TRAF3 | Y | 1785 |
| 14 | 102406606 | 102409996 | 3390 | loss | 969 | TRAF3 | Y | 1786 |
| 3 | 115911311 | 115919955 | 8644 | loss | 1034 | ZBTB20 | Y | 1787 |
| 3 | 115911311 | 115919955 | 8644 | loss | 1036 | ZBTB20 | Y | 1787 |
| 13 | 113574877 | 113602677 | 27800 | loss | 1020 | FAM70B,GAS6-AS1,GAS6 | Y | 1788 |
| 13 | 113576560 | 113602677 | 26117 | loss | 1037 | FAM70B,GAS6-AS1,GAS6 | Y | 1789 |
| 2 | 54308895 | 54356768 | 47873 | gain | 983 | TSPYL6,ACYP2 | Y | 1790 |
| 7 | 133903992 | 133913921 | 9929 | loss | 983 | AKR1B15 | Y | 1791 |
| 7 | 133906667 | 133910372 | 3705 | loss | 1032 | AKR1B15 | Y | 1792 |
| 13 | 24166764 | 24232405 | 65641 | gain | 1002 | ATP12A | Y | 1793 |
| 7 | 43804939 | 43809287 | 4348 | gain | 1016 | BLVRA | Y | 1794 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 7 | 43807656 | 43810836 | 3180 | gain | 1004 | BLVRA | Y | 1795 |
| 16 | 84330410 | 84332684 | 2274 | loss | 1034 | C16orf74,MIR1910 | Y | 1796 |
| 16 | 84332684 | 84335524 | 2840 | loss | 999 | C16orf74,MIR1910 | Y | 1797 |
| 3 | 11705809 | 11869809 | 164000 | gain | 989 | TAMM41,VGLL4 | Y | 1798 |
| 1 | 85964576 | 85967615 | 3039 | gain | 948 | COL24A1 | Y | 1799 |
| 1 | 85964576 | 85967615 | 3039 | gain | 984 | COL24A1 | Y | 1799 |
| 1 | 85964576 | 85967615 | 3039 | gain | 991 | COL24A1 | Y | 1799 |
| 1 | 85964576 | 85967615 | 3039 | gain | 993 | COL24A1 | Y | 1799 |
| 1 | 85964576 | 85967615 | 3039 | gain | 994 | COL24A1 | Y | 1799 |
| 1 | 85964576 | 85967615 | 3039 | gain | 998 | COL24A1 | Y | 1799 |
| 1 | 85964576 | 85967615 | 3039 | gain | 1005 | COL24A1 | Y | 1799 |
| 1 | 85964576 | 85967615 | 3039 | loss | 1009 | COL24A1 | Y | 1799 |
| 1 | 85964576 | 85967615 | 3039 | gain | 1010 | COL24A1 | Y | 1799 |
| 1 | 85964576 | 85967615 | 3039 | gain | 1011 | COL24A1 | Y | 1799 |
| 1 | 85964576 | 85967615 | 3039 | gain | 1013 | COL24A1 | Y | 1799 |
| 1 | 85964576 | 85967615 | 3039 | gain | 1014 | COL24A1 | Y | 1799 |
| 1 | 85964576 | 85967615 | 3039 | gain | 1015 | COL24A1 | Y | 1799 |
| 1 | 85964576 | 85967615 | 3039 | gain | 1020 | COL24A1 | Y | 1799 |
| 5 | 150082708 | 150087911 | 5203 | gain | 964 | DCTN4 | Y | 1800 |
| 5 | 150084557 | 150086690 | 2133 | gain | 971 | DCTN4 | N | 1801 |
| 7 | 14179928 | 14185615 | 5687 | loss | 989 | DGKB | Y | 1802 |
| 7 | 14727426 | 14731583 | 4157 | gain | 977 | DGKB | N | 1803 |
| 11 | 84499641 | 84610167 | 110526 | loss | 1026 | DLG2 | Y | 1804 |
| 11 | 84972646 | 84980750 | 8104 | loss | 1003 | DLG2 | N | 1805 |
| 13 | 112811735 | 112813401 | 1666 | loss | 965 | F7 | Y | 1806 |
| 13 | 112811735 | 112813401 | 1666 | loss | 971 | F7 | Y | 1806 |
| 13 | 112811735 | 112813401 | 1666 | loss | 972 | F7 | Y | 1806 |
| 13 | 112811735 | 112813401 | 1666 | loss | 973 | F7 | Y | 1806 |
| 13 | 112811735 | 112813401 | 1666 | loss | 978 | F7 | Y | 1806 |
| 13 | 112811735 | 112813401 | 1666 | loss | 992 | F7 | Y | 1806 |
| 9 | 39048058 | 43599449 | 4551391 | loss | 980 | LOC653501,FAM95B1,KGFLP2,FAM75A1,FAM75A2,FAM75A3,FAM75A4,FAM75A5,FAM75A6,FAM75A7,FAM74A1,FAM74A3,LOC64292 | Y | 1807 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| | | | | | | 9,FOXD4L4,FOXD4L2,LOC286297,ZNF658B,ANKRD20A2,MGC21881,CNTNAP3,LOC643648,AQP7P3,ZNF658,ANKRD20A3 | | |
| 9 | 39062211 | 43599449 | 4537238 | loss | 982 | LOC653501,FAM95B1,KGFLP2,FAM75A1,FAM75A2,FAM75A3,FAM75A4,FAM75A5,FAM75A6,FAM75A7,FAM74A1,FAM74A3,LOC642929,FOXD4L4,FOXD4L2,LOC286297,ZNF658B,ANKRD20A2,MGC21881,CNTNAP3,LOC643648,AQP7P3,ZNF658,ANKRD20A3 | Y | 1808 |
| 9 | 38758232 | 44199401 | 5441169 | loss | 975 | LOC653501,FAM95B1,KGFLP2,FAM75A1,FAM75A2,FAM75A3,FAM75A4,FAM75A5,FAM75A6,FAM75A7,FAM74A1,FAM74A3,CNTNAP3B,LOC642929,FOXD4L4,FOXD4L2,LOC286297,ZNF658B,ANKRD20A2,MGC21881,CNTNAP3,LOC643648,AQP7P3,ZNF658,ANKRD20A3 | Y | 1809 |
| 9 | 39048058 | 43776365 | 4728307 | loss | 967 | LOC653501,FAM95B1,KGFLP2,FAM75A1,FAM75A2,FAM75A3,FAM75A4,FAM75A5,FAM75A6,FAM75A7,FAM74A1,FAM74A3,CNTNAP3B,LOC642929,FOXD4L4,FOXD4L2,LOC286297,ZNF658B,ANKRD20A2,MGC2 | Y | 1810 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| | | | | | | 1881,CNTNAP3,LOC643648,AQP7P3,ZNF658,ANKRD20A3 | | |
| 9 | 39048058 | 43626920 | 4578862 | loss | 992 | LOC653501,FAM95B1,KGFLP2,FAM75A1,FAM75A2,FAM75A3,FAM75A4,FAM75A5,FAM75A6,FAM75A7,FAM74A1,FAM74A3,CNTNAP3B,LOC642929,FOXD4L4,FOXD4L2,LOC286297,ZNF658B,ANKRD20A2,MGC21881,CNTNAP3,LOC643648,AQP7P3,ZNF658,ANKRD20A3 | Y | 1811 |
| 9 | 39048058 | 43776365 | 4728307 | loss | 994 | LOC653501,FAM95B1,KGFLP2,FAM75A1,FAM75A2,FAM75A3,FAM75A4,FAM75A5,FAM75A6,FAM75A7,FAM74A1,FAM74A3,CNTNAP3B,LOC642929,FOXD4L4,FOXD4L2,LOC286297,ZNF658B,ANKRD20A2,MGC21881,CNTNAP3,LOC643648,AQP7P3,ZNF658,ANKRD20A3 | Y | 1810 |
| 9 | 39091349 | 44199401 | 5108052 | loss | 970 | LOC653501,FAM95B1,KGFLP2,FAM75A1,FAM75A2,FAM75A3,FAM75A4,FAM75A5,FAM75A6,FAM75A7,FAM74A1,FAM74A3,CNTNAP3B,LOC642929,FOXD4L4,FOXD4L2,LOC286297,ZNF658B,ANKRD20A2,MGC21881,CNTNAP3,LOC643648,AQP7P3,ZNF658,ANKRD20A3 | Y | 1812 |
| 9 | 38758232 | 45359327 | 660109 | loss | 966 | LOC653501,FAM95 | Y | 1813 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| | | | 5 | | | B1,KGFLP2,FAM75A1,FAM75A2,FAM75A3,FAM75A4,FAM75A5,FAM75A6,FAM75A7,FAM74A1,FAM74A3,FAM27C,CNTNAP3B,LOC642929,FOXD4L4,FOXD4L2,LOC286297,ZNF658B,ANKRD20A2,MGC21881,CNTNAP3,LOC643648,AQP7P3,ZNF658,ANKRD20A3 | | |
| X | 29367686 | 29369448 | 1762 | gain | 958 | IL1RAPL1 | N | 1814 |
| X | 29595687 | 29597689 | 2002 | loss | 1035 | IL1RAPL1 | Y | 1815 |
| X | 104510036 | 104512681 | 2645 | loss | 979 | IL1RAPL2 | N | 1816 |
| X | 104510036 | 104512681 | 2645 | loss | 1003 | IL1RAPL2 | N | 1816 |
| X | 104510036 | 104512681 | 2645 | loss | 1023 | IL1RAPL2 | N | 1816 |
| 1 | 1707874 | 1914525 | 206651 | gain | 1020 | KIAA1751,TMEM52,GNB1,CALML6 | Y | 1817 |
| 12 | 10465787 | 10540088 | 74301 | gain | 947 | KLRC1,KLRC2 | Y | 1818 |
| 12 | 10464018 | 10534393 | 70375 | gain | 979 | KLRC1,KLRC3,KLRC2 | Y | 1819 |
| 8 | 144845724 | 144863110 | 17386 | loss | 1008 | BREA2,ZNF707,CCDC166 | Y | 1820 |
| 8 | 144845724 | 144863110 | 17386 | loss | 1024 | BREA2,ZNF707,CCDC166 | Y | 1820 |
| 11 | 88258151 | 88274575 | 16424 | loss | 949 | GRM5 | N | 1821 |
| 11 | 88268465 | 88305485 | 37020 | loss | 1003 | GRM5 | N | 1822 |
| 17 | 41501967 | 41710400 | 208433 | loss | 1024 | KANSL1,KANSL1-AS1 | Y | 1823 |
| 17 | 41519702 | 41710400 | 190698 | loss | 1028 | KANSL1,KANSL1-AS1 | Y | 1824 |
| 10 | 76129083 | 76135755 | 6672 | gain | 955 | ADK | N | 1825 |
| 10 | 76129083 | 76135755 | 6672 | gain | 959 | ADK | N | 1825 |
| 10 | 76129083 | 76135755 | 6672 | gain | 964 | ADK | N | 1825 |
| 10 | 76129083 | 76135755 | 6672 | loss | 988 | ADK | N | 1825 |
| 10 | 76129083 | 76135755 | 6672 | loss | 1007 | ADK | N | 1825 |
| 10 | 60139394 | 60201113 | 61719 | gain | 992 | FAM133CP,BICC1 | Y | 1826 |
| 3 | 174692234 | 174701950 | 9716 | gain | 952 | NLGN1 | N | 1827 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 3 | 174692234 | 174704469 | 12235 | gain | 975 | NLGN1 | N | 1828 |
| 3 | 174692234 | 174704469 | 12235 | gain | 978 | NLGN1 | N | 1828 |
| 3 | 174692234 | 174706670 | 14436 | gain | 1020 | NLGN1 | N | 1829 |
| 3 | 174692234 | 174704469 | 12235 | gain | 1022 | NLGN1 | N | 1828 |
| 3 | 174692778 | 174708603 | 15825 | gain | 1034 | NLGN1 | N | 1830 |
| 19 | 794973 | 798817 | 3844 | gain | 961 | PRTN3 | Y | 1831 |
| 19 | 794973 | 801351 | 6378 | loss | 998 | PRTN3 | Y | 1832 |
| 8 | 99038720 | 99041695 | 2975 | loss | 1004 | MATN2 | N | 1833 |
| 8 | 99039952 | 99041695 | 1743 | loss | 968 | MATN2 | N | 1834 |
| 8 | 99039952 | 99041695 | 1743 | loss | 975 | MATN2 | N | 1834 |
| 8 | 99039952 | 99041695 | 1743 | loss | 993 | MATN2 | N | 1834 |
| 6 | 134624093 | 134635779 | 11686 | gain | 953 | SGK1 | Y | 1835 |
| 6 | 134624093 | 134635779 | 11686 | gain | 957 | SGK1 | Y | 1835 |
| 6 | 134624093 | 134635779 | 11686 | gain | 963 | SGK1 | Y | 1835 |
| 6 | 134624093 | 134635779 | 11686 | gain | 981 | SGK1 | Y | 1835 |
| 6 | 134624093 | 134635779 | 11686 | gain | 984 | SGK1 | Y | 1835 |
| 6 | 134624093 | 134635779 | 11686 | gain | 1003 | SGK1 | Y | 1835 |
| 6 | 134624093 | 134635779 | 11686 | gain | 1005 | SGK1 | Y | 1835 |
| 2 | 3708749 | 3714236 | 5487 | loss | 995 | ALLC | N | 1836 |
| 2 | 3708749 | 3714236 | 5487 | loss | 1001 | ALLC | N | 1836 |
| 2 | 3708749 | 3714236 | 5487 | loss | 1018 | ALLC | N | 1836 |
| 2 | 3708749 | 3714236 | 5487 | loss | 1019 | ALLC | N | 1836 |
| 5 | 134286886 | 134289928 | 3042 | gain | 961 | PCBD2 | N | 1837 |
| 5 | 134286886 | 134289928 | 3042 | gain | 975 | PCBD2 | N | 1837 |
| 5 | 134286886 | 134289928 | 3042 | gain | 993 | PCBD2 | N | 1837 |
| 5 | 134286886 | 134289928 | 3042 | gain | 1030 | PCBD2 | N | 1837 |
| 2 | 214581782 | 214586936 | 5154 | loss | 993 | SPAG16 | Y | 1838 |
| 2 | 214805561 | 214828475 | 22914 | gain | 1018 | SPAG16 | N | 1839 |
| 2 | 214886207 | 214887681 | 1474 | loss | 999 | SPAG16 | N | 1840 |
| 8 | 144970607 | 144970777 | 170 | gain | 946 | PUF60 | Y | 1841 |
| 8 | 144970607 | 144970777 | 170 | gain | 949 | PUF60 | Y | 1841 |
| 8 | 144970607 | 144970777 | 170 | gain | 961 | PUF60 | Y | 1841 |
| 8 | 144970607 | 144970777 | 170 | gain | 968 | PUF60 | Y | 1841 |
| 8 | 144970607 | 144970777 | 170 | gain | 974 | PUF60 | Y | 1841 |
| 8 | 144970607 | 144970777 | 170 | gain | 975 | PUF60 | Y | 1841 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 8 | 144970607 | 144970777 | 170 | gain | 1034 | PUF60 | Y | 1841 |
| 8 | 74526051 | 74527806 | 1755 | gain | 1032 | STAU2 | N | 1842 |
| 8 | 74753295 | 74778653 | 25358 | gain | 1012 | STAU2 | Y | 1843 |
| 8 | 74753948 | 74761544 | 7596 | gain | 992 | STAU2 | N | 1844 |
| 8 | 88382155 | 88388307 | 6152 | gain | 964 | CNBD1 | N | 1845 |
| 8 | 88382155 | 88388307 | 6152 | gain | 971 | CNBD1 | N | 1845 |
| 8 | 88382155 | 88388307 | 6152 | loss | 975 | CNBD1 | N | 1845 |
| 8 | 88382155 | 88388307 | 6152 | loss | 990 | CNBD1 | N | 1845 |
| 10 | 122623381 | 122626509 | 3128 | gain | 966 | WDR11,MIR5694 | Y | 1846 |
| 10 | 122633344 | 122640560 | 7216 | gain | 950 | WDR11,MIR5694 | Y | 1847 |
| 5 | 179430821 | 179431937 | 1116 | loss | 947 | RNF130 | Y | 1848 |
| 5 | 179430821 | 179431937 | 1116 | loss | 953 | RNF130 | Y | 1848 |
| 5 | 179430821 | 179431937 | 1116 | loss | 955 | RNF130 | Y | 1848 |
| 5 | 179430821 | 179431937 | 1116 | loss | 957 | RNF130 | Y | 1848 |
| 5 | 179430821 | 179431937 | 1116 | loss | 958 | RNF130 | Y | 1848 |
| 5 | 179430821 | 179431937 | 1116 | loss | 959 | RNF130 | Y | 1848 |
| 5 | 179430821 | 179431937 | 1116 | loss | 960 | RNF130 | Y | 1848 |
| 5 | 179430821 | 179431937 | 1116 | loss | 971 | RNF130 | Y | 1848 |
| 5 | 179430821 | 179431937 | 1116 | loss | 977 | RNF130 | Y | 1848 |
| 5 | 179430821 | 179431937 | 1116 | loss | 982 | RNF130 | Y | 1848 |
| 5 | 179430821 | 179431937 | 1116 | loss | 997 | RNF130 | Y | 1848 |
| 5 | 179430821 | 179431937 | 1116 | loss | 1001 | RNF130 | Y | 1848 |
| 5 | 179430821 | 179431937 | 1116 | loss | 1003 | RNF130 | Y | 1848 |
| 5 | 179430821 | 179431937 | 1116 | loss | 1006 | RNF130 | Y | 1848 |
| 5 | 179430821 | 179431937 | 1116 | loss | 1031 | RNF130 | Y | 1848 |
| 5 | 179430821 | 179431937 | 1116 | loss | 1033 | RNF130 | Y | 1848 |
| 15 | 99634434 | 99635701 | 1267 | gain | 960 | VIMP | Y | 1849 |
| 15 | 99634434 | 99635701 | 1267 | gain | 969 | VIMP | Y | 1849 |
| 15 | 99634434 | 99635701 | 1267 | gain | 971 | VIMP | Y | 1849 |
| 15 | 99634434 | 99635701 | 1267 | gain | 984 | VIMP | Y | 1849 |
| 15 | 99634434 | 99635701 | 1267 | gain | 992 | VIMP | Y | 1849 |
| 15 | 99634434 | 99635701 | 1267 | gain | 993 | VIMP | Y | 1849 |
| 15 | 99634434 | 99635701 | 1267 | gain | 994 | VIMP | Y | 1849 |
| 15 | 99634434 | 99635701 | 1267 | gain | 997 | VIMP | Y | 1849 |
| 15 | 99634434 | 99635701 | 1267 | loss | 998 | VIMP | Y | 1849 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 15 | 99634434 | 99635701 | 1267 | gain | 1000 | VIMP | Y | 1849 |
| 15 | 99634434 | 99635701 | 1267 | gain | 1003 | VIMP | Y | 1849 |
| 15 | 99634434 | 99635701 | 1267 | loss | 1004 | VIMP | Y | 1849 |
| 15 | 99634434 | 99635701 | 1267 | gain | 1017 | VIMP | Y | 1849 |
| 15 | 99634434 | 99635701 | 1267 | gain | 1025 | VIMP | Y | 1849 |
| 15 | 99634434 | 99635701 | 1267 | gain | 1028 | VIMP | Y | 1849 |
| 15 | 99634434 | 99635701 | 1267 | loss | 1029 | VIMP | Y | 1849 |
| 15 | 99634434 | 99635701 | 1267 | gain | 1035 | VIMP | Y | 1849 |
| 19 | 42537228 | 42537766 | 538 | loss | 990 | HKR1 | N | 1850 |
| 19 | 42537228 | 42537766 | 538 | loss | 991 | HKR1 | N | 1850 |
| 19 | 42537228 | 42544684 | 7456 | loss | 1014 | HKR1 | N | 1851 |
| 19 | 42537228 | 42537766 | 538 | loss | 1022 | HKR1 | N | 1850 |
| 7 | 55855108 | 55873303 | 18195 | loss | 957 | 14-Sep | Y | 1852 |
| 7 | 55878374 | 55890585 | 12211 | loss | 1003 | 14-Sep | Y | 1853 |
| 7 | 23802428 | 23809398 | 6970 | loss | 993 | STK31 | N | 1854 |
| 7 | 23802428 | 23809398 | 6970 | loss | 1004 | STK31 | N | 1854 |
| 7 | 23802428 | 23809218 | 6790 | loss | 1009 | STK31 | N | 1855 |
| 7 | 23802428 | 23811096 | 8668 | loss | 1013 | STK31 | N | 1856 |
| 7 | 23802428 | 23809398 | 6970 | loss | 1022 | STK31 | N | 1854 |
| 7 | 23802428 | 23809218 | 6790 | loss | 1036 | STK31 | N | 1855 |
| 20 | 51045995 | 51058635 | 12640 | loss | 952 | TSHZ2 | N | 1857 |
| 20 | 51053053 | 51054248 | 1195 | loss | 961 | TSHZ2 | N | 1858 |
| 20 | 51053053 | 51054248 | 1195 | loss | 975 | TSHZ2 | N | 1858 |
| 20 | 51053053 | 51058635 | 5582 | loss | 980 | TSHZ2 | N | 1859 |
| 19 | 42386895 | 42388238 | 1343 | loss | 986 | ZNF585B | N | 1860 |
| 19 | 42386895 | 42388238 | 1343 | loss | 1012 | ZNF585B | N | 1860 |
| 19 | 42386895 | 42388238 | 1343 | loss | 1017 | ZNF585B | N | 1860 |
| 19 | 42386895 | 42388238 | 1343 | loss | 1026 | ZNF585B | N | 1860 |
| X | 39852030 | 39853092 | 1062 | gain | 970 | BCOR | N | 1861 |
| X | 39852030 | 39853092 | 1062 | loss | 1016 | BCOR | N | 1861 |
| X | 39852030 | 39853092 | 1062 | loss | 1031 | BCOR | N | 1861 |
| 1 | 195559094 | 195562465 | 3371 | gain | 958 | CRB1 | N | 1862 |
| 1 | 195561305 | 195562465 | 1160 | gain | 972 | CRB1 | N | 1863 |
| 1 | 195561305 | 195562465 | 1160 | gain | 1002 | CRB1 | N | 1863 |
| 3 | 172847008 | 172850471 | 3463 | loss | 994 | PLD1 | N | 1864 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 3 | 173003698 | 173009667 | 5969 | loss | 991 | PLD1 | N | 1865 |
| 3 | 173003698 | 173006873 | 3175 | loss | 1015 | PLD1 | N | 1866 |
| 3 | 173003698 | 173006873 | 3175 | loss | 1022 | PLD1 | N | 1866 |
| 8 | 18894239 | 18908287 | 14048 | gain | 949 | PSD3 | N | 1867 |
| 8 | 18894239 | 18908287 | 14048 | gain | 985 | PSD3 | N | 1867 |
| 8 | 18894239 | 18908287 | 14048 | gain | 1016 | PSD3 | N | 1867 |
| 14 | 71779767 | 71780825 | 1058 | gain | 998 | RGS6 | N | 1868 |
| 14 | 71779767 | 71780825 | 1058 | gain | 1016 | RGS6 | N | 1868 |
| 14 | 71779767 | 71780825 | 1058 | gain | 1019 | RGS6 | N | 1868 |
| 6 | 72916886 | 72924440 | 7554 | gain | 1029 | RIMS1 | N | 1869 |
| 6 | 72920894 | 72931789 | 10895 | gain | 996 | RIMS1 | N | 1870 |
| 17 | 16480516 | 16489447 | 8931 | loss | 975 | ZNF624 | N | 1871 |
| 17 | 16480516 | 16483386 | 2870 | loss | 991 | ZNF624 | N | 1872 |
| 17 | 16480516 | 16483386 | 2870 | loss | 1004 | ZNF624 | N | 1872 |
| 12 | 42159304 | 42167699 | 8395 | loss | 946 | ADAMTS20 | N | 1873 |
| 12 | 42159304 | 42167699 | 8395 | gain | 951 | ADAMTS20 | N | 1873 |
| 1 | 6779563 | 6789223 | 9660 | gain | 973 | CAMTA1 | N | 1874 |
| 1 | 6786219 | 6790460 | 4241 | gain | 962 | CAMTA1 | N | 1875 |
| 1 | 7056961 | 7059582 | 2621 | gain | 1037 | CAMTA1 | N | 1876 |
| 16 | 81590448 | 81599011 | 8563 | loss | 994 | CDH13 | N | 1877 |
| 16 | 81592666 | 81599011 | 6345 | loss | 993 | CDH13 | N | 1878 |
| 16 | 81752862 | 81755529 | 2667 | gain | 1025 | CDH13 | N | 1879 |
| 16 | 81752862 | 81755529 | 2667 | gain | 1030 | CDH13 | N | 1879 |
| 12 | 105959641 | 105980836 | 21195 | gain | 964 | CRY1 | N | 1880 |
| 12 | 105966884 | 105967651 | 767 | gain | 950 | CRY1 | N | 1881 |
| 7 | 101300618 | 101307173 | 6555 | loss | 1024 | CUX1 | N | 1882 |
| 7 | 101300618 | 101307173 | 6555 | loss | 1026 | CUX1 | N | 1882 |
| 19 | 15640597 | 15677382 | 36785 | gain | 1001 | CYP4F12 | Y | 1883 |
| 19 | 15664290 | 15667581 | 3291 | gain | 950 | CYP4F12 | N | 1884 |
| 8 | 1491491 | 1500993 | 9502 | gain | 998 | DLGAP2 | N | 1885 |
| 8 | 1496880 | 1499520 | 2640 | gain | 1012 | DLGAP2 | N | 1886 |
| 2 | 153167113 | 153169656 | 2543 | gain | 962 | FMNL2 | N | 1887 |
| 2 | 153167113 | 153169656 | 2543 | gain | 977 | FMNL2 | N | 1887 |
| 5 | 90112791 | 90112816 | 25 | loss | 969 | GPR98 | N | 1888 |
| 5 | 90254811 | 90261232 | 6421 | loss | 1015 | GPR98 | N | 1889 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 5 | 90254811 | 90261232 | 6421 | loss | 1020 | GPR98 | N | 1889 |
| 16 | 9962571 | 9968344 | 5773 | gain | 1032 | GRIN2A | N | 1890 |
| 16 | 9965024 | 9968344 | 3320 | gain | 1001 | GRIN2A | N | 1891 |
| 16 | 9979934 | 9981275 | 1341 | gain | 1032 | GRIN2A | N | 1892 |
| 1 | 113847479 | 113848985 | 1506 | loss | 1016 | MAGI3 | N | 1893 |
| 1 | 113847479 | 113848985 | 1506 | loss | 1036 | MAGI3 | N | 1893 |
| 2 | 210019796 | 210021952 | 2156 | loss | 969 | MAP2 | N | 1894 |
| 2 | 210089280 | 210092780 | 3500 | loss | 990 | MAP2 | N | 1895 |
| 9 | 27323197 | 27324577 | 1380 | loss | 975 | MOB3B | N | 1896 |
| 9 | 27365836 | 27367745 | 1909 | gain | 989 | MOB3B | N | 1897 |
| 8 | 63429132 | 63445676 | 16544 | loss | 1003 | NKAIN3 | N | 1898 |
| 8 | 63686220 | 63692725 | 6505 | loss | 992 | NKAIN3 | N | 1899 |
| 8 | 63686220 | 63692725 | 6505 | loss | 999 | NKAIN3 | N | 1899 |
| 14 | 78086003 | 78087442 | 1439 | gain | 971 | NRXN3 | N | 1900 |
| 14 | 78227579 | 78233664 | 6085 | loss | 1002 | NRXN3 | N | 1901 |
| 14 | 79127635 | 79134722 | 7087 | loss | 971 | NRXN3 | N | 1902 |
| 14 | 79127635 | 79128659 | 1024 | loss | 986 | NRXN3 | N | 1903 |
| 14 | 79174722 | 79183154 | 8432 | gain | 1035 | NRXN3 | N | 1904 |
| 6 | 144006076 | 144011154 | 5078 | loss | 989 | PHACTR2 | N | 1905 |
| 6 | 144006076 | 144011154 | 5078 | loss | 990 | PHACTR2 | N | 1905 |
| 12 | 63346598 | 63347718 | 1120 | loss | 978 | RASSF3 | N | 1906 |
| 12 | 63346598 | 63349229 | 2631 | loss | 987 | RASSF3 | N | 1907 |
| 1 | 211441787 | 211462117 | 20330 | gain | 1027 | RPS6KC1 | N | 1908 |
| 1 | 211453716 | 211460007 | 6291 | gain | 958 | RPS6KC1 | N | 1909 |
| 11 | 13984290 | 13989127 | 4837 | loss | 995 | SPON1 | N | 1910 |
| 11 | 13984290 | 13989127 | 4837 | loss | 996 | SPON1 | N | 1910 |
| 3 | 122247183 | 122251797 | 4614 | loss | 990 | STXBP5L | N | 1911 |
| 3 | 122247183 | 122251797 | 4614 | loss | 1033 | STXBP5L | N | 1911 |
| 3 | 122473098 | 122479931 | 6833 | loss | 1004 | STXBP5L | N | 1912 |
| 17 | 9267206 | 9269293 | 2087 | gain | 1027 | STX8 | N | 1913 |
| 17 | 9269293 | 9272211 | 2918 | gain | 982 | STX8 | N | 1914 |
| 12 | 77815879 | 77835641 | 19762 | loss | 1002 | SYT1 | N | 1915 |
| 12 | 77815879 | 77835641 | 19762 | loss | 1015 | SYT1 | N | 1915 |
| 12 | 6315047 | 6317276 | 2229 | loss | 1003 | TNFRSF1A | N | 1916 |
| 12 | 6315047 | 6317276 | 2229 | loss | 1005 | TNFRSF1A | N | 1916 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 2 | 54317909 | 54320610 | 2701 | gain | 962 | ACYP2 | N | 1917 |
| 4 | 73518013 | 73522044 | 4031 | gain | 971 | ADAMTS3 | N | 1918 |
| 4 | 73557728 | 73567966 | 10238 | loss | 1002 | ADAMTS3 | N | 1919 |
| 7 | 97767682 | 97771031 | 3349 | gain | 986 | BAIAP2L1 | N | 1920 |
| 7 | 97805256 | 97807057 | 1801 | gain | 989 | BAIAP2L1 | N | 1921 |
| 11 | 47040725 | 47045421 | 4696 | loss | 1035 | C11orf49 | N | 1922 |
| 11 | 47098212 | 47098992 | 780 | loss | 1017 | C11orf49 | N | 1923 |
| 7 | 81791206 | 81794051 | 2845 | gain | 1019 | CACNA2D1 | N | 1924 |
| 7 | 81792312 | 81794051 | 1739 | gain | 952 | CACNA2D1 | N | 1925 |
| 7 | 81792312 | 81794051 | 1739 | gain | 989 | CACNA2D1 | N | 1925 |
| 7 | 81792312 | 81794051 | 1739 | gain | 1002 | CACNA2D1 | N | 1925 |
| 7 | 81792312 | 81794051 | 1739 | gain | 1009 | CACNA2D1 | N | 1925 |
| 7 | 81792312 | 81794051 | 1739 | gain | 1016 | CACNA2D1 | N | 1925 |
| 7 | 81792312 | 81794051 | 1739 | gain | 1022 | CACNA2D1 | N | 1925 |
| 7 | 81792312 | 81794051 | 1739 | gain | 1026 | CACNA2D1 | N | 1925 |
| 7 | 81792312 | 81794051 | 1739 | gain | 1036 | CACNA2D1 | N | 1925 |
| 7 | 81792312 | 81794051 | 1739 | gain | 1037 | CACNA2D1 | N | 1925 |
| 9 | 140136862 | 140145683 | 8821 | gain | 981 | CACNA1B | Y | 1926 |
| 5 | 106844020 | 106849671 | 5651 | loss | 1015 | EFNA5 | N | 1927 |
| 5 | 106868586 | 106875551 | 6965 | loss | 992 | EFNA5 | N | 1928 |
| 3 | 89522996 | 89718542 | 195546 | gain | 960 | EPHA3 | Y | 1929 |
| 2 | 154593217 | 154611228 | 18011 | gain | 950 | GALNT13 | N | 1930 |
| 2 | 154915705 | 154919651 | 3946 | loss | 1022 | GALNT13 | N | 1931 |
| 2 | 154953643 | 154955528 | 1885 | gain | 1037 | GALNT13 | N | 1932 |
| 1 | 18377963 | 18381122 | 3159 | gain | 965 | IGSF21 | N | 1933 |
| 1 | 18554390 | 18556733 | 2343 | loss | 966 | IGSF21 | N | 1934 |
| 2 | 238217378 | 238224411 | 7033 | gain | 1010 | LRRFIP1 | N | 1935 |
| 2 | 238219154 | 238224411 | 5257 | gain | 952 | LRRFIP1 | N | 1936 |
| 2 | 238219154 | 238224411 | 5257 | gain | 966 | LRRFIP1 | N | 1936 |
| 2 | 238219154 | 238224411 | 5257 | gain | 976 | LRRFIP1 | N | 1936 |
| 2 | 238219154 | 238224411 | 5257 | gain | 978 | LRRFIP1 | N | 1936 |
| 2 | 238219154 | 238224411 | 5257 | gain | 1002 | LRRFIP1 | N | 1936 |
| 2 | 238219154 | 238224411 | 5257 | gain | 1014 | LRRFIP1 | N | 1936 |
| 2 | 238219154 | 238224411 | 5257 | gain | 1034 | LRRFIP1 | N | 1936 |
| X | 152978747 | 152981151 | 2404 | gain | 999 | MECP2 | N | 1937 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| X | 152978747 | 152981151 | 2404 | gain | 1022 | MECP2 | N | 1937 |
| 1 | 239259578 | 239489157 | 229579 | gain | 948 | MIR3123,RGS7 | Y | 1938 |
| 19 | 3355220 | 3356334 | 1114 | gain | 949 | NFIC | N | 1939 |
| 19 | 3355220 | 3356334 | 1114 | gain | 951 | NFIC | N | 1939 |
| 19 | 3355220 | 3356334 | 1114 | gain | 954 | NFIC | N | 1939 |
| 19 | 3355220 | 3356334 | 1114 | gain | 970 | NFIC | N | 1939 |
| 19 | 3355220 | 3356334 | 1114 | gain | 978 | NFIC | N | 1939 |
| 19 | 3355220 | 3356334 | 1114 | gain | 995 | NFIC | N | 1939 |
| 19 | 3355220 | 3356334 | 1114 | gain | 1005 | NFIC | N | 1939 |
| 19 | 3355220 | 3356334 | 1114 | gain | 1022 | NFIC | N | 1939 |
| 19 | 3355220 | 3356334 | 1114 | gain | 1034 | NFIC | N | 1939 |
| 9 | 8344218 | 8345409 | 1191 | gain | 993 | PTPRD | N | 1940 |
| 9 | 9055746 | 9057345 | 1599 | loss | 1016 | PTPRD | N | 1941 |
| 9 | 9675661 | 9679084 | 3423 | loss | 1036 | PTPRD | N | 1942 |
| 9 | 10164640 | 10167989 | 3349 | gain | 950 | PTPRD | N | 1943 |
| 9 | 10395198 | 10398529 | 3331 | loss | 1012 | PTPRD | N | 1944 |
| 15 | 59220825 | 59234113 | 13288 | gain | 996 | RORA | N | 1945 |
| 15 | 59220825 | 59221540 | 715 | gain | 998 | RORA | N | 1946 |
| 5 | 77724204 | 77725392 | 1188 | gain | 948 | SCAMP1 | N | 1947 |
| 5 | 77724204 | 77725392 | 1188 | gain | 950 | SCAMP1 | N | 1947 |
| 5 | 77724204 | 77725392 | 1188 | gain | 955 | SCAMP1 | N | 1947 |
| 5 | 77724204 | 77725392 | 1188 | gain | 957 | SCAMP1 | N | 1947 |
| 5 | 77724204 | 77725392 | 1188 | gain | 958 | SCAMP1 | N | 1947 |
| 5 | 77724204 | 77725392 | 1188 | gain | 970 | SCAMP1 | N | 1947 |
| 5 | 77724204 | 77725392 | 1188 | gain | 978 | SCAMP1 | N | 1947 |
| 5 | 77724204 | 77725392 | 1188 | gain | 988 | SCAMP1 | N | 1947 |
| 5 | 77724204 | 77725392 | 1188 | gain | 995 | SCAMP1 | N | 1947 |
| 5 | 77724204 | 77725392 | 1188 | gain | 1000 | SCAMP1 | N | 1947 |
| 5 | 77724204 | 77725392 | 1188 | gain | 1002 | SCAMP1 | N | 1947 |
| 5 | 77724204 | 77725392 | 1188 | gain | 1028 | SCAMP1 | N | 1947 |
| 12 | 42909733 | 42912201 | 2468 | loss | 979 | TMEM117 | N | 1948 |
| 12 | 42912202 | 42913523 | 1321 | loss | 1014 | TMEM117 | N | 1949 |
| 3 | 11693583 | 11695234 | 1651 | loss | 974 | VGLL4 | N | 1950 |
| 7 | 70311792 | 70316530 | 4738 | gain | 1019 | WBSCR17 | N | 1951 |
| 7 | 70661573 | 70662760 | 1187 | loss | 978 | WBSCR17 | N | 1952 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| 1 | 68435695 | 68436445 | 750 | loss | 961 | WLS,GNG12-AS1 | N | 1953 |
| 1 | 68435695 | 68436445 | 750 | gain | 971 | WLS,GNG12-AS1 | N | 1953 |
| 1 | 68435695 | 68436445 | 750 | gain | 992 | WLS,GNG12-AS1 | N | 1953 |
| 1 | 68435695 | 68436445 | 750 | gain | 997 | WLS,GNG12-AS1 | N | 1953 |
| 1 | 68435695 | 68436445 | 750 | loss | 998 | WLS,GNG12-AS1 | N | 1953 |
| 1 | 68435695 | 68436445 | 750 | gain | 999 | WLS,GNG12-AS1 | N | 1953 |
| 1 | 68435695 | 68436445 | 750 | loss | 1011 | WLS,GNG12-AS1 | N | 1953 |
| 1 | 68435695 | 68436445 | 750 | gain | 1013 | WLS,GNG12-AS1 | N | 1953 |
| 1 | 68435695 | 68439703 | 4008 | loss | 1020 | WLS,GNG12-AS1 | N | 1954 |
| 8 | 56318028 | 56321660 | 3632 | gain | 992 | XKR4 | N | 1955 |
| 8 | 56363588 | 56368489 | 4901 | loss | 1028 | XKR4 | N | 1956 |
| 5 | 172485049 | 172499213 | 14164 | gain | 958 | CREBRF | Y | 1957 |
| 4 | 37191879 | 37278974 | 87095 | loss | 1011 | C4orf19,RELL1 | Y | 1958 |
| 2 | 44392191 | 44488199 | 96008 | loss | 978 | CAMKMT,PREPL,SLC3A1 | Y | 1959 |
| 12 | 122838898 | 122840411 | 1513 | loss | 975 | DNAH10 | Y | 1960 |
| 3 | 57391544 | 57403468 | 11924 | loss | 986 | DNAH12 | Y | 1961 |
| 6 | 38910371 | 38921613 | 11242 | gain | 957 | DNAH8 | Y | 1962 |
| 5 | 138783067 | 138788669 | 5602 | gain | 1005 | DNAJC18 | Y | 1963 |
| 3 | 60640025 | 60872007 | 231982 | loss | 967 | FHIT | Y | 1964 |
| 3 | 189367406 | 189936236 | 568830 | gain | 971 | FLJ42393,LPP | Y | 1965 |
| 22 | 20711753 | 21392867 | 681114 | loss | 963 | GGTLC2,LOC96610,PRAME,ZNF280B,ZNF280A,LOC648691,POM121L1P,VPREB1 | Y | 1966 |
| 22 | 20716147 | 21576859 | 860712 | loss | 947 | GGTLC2,LOC96610,PRAME,IGLL5,ZNF280B,ZNF280A,LOC648691,POM121L1P,MIR650,VPREB1 | Y | 1967 |
| 1 | 233606018 | 233781576 | 175558 | gain | 1018 | GNG4,TBCE,B3GALNT2 | Y | 1968 |
| 6 | 87558407 | 87787539 | 229132 | gain | 980 | HTR1E | Y | 1969 |
| 8 | 42308627 | 42312018 | 3391 | gain | 989 | IKBKB | Y | 1970 |
| 16 | 31186841 | 31256185 | 69344 | gain | 1020 | ITGAM | Y | 1971 |
| 1 | 153095163 | 153108159 | 12996 | gain | 950 | KCNN3 | Y | 1972 |
| 2 | 143350188 | 143354905 | 4717 | loss | 1037 | KYNU | Y | 1973 |
| 10 | 78775816 | 79543704 | 767888 | gain | 946 | LOC100128292,RPS | Y | 1974 |

Figure 8C (Continued)

| Figure 8C | | | | | | | | |
|---|---|---|---|---|---|---|---|---|
| Chr | Start | Stop | Size | CNV Type | PD Case ID | RefSeq Gene Symbol | Exon overlap | SEQ ID |
| | | | | | | 24,DLG5,KCNMA1, POLR3A | | |
| 8 | 142345181 | 142510717 | 165536 | gain | 1036 | LOC731779,GPR20, PTP4A3 | Y | 1975 |
| 2 | 169872912 | 169890340 | 17428 | loss | 1037 | LRP2 | Y | 1976 |
| 12 | 38904346 | 38909561 | 5215 | gain | 972 | LRRK2 | Y | 1977 |
| 8 | 17702372 | 17880477 | 178105 | loss | 976 | MTUS1,FGL1,PCM1 | Y | 1978 |
| 2 | 170839943 | 170843170 | 3227 | gain | 955 | MYO3B | N | 1979 |
| 2 | 170842044 | 170843170 | 1126 | loss | 1002 | MYO3B | N | 1980 |
| 2 | 171074964 | 171076390 | 1426 | loss | 1007 | MYO3B | N | 1981 |
| 2 | 171186115 | 171203861 | 17746 | gain | 959 | MYO3B | N | 1982 |
| 2 | 171193428 | 171205175 | 11747 | gain | 1037 | MYO3B | N | 1983 |
| 7 | 100622624 | 100660738 | 38114 | loss | 964 | PLOD3,ZNHIT1,MOGAT3 | Y | 1984 |
| 6 | 149859127 | 149870155 | 11028 | loss | 1010 | PPIL4 | Y | 1985 |
| 20 | 2873876 | 2879388 | 5512 | gain | 962 | PTPRA | Y | 1986 |
| 1 | 196963584 | 196986393 | 22809 | loss | 1034 | PTPRC | Y | 1987 |
| 4 | 2481647 | 2661045 | 179398 | loss | 969 | RNF4,FAM193A | Y | 1988 |
| 18 | 16833161 | 16851074 | 17913 | gain | 965 | ROCK1 | Y | 1989 |
| 6 | 125405845 | 125410165 | 4320 | loss | 1001 | RNF217 | Y | 1990 |
| 8 | 41199070 | 41267922 | 68852 | gain | 996 | SFRP1 | Y | 1991 |
| 6 | 43253688 | 43256242 | 2554 | loss | 1001 | SRF | Y | 1992 |
| 15 | 72197969 | 72283889 | 85920 | gain | 1012 | STRA6,ISLR,ISLR2,LOC283731 | Y | 1993 |
| 1 | 243943023 | 244875851 | 932828 | gain | 986 | TFB2M,CNST,LOC255654,SMYD3 | Y | 1994 |
| 19 | 54388780 | 54397344 | 8564 | loss | 993 | TRPM4 | Y | 1995 |
| 18 | 169042 | 184227 | 15185 | loss | 957 | USP14 | Y | 1996 |
| 2 | 198356013 | 198386999 | 30986 | gain | 1036 | BOLL,PLCL1 | Y | 1997 |
| 12 | 63107981 | 63136048 | 28067 | gain | 1027 | XPOT,TBK1 | Y | 1998 |
| 6 | 135696211 | 136199542 | 503331 | loss | 1024 | LINC00271,AHI1,MIR548H4 | Y | 1999 |
| 16 | 71619180 | 72163605 | 544425 | gain | 1011 | LOC100506172,HTA,ZFHX3 | Y | 2000 |
| 7 | 18161134 | 18275401 | 114267 | loss | 971 | HDAC9 | Y | 2001 |
| 21 | 38314286 | 38675904 | 361618 | gain | 1015 | DSCR4,ERG,DSCR8,KCNJ15,DSCR10 | Y | 2002 |

Figure 8C (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 1 | 8283325 | 8285554 | 2229 | loss | 2427 | | 806 |
| 1 | 8283325 | 8285554 | 2229 | loss | 2465 | | 806 |
| 1 | 8283325 | 8285554 | 2229 | loss | 2541 | | 806 |
| 1 | 8283325 | 8285554 | 2229 | loss | 2616 | | 806 |
| 1 | 41120407 | 41153389 | 32982 | gain | 71 | | 807 |
| 1 | 41118001 | 41153389 | 35388 | gain | 98 | | 808 |
| 1 | 41120407 | 41153389 | 32982 | gain | 172 | | 807 |
| 1 | 41120407 | 41153389 | 32982 | gain | 218 | | 807 |
| 1 | 41120407 | 41153389 | 32982 | gain | 384 | | 807 |
| 1 | 41120407 | 41153389 | 32982 | gain | 429 | | 807 |
| 1 | 41120407 | 41153389 | 32982 | gain | 467 | | 807 |
| 1 | 41120407 | 41153389 | 32982 | gain | 507 | | 807 |
| 1 | 41120407 | 41153389 | 32982 | gain | 535 | | 807 |
| 1 | 41120407 | 41153389 | 32982 | gain | 592 | | 807 |
| 1 | 41120407 | 41153389 | 32982 | gain | 669 | | 807 |
| 1 | 41120407 | 41153389 | 32982 | gain | 674 | | 807 |
| 1 | 41120407 | 41153389 | 32982 | gain | 783 | | 807 |
| 1 | 41120407 | 41153389 | 32982 | gain | 919 | | 807 |
| 1 | 41120407 | 41153389 | 32982 | gain | 1194 | | 807 |
| 1 | 113163170 | 113323600 | 160430 | gain | 2616 | SLC16A1 | 809 |
| 1 | 151459627 | 151463425 | 3798 | loss | 7 | | 810 |
| 1 | 151459627 | 151463425 | 3798 | loss | 73 | | 810 |
| 1 | 151459627 | 151463425 | 3798 | loss | 136 | | 810 |
| 1 | 151459627 | 151463425 | 3798 | loss | 201 | | 810 |
| 1 | 151459627 | 151463425 | 3798 | loss | 393 | | 810 |
| 1 | 151459627 | 151463425 | 3798 | loss | 513 | | 810 |
| 1 | 151459627 | 151463425 | 3798 | loss | 731 | | 810 |
| 1 | 153872608 | 153992044 | 119436 | loss | 2206 | DAP3, GON4L, MSTO2P | 811 |
| 2 | 18050278 | 18056693 | 6415 | gain | 2191 | | 812 |
| 2 | 18025972 | 18056693 | 30721 | gain | 2260 | | 813 |
| 2 | 18025972 | 18056693 | 30721 | gain | 2491 | | 813 |
| 2 | 18050278 | 18115172 | 64894 | loss | 2593 | | 814 |
| 2 | 24455322 | 24462631 | 7309 | loss | 2 | | 815 |

Figure 8D

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 2 | 24455322 | 24462631 | 7309 | loss | 29 | | 815 |
| 2 | 24455322 | 24467164 | 11842 | loss | 83 | | 816 |
| 2 | 24455322 | 24462631 | 7309 | loss | 95 | | 815 |
| 2 | 24455322 | 24467164 | 11842 | loss | 98 | | 816 |
| 2 | 24455322 | 24467164 | 11842 | loss | 140 | | 816 |
| 2 | 24455322 | 24467164 | 11842 | loss | 219 | | 816 |
| 2 | 24455322 | 24462631 | 7309 | loss | 291 | | 815 |
| 2 | 24455322 | 24462631 | 7309 | loss | 355 | | 815 |
| 2 | 24455322 | 24462631 | 7309 | loss | 425 | | 815 |
| 2 | 24455322 | 24462631 | 7309 | loss | 535 | | 815 |
| 2 | 24455322 | 24462631 | 7309 | loss | 537 | | 815 |
| 2 | 24455322 | 24462631 | 7309 | loss | 538 | | 815 |
| 2 | 24455322 | 24462631 | 7309 | loss | 543 | | 815 |
| 2 | 24455322 | 24462631 | 7309 | loss | 564 | | 815 |
| 2 | 24455322 | 24462631 | 7309 | loss | 581 | | 815 |
| 2 | 24455322 | 24462631 | 7309 | loss | 583 | | 815 |
| 2 | 24455322 | 24462631 | 7309 | loss | 592 | | 815 |
| 2 | 24455322 | 24467164 | 11842 | loss | 601 | | 816 |
| 2 | 24455322 | 24462631 | 7309 | loss | 607 | | 815 |
| 2 | 24455322 | 24462631 | 7309 | loss | 632 | | 815 |
| 2 | 24455322 | 24462631 | 7309 | loss | 641 | | 815 |
| 2 | 24455322 | 24462631 | 7309 | loss | 666 | | 815 |
| 2 | 24455322 | 24462631 | 7309 | loss | 671 | | 815 |
| 2 | 24455322 | 24471101 | 15779 | loss | 718 | | 817 |
| 2 | 24455322 | 24467164 | 11842 | loss | 721 | | 816 |
| 2 | 24455322 | 24462631 | 7309 | loss | 729 | | 815 |
| 2 | 24455322 | 24462631 | 7309 | loss | 731 | | 815 |
| 2 | 24455322 | 24462631 | 7309 | loss | 736 | | 815 |
| 2 | 24455322 | 24462631 | 7309 | loss | 774 | | 815 |
| 2 | 24455322 | 24462631 | 7309 | loss | 815 | | 815 |
| 2 | 24455322 | 24462631 | 7309 | loss | 828 | | 815 |
| 2 | 24455322 | 24462631 | 7309 | loss | 832 | | 815 |
| 2 | 24455322 | 24462631 | 7309 | loss | 840 | | 815 |
| 2 | 24455322 | 24462631 | 7309 | loss | 860 | | 815 |
| 2 | 24455322 | 24462631 | 7309 | loss | 861 | | 815 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 2 | 24455322 | 24462631 | 7309 | loss | 872 | | 815 |
| 2 | 24455322 | 24462631 | 7309 | loss | 874 | | 815 |
| 2 | 24455322 | 24462631 | 7309 | loss | 878 | | 815 |
| 2 | 24455322 | 24462631 | 7309 | loss | 886 | | 815 |
| 2 | 24455322 | 24462631 | 7309 | loss | 891 | | 815 |
| 2 | 24455322 | 24462631 | 7309 | loss | 895 | | 815 |
| 2 | 24455322 | 24462631 | 7309 | loss | 898 | | 815 |
| 2 | 24455322 | 24462631 | 7309 | loss | 905 | | 815 |
| 2 | 24455322 | 24462631 | 7309 | loss | 906 | | 815 |
| 2 | 24455322 | 24462631 | 7309 | loss | 910 | | 815 |
| 2 | 24455322 | 24462631 | 7309 | loss | 934 | | 815 |
| 2 | 24455322 | 24462631 | 7309 | loss | 935 | | 815 |
| 2 | 24455322 | 24462631 | 7309 | loss | 1163 | | 815 |
| 2 | 24455322 | 24462631 | 7309 | loss | 1188 | | 815 |
| 2 | 24455322 | 24462631 | 7309 | loss | 2292 | | 815 |
| 2 | 24455322 | 24462631 | 7309 | loss | 2448 | | 815 |
| 2 | 24455322 | 24462631 | 7309 | loss | 2460 | | 815 |
| 2 | 24455322 | 24462631 | 7309 | loss | 2501 | | 815 |
| 2 | 24455322 | 24462631 | 7309 | loss | 2516 | | 815 |
| 2 | 24455322 | 24462631 | 7309 | loss | 2519 | | 815 |
| 2 | 24455322 | 24462631 | 7309 | loss | 2534 | | 815 |
| 2 | 24455322 | 24462631 | 7309 | loss | 2622 | | 815 |
| 2 | 24455322 | 24462631 | 7309 | loss | 2628 | | 815 |
| 2 | 32484470 | 33185508 | 701038 | gain | 323 | LINC00486, LOC100271832, LTBP1 | 818 |
| 2 | 32484470 | 33185508 | 701038 | gain | 664 | LINC00486,LOC100271832,LTBP1 | 818 |
| 2 | 32484470 | 33185508 | 701038 | gain | 1180 | LINC00486,LOC100271832,LTBP1 | 818 |
| 2 | 32484470 | 33185508 | 701038 | gain | 2057 | LINC00486,LOC100271832,LT | 818 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| | | | | | | BP1 | |
| 2 | 32484470 | 33185508 | 701038 | gain | 2281 | LINC00486,LOC100271832,LTBP1 | 818 |
| 2 | 32484470 | 33185508 | 701038 | gain | 2427 | LINC00486,LOC100271832,LTBP1 | 818 |
| 2 | 44371811 | 44398519 | 26708 | gain | 135 | PREPL,SLC3A1 | 819 |
| 2 | 44368336 | 44398519 | 30183 | gain | 461 | PREPL,SLC3A1 | 820 |
| 2 | 44362881 | 44398519 | 35638 | loss | 541 | PREPL,SLC3A1 | 821 |
| 2 | 44368336 | 44398519 | 30183 | gain | 615 | PREPL,SLC3A1 | 820 |
| 2 | 44371811 | 44398519 | 26708 | gain | 627 | PREPL,SLC3A1 | 819 |
| 2 | 44371811 | 44398519 | 26708 | gain | 710 | PREPL,SLC3A1 | 819 |
| 2 | 44371811 | 44398519 | 26708 | gain | 881 | PREPL,SLC3A1 | 819 |
| 2 | 88914081 | 88949759 | 35678 | loss | 2246 | | 822 |
| 2 | 88914081 | 88948348 | 34267 | loss | 2440 | | 823 |
| 2 | 88914081 | 89231629 | 317548 | loss | 2584 | | 824 |
| 2 | 88914081 | 88949759 | 35678 | loss | 2246 | | 822 |
| 2 | 88914081 | 88948348 | 34267 | loss | 2440 | | 823 |
| 2 | 88914081 | 89231629 | 317548 | loss | 2584 | | 824 |
| 2 | 88944977 | 89093646 | 148669 | loss | 2615 | | 825 |
| 2 | 88953798 | 89013440 | 59642 | loss | 2246 | | 826 |
| 2 | 88949759 | 89013440 | 63681 | loss | 2440 | | 827 |
| 2 | 88914081 | 89231629 | 317548 | loss | 2584 | | 824 |
| 2 | 88944977 | 89093646 | 148669 | loss | 2615 | | 825 |
| 2 | 214807911 | 214828475 | 20564 | gain | 149 | SPAG16 | 828 |
| 2 | 214807911 | 214828475 | 20564 | gain | 646 | SPAG16 | 828 |
| 2 | 214807911 | 214828475 | 20564 | gain | 668 | SPAG16 | 828 |
| 2 | 214807911 | 214828475 | 20564 | gain | 756 | SPAG16 | 828 |
| 2 | 214807911 | 214828475 | 20564 | gain | 780 | SPAG16 | 828 |
| 2 | 214807911 | 214828475 | 20564 | gain | 923 | SPAG16 | 828 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 2 | 214807911 | 214828475 | 20564 | gain | 1206 | SPAG16 | 828 |
| 3 | 641257 | 1327726 | 686469 | gain | 2277 | | 829 |
| 3 | 701645 | 1095841 | 394196 | loss | 2369 | | 830 |
| 3 | 11386892 | 11389624 | 2732 | loss | 24 | ATG7 | 831 |
| 3 | 11386892 | 11389624 | 2732 | loss | 57 | ATG7 | 831 |
| 3 | 11386892 | 11389624 | 2732 | loss | 72 | ATG7 | 831 |
| 3 | 11386892 | 11389624 | 2732 | loss | 73 | ATG7 | 831 |
| 3 | 11386892 | 11389624 | 2732 | loss | 151 | ATG7 | 831 |
| 3 | 11386892 | 11389624 | 2732 | loss | 177 | ATG7 | 831 |
| 3 | 11386892 | 11389624 | 2732 | loss | 182 | ATG7 | 831 |
| 3 | 11386892 | 11389624 | 2732 | loss | 186 | ATG7 | 831 |
| 3 | 11386892 | 11389624 | 2732 | loss | 188 | ATG7 | 831 |
| 3 | 11386892 | 11389624 | 2732 | loss | 192 | ATG7 | 831 |
| 3 | 11386892 | 11389624 | 2732 | loss | 201 | ATG7 | 831 |
| 3 | 11386892 | 11389624 | 2732 | loss | 203 | ATG7 | 831 |
| 3 | 11386892 | 11389624 | 2732 | loss | 219 | ATG7 | 831 |
| 3 | 11386892 | 11389624 | 2732 | loss | 246 | ATG7 | 831 |
| 3 | 11386892 | 11389624 | 2732 | loss | 266 | ATG7 | 831 |
| 3 | 11386892 | 11389624 | 2732 | loss | 267 | ATG7 | 831 |
| 3 | 11386892 | 11389624 | 2732 | loss | 325 | ATG7 | 831 |
| 3 | 11386892 | 11389624 | 2732 | loss | 329 | ATG7 | 831 |
| 3 | 11386892 | 11389624 | 2732 | loss | 384 | ATG7 | 831 |
| 3 | 11386892 | 11389624 | 2732 | loss | 413 | ATG7 | 831 |
| 3 | 11386892 | 11389624 | 2732 | loss | 419 | ATG7 | 831 |
| 3 | 11386892 | 11389624 | 2732 | loss | 461 | ATG7 | 831 |
| 3 | 11386892 | 11389624 | 2732 | loss | 467 | ATG7 | 831 |
| 3 | 11386892 | 11389624 | 2732 | loss | 481 | ATG7 | 831 |
| 3 | 11386892 | 11389624 | 2732 | loss | 493 | ATG7 | 831 |
| 3 | 11386892 | 11389624 | 2732 | loss | 498 | ATG7 | 831 |
| 3 | 11386892 | 11389624 | 2732 | loss | 510 | ATG7 | 831 |
| 3 | 11386892 | 11389624 | 2732 | loss | 544 | ATG7 | 831 |
| 3 | 11386892 | 11389624 | 2732 | loss | 561 | ATG7 | 831 |
| 3 | 11386892 | 11389624 | 2732 | loss | 574 | ATG7 | 831 |
| 3 | 11386892 | 11389624 | 2732 | loss | 599 | ATG7 | 831 |
| 3 | 11386892 | 11389624 | 2732 | loss | 685 | ATG7 | 831 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 3 | 11386892 | 11389624 | 2732 | loss | 729 | ATG7 | 831 |
| 3 | 11386892 | 11389624 | 2732 | loss | 743 | ATG7 | 831 |
| 3 | 11386892 | 11389624 | 2732 | loss | 804 | ATG7 | 831 |
| 3 | 11386892 | 11389624 | 2732 | loss | 821 | ATG7 | 831 |
| 3 | 11386892 | 11389624 | 2732 | loss | 855 | ATG7 | 831 |
| 3 | 11386892 | 11389624 | 2732 | loss | 893 | ATG7 | 831 |
| 3 | 11386892 | 11389624 | 2732 | loss | 922 | ATG7 | 831 |
| 3 | 11386892 | 11389624 | 2732 | loss | 935 | ATG7 | 831 |
| 3 | 11386892 | 11389624 | 2732 | loss | 936 | ATG7 | 831 |
| 3 | 11386892 | 11389624 | 2732 | loss | 1170 | ATG7 | 831 |
| 3 | 11386892 | 11389624 | 2732 | loss | 1177 | ATG7 | 831 |
| 3 | 11386892 | 11389624 | 2732 | loss | 1178 | ATG7 | 831 |
| 3 | 11386892 | 11389624 | 2732 | loss | 1185 | ATG7 | 831 |
| 3 | 11386892 | 11389624 | 2732 | loss | 1214 | ATG7 | 831 |
| 3 | 11386892 | 11389624 | 2732 | loss | 2213 | ATG7 | 831 |
| 3 | 11386892 | 11389624 | 2732 | loss | 2270 | ATG7 | 831 |
| 3 | 11386892 | 11389624 | 2732 | loss | 2274 | ATG7 | 831 |
| 3 | 11386892 | 11389624 | 2732 | loss | 2360 | ATG7 | 831 |
| 3 | 11386892 | 11389624 | 2732 | loss | 2418 | ATG7 | 831 |
| 3 | 11386892 | 11389624 | 2732 | loss | 2486 | ATG7 | 831 |
| 3 | 11386892 | 11389624 | 2732 | loss | 2561 | ATG7 | 831 |
| 3 | 11386892 | 11389624 | 2732 | loss | 2596 | ATG7 | 831 |
| 3 | 11386892 | 11389624 | 2732 | loss | 2611 | ATG7 | 831 |
| 3 | 48636299 | 48676237 | 39938 | loss | 2591 | CELSR3, MIR4793,SLC26A6 | 832 |
| 3 | 162255354 | 162259312 | 3958 | loss | 136 | PPM1L | 833 |
| 3 | 162255354 | 162259312 | 3958 | loss | 287 | PPM1L | 833 |
| 3 | 162255354 | 162259312 | 3958 | loss | 339 | PPM1L | 833 |
| 3 | 162255354 | 162259312 | 3958 | loss | 407 | PPM1L | 833 |
| 3 | 162255354 | 162259312 | 3958 | loss | 418 | PPM1L | 833 |
| 3 | 162255354 | 162259312 | 3958 | loss | 496 | PPM1L | 833 |
| 3 | 162255354 | 162259312 | 3958 | loss | 907 | PPM1L | 833 |
| 3 | 172587026 | 172812104 | 225078 | gain | 2053 | PLD1,TNIK | 834 |
| 4 | 21662924 | 21676485 | 13561 | loss | 96 | | 835 |
| 4 | 21662924 | 21676485 | 13561 | loss | 394 | | 835 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 4 | 21662924 | 21676485 | 13561 | loss | 482 | | 835 |
| 4 | 21662924 | 21676485 | 13561 | loss | 575 | | 835 |
| 4 | 21662924 | 21676485 | 13561 | loss | 694 | | 835 |
| 4 | 21662924 | 21676485 | 13561 | loss | 746 | | 835 |
| 4 | 21662924 | 21676485 | 13561 | loss | 755 | | 835 |
| 4 | 21662924 | 21676485 | 13561 | loss | 823 | | 835 |
| 4 | 21662924 | 21676485 | 13561 | loss | 913 | | 835 |
| 4 | 21662924 | 21676485 | 13561 | loss | 920 | | 835 |
| 4 | 21662924 | 21676485 | 13561 | loss | 945 | | 835 |
| 4 | 21662924 | 21676485 | 13561 | loss | 1193 | | 835 |
| 4 | 21662924 | 21676485 | 13561 | loss | 2251 | | 835 |
| 4 | 40264490 | 40267639 | 3149 | loss | 84 | RBM47 | 836 |
| 4 | 40264490 | 40267639 | 3149 | loss | 179 | RBM47 | 836 |
| 4 | 40264490 | 40267639 | 3149 | loss | 336 | RBM47 | 836 |
| 4 | 40264490 | 40267639 | 3149 | loss | 340 | RBM47 | 836 |
| 4 | 40264490 | 40267639 | 3149 | loss | 381 | RBM47 | 836 |
| 4 | 40264490 | 40267639 | 3149 | loss | 397 | RBM47 | 836 |
| 4 | 40264490 | 40267639 | 3149 | loss | 433 | RBM47 | 836 |
| 4 | 40264490 | 40267639 | 3149 | loss | 478 | RBM47 | 836 |
| 4 | 40264490 | 40267639 | 3149 | loss | 501 | RBM47 | 836 |
| 4 | 40264490 | 40267639 | 3149 | loss | 521 | RBM47 | 836 |
| 4 | 40264490 | 40267639 | 3149 | loss | 546 | RBM47 | 836 |
| 4 | 40264490 | 40267639 | 3149 | loss | 556 | RBM47 | 836 |
| 4 | 40264490 | 40267639 | 3149 | loss | 560 | RBM47 | 836 |
| 4 | 40264490 | 40267639 | 3149 | loss | 595 | RBM47 | 836 |
| 4 | 40264490 | 40267639 | 3149 | loss | 611 | RBM47 | 836 |
| 4 | 40264490 | 40267639 | 3149 | loss | 655 | RBM47 | 836 |
| 4 | 40264490 | 40271184 | 6694 | loss | 662 | RBM47 | 837 |
| 4 | 40264490 | 40267639 | 3149 | loss | 768 | RBM47 | 836 |
| 4 | 40264490 | 40267639 | 3149 | loss | 780 | RBM47 | 836 |
| 4 | 40264490 | 40267639 | 3149 | loss | 855 | RBM47 | 836 |
| 4 | 40264490 | 40267639 | 3149 | loss | 1168 | RBM47 | 836 |
| 4 | 40264490 | 40267639 | 3149 | loss | 1194 | RBM47 | 836 |
| 4 | 40264490 | 40267639 | 3149 | loss | 2188 | RBM47 | 836 |
| 4 | 40264490 | 40267639 | 3149 | loss | 2264 | RBM47 | 836 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 4 | 40264490 | 40267639 | 3149 | loss | 2435 | RBM47 | 836 |
| 4 | 40264490 | 40267639 | 3149 | loss | 2617 | RBM47 | 836 |
| 4 | 73200621 | 73213381 | 12760 | gain | 2434 | NPFFR2 | 838 |
| 4 | 92499781 | 92501024 | 1243 | loss | 330 | CCSER1 | 839 |
| 4 | 91067941 | 94122361 | 3054420 | gain | 383 | CCSER1 | 840 |
| 4 | 92499781 | 92501024 | 1243 | loss | 618 | CCSER1 | 839 |
| 4 | 92499781 | 92501024 | 1243 | loss | 647 | CCSER1 | 839 |
| 4 | 92499781 | 92501024 | 1243 | loss | 667 | CCSER1 | 839 |
| 4 | 92499781 | 92501024 | 1243 | loss | 679 | CCSER1 | 839 |
| 4 | 92499781 | 92501024 | 1243 | loss | 688 | CCSER1 | 839 |
| 4 | 92499781 | 92501024 | 1243 | loss | 708 | CCSER1 | 839 |
| 4 | 92499781 | 92501024 | 1243 | loss | 717 | CCSER1 | 839 |
| 4 | 92499781 | 92501024 | 1243 | loss | 798 | CCSER1 | 839 |
| 4 | 92499781 | 92501024 | 1243 | loss | 814 | CCSER1 | 839 |
| 4 | 92499781 | 92501024 | 1243 | loss | 861 | CCSER1 | 839 |
| 4 | 92499781 | 92501024 | 1243 | loss | 862 | CCSER1 | 839 |
| 4 | 92499781 | 92501024 | 1243 | loss | 907 | CCSER1 | 839 |
| 4 | 92499781 | 92501024 | 1243 | loss | 1194 | CCSER1 | 839 |
| 4 | 92499781 | 92501024 | 1243 | loss | 2058 | CCSER1 | 839 |
| 5 | 2093610 | 2117301 | 23691 | loss | 75 | | 841 |
| 5 | 2093610 | 2117301 | 23691 | loss | 95 | | 841 |
| 5 | 2093610 | 2117301 | 23691 | loss | 101 | | 841 |
| 5 | 2093610 | 2117301 | 23691 | loss | 410 | | 841 |
| 5 | 2093610 | 2117301 | 23691 | loss | 749 | | 841 |
| 5 | 2093610 | 2117301 | 23691 | loss | 843 | | 841 |
| 5 | 17397258 | 17409796 | 12538 | loss | 31 | | 842 |
| 5 | 17397258 | 17409796 | 12538 | loss | 41 | | 842 |
| 5 | 17397258 | 17409796 | 12538 | loss | 70 | | 842 |
| 5 | 17397258 | 17409796 | 12538 | loss | 92 | | 842 |
| 5 | 17397258 | 17409796 | 12538 | loss | 100 | | 842 |
| 5 | 17397258 | 17409796 | 12538 | loss | 126 | | 842 |
| 5 | 17397258 | 17409796 | 12538 | loss | 169 | | 842 |
| 5 | 17397258 | 17409796 | 12538 | loss | 190 | | 842 |
| 5 | 17397258 | 17409796 | 12538 | loss | 205 | | 842 |
| 5 | 17397258 | 17409796 | 12538 | loss | 266 | | 842 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 5 | 17397258 | 17409796 | 12538 | loss | 275 | | 842 |
| 5 | 17397258 | 17409796 | 12538 | loss | 439 | | 842 |
| 5 | 17397258 | 17409796 | 12538 | loss | 586 | | 842 |
| 5 | 17397258 | 17409796 | 12538 | loss | 602 | | 842 |
| 5 | 17397258 | 17409796 | 12538 | loss | 713 | | 842 |
| 5 | 17397258 | 17409796 | 12538 | loss | 731 | | 842 |
| 5 | 17397258 | 17409796 | 12538 | loss | 738 | | 842 |
| 5 | 17397258 | 17409796 | 12538 | loss | 747 | | 842 |
| 5 | 17397258 | 17409796 | 12538 | loss | 805 | | 842 |
| 5 | 17397258 | 17409796 | 12538 | loss | 808 | | 842 |
| 5 | 17397258 | 17409796 | 12538 | loss | 824 | | 842 |
| 5 | 17397258 | 17409796 | 12538 | loss | 864 | | 842 |
| 5 | 17397258 | 17409796 | 12538 | loss | 875 | | 842 |
| 5 | 17397258 | 17409796 | 12538 | loss | 880 | | 842 |
| 5 | 17397258 | 17409796 | 12538 | loss | 887 | | 842 |
| 5 | 17397258 | 17409796 | 12538 | loss | 905 | | 842 |
| 5 | 17397258 | 17409796 | 12538 | loss | 914 | | 842 |
| 5 | 17397258 | 17409796 | 12538 | loss | 943 | | 842 |
| 5 | 17397258 | 17409796 | 12538 | loss | 1176 | | 842 |
| 5 | 17397258 | 17409796 | 12538 | loss | 1190 | | 842 |
| 5 | 17397258 | 17409796 | 12538 | loss | 2172 | | 842 |
| 5 | 17397258 | 17409796 | 12538 | loss | 2220 | | 842 |
| 5 | 17397258 | 17409796 | 12538 | loss | 2600 | | 842 |
| 5 | 22612750 | 22764867 | 152117 | loss | 704 | CDH12 | 843 |
| 5 | 22719259 | 22758666 | 39407 | gain | 2401 | CDH12 | 844 |
| 5 | 113625639 | 113683448 | 57809 | loss | 2253 | | 845 |
| 5 | 113625639 | 113683448 | 57809 | loss | 2627 | | 845 |
| 6 | 52727873 | 52793393 | 65520 | loss | 78 | GSTA2 | 846 |
| 6 | 52735825 | 52758917 | 23092 | loss | 96 | GSTA2 | 847 |
| 6 | 52735825 | 52758917 | 23092 | loss | 434 | GSTA2 | 847 |
| 6 | 52727873 | 52793393 | 65520 | loss | 771 | GSTA2 | 846 |
| 6 | 52735825 | 52760603 | 24778 | loss | 1203 | GSTA2 | 848 |
| 6 | 162638508 | 162834610 | 196102 | gain | 35 | PARK2 | 849 |
| 6 | 162587578 | 162754618 | 167040 | loss | 369 | PARK2 | 850 |
| 6 | 162638508 | 162834610 | 196102 | gain | 571 | PARK2 | 849 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 6 | 162579968 | 163048402 | 468434 | loss | 629 | PARK2 | 851 |
| 6 | 162647400 | 162760110 | 112710 | gain | 636 | PARK2 | 852 |
| 6 | 162638508 | 162834610 | 196102 | gain | 1201 | PARK2 | 849 |
| 6 | 162473616 | 162716462 | 242846 | loss | 2237 | PARK2 | 853 |
| 7 | 3524008 | 3573608 | 49600 | loss | 2341 | SDK1 | 854 |
| 7 | 14979840 | 15000000 | 20160 | gain | 46 | | 855 |
| 7 | 14979840 | 15000000 | 20160 | gain | 84 | | 855 |
| 7 | 14979840 | 15000000 | 20160 | gain | 183 | | 855 |
| 7 | 14979840 | 15000000 | 20160 | gain | 224 | | 855 |
| 7 | 14979840 | 15000000 | 20160 | gain | 256 | | 855 |
| 7 | 14979840 | 15000000 | 20160 | gain | 270 | | 855 |
| 7 | 14979840 | 15000000 | 20160 | gain | 554 | | 855 |
| 7 | 110983862 | 111069280 | 85418 | gain | 82 | | 856 |
| 7 | 111031308 | 111035453 | 4145 | loss | 110 | | 857 |
| 7 | 110625485 | 111100796 | 475311 | loss | 192 | | 858 |
| 7 | 110711620 | 111042735 | 331115 | gain | 304 | | 859 |
| 7 | 111031308 | 111045739 | 14431 | gain | 417 | | 860 |
| 7 | 110841345 | 111149346 | 308001 | loss | 477 | | 861 |
| 7 | 110800031 | 111073547 | 273516 | loss | 480 | | 862 |
| 7 | 110981833 | 111067670 | 85837 | gain | 680 | | 863 |
| 7 | 110690021 | 111113072 | 423051 | loss | 1167 | | 864 |
| 7 | 131426580 | 131429932 | 3352 | loss | 113 | | 865 |
| 7 | 131426580 | 131429932 | 3352 | loss | 140 | | 865 |
| 7 | 131426580 | 131429932 | 3352 | loss | 141 | | 865 |
| 7 | 131426580 | 131429932 | 3352 | loss | 201 | | 865 |
| 7 | 131426580 | 131429932 | 3352 | loss | 212 | | 865 |
| 7 | 131426580 | 131429932 | 3352 | loss | 241 | | 865 |
| 7 | 131426580 | 131429932 | 3352 | loss | 284 | | 865 |
| 7 | 131426580 | 131428130 | 1550 | loss | 319 | | 866 |
| 7 | 131426580 | 131429932 | 3352 | loss | 353 | | 865 |
| 7 | 131426580 | 131429932 | 3352 | loss | 443 | | 865 |
| 7 | 131426580 | 131429932 | 3352 | loss | 521 | | 865 |
| 7 | 131426580 | 131429932 | 3352 | loss | 544 | | 865 |
| 7 | 131426580 | 131429932 | 3352 | loss | 570 | | 865 |
| 7 | 131426580 | 131429932 | 3352 | loss | 581 | | 865 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 7 | 131426580 | 131429932 | 3352 | loss | 584 | | 865 |
| 7 | 131426580 | 131429932 | 3352 | loss | 680 | | 865 |
| 7 | 131426580 | 131429932 | 3352 | loss | 866 | | 865 |
| 7 | 131426580 | 131428130 | 1550 | loss | 906 | | 866 |
| 7 | 131426580 | 131429932 | 3352 | loss | 1171 | | 865 |
| 7 | 131426580 | 131429932 | 3352 | loss | 1188 | | 865 |
| 7 | 131426580 | 131429932 | 3352 | loss | 2391 | | 865 |
| 7 | 131426580 | 131429932 | 3352 | loss | 2558 | | 865 |
| 7 | 131426580 | 131429932 | 3352 | loss | 2576 | | 865 |
| 8 | 15990019 | 16067927 | 77908 | loss | 58 | MSR1 | 867 |
| 8 | 15990019 | 16067927 | 77908 | loss | 60 | MSR1 | 867 |
| 8 | 15990019 | 16067927 | 77908 | loss | 187 | MSR1 | 867 |
| 8 | 16007459 | 16090243 | 82784 | loss | 335 | MSR1 | 868 |
| 8 | 15990019 | 16067927 | 77908 | loss | 465 | MSR1 | 867 |
| 8 | 15990019 | 16067927 | 77908 | loss | 557 | MSR1 | 867 |
| 8 | 15990019 | 16067927 | 77908 | loss | 577 | MSR1 | 867 |
| 8 | 15990019 | 16067927 | 77908 | loss | 757 | MSR1 | 867 |
| 8 | 15990019 | 16067927 | 77908 | loss | 1172 | MSR1 | 867 |
| 8 | 131071806 | 131078251 | 6445 | gain | 2360 | FAM49B | 869 |
| 8 | 131019559 | 131141060 | 121501 | gain | 2611 | FAM49B | 870 |
| 8 | 131071806 | 131080474 | 8668 | gain | 2622 | FAM49B | 871 |
| 8 | 131071806 | 131074181 | 2375 | gain | 2626 | FAM49B | 872 |
| 9 | 73101325 | 73139210 | 37885 | loss | 82 | | 873 |
| 9 | 73135012 | 73139210 | 4198 | loss | 98 | | 874 |
| 9 | 73135012 | 73139210 | 4198 | loss | 110 | | 874 |
| 9 | 73135012 | 73139210 | 4198 | loss | 184 | | 874 |
| 9 | 73135012 | 73139210 | 4198 | loss | 206 | | 874 |
| 9 | 73135012 | 73139210 | 4198 | loss | 234 | | 874 |
| 9 | 73135012 | 73139210 | 4198 | loss | 258 | | 874 |
| 9 | 73135012 | 73139210 | 4198 | loss | 264 | | 874 |
| 9 | 73135012 | 73139210 | 4198 | loss | 308 | | 874 |
| 9 | 73135012 | 73139210 | 4198 | loss | 404 | | 874 |
| 9 | 73135012 | 73139210 | 4198 | loss | 511 | | 874 |
| 9 | 73135012 | 73139210 | 4198 | loss | 608 | | 874 |
| 9 | 73135012 | 73139210 | 4198 | loss | 668 | | 874 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 9 | 73135012 | 73139210 | 4198 | loss | 724 | | 874 |
| 9 | 73135012 | 73139210 | 4198 | loss | 754 | | 874 |
| 9 | 73135012 | 73139210 | 4198 | loss | 825 | | 874 |
| 9 | 73135012 | 73139210 | 4198 | loss | 861 | | 874 |
| 9 | 73135012 | 73139210 | 4198 | loss | 1167 | | 874 |
| 9 | 73135012 | 73139210 | 4198 | loss | 2223 | | 874 |
| 9 | 73135012 | 73139210 | 4198 | loss | 2434 | | 874 |
| 9 | 86190067 | 86196526 | 6459 | loss | 9 | | 875 |
| 9 | 86192876 | 86196526 | 3650 | loss | 45 | | 876 |
| 9 | 86192876 | 86196526 | 3650 | loss | 102 | | 876 |
| 9 | 86190067 | 86196526 | 6459 | loss | 109 | | 875 |
| 9 | 86190067 | 86196526 | 6459 | loss | 181 | | 875 |
| 9 | 86190067 | 86196526 | 6459 | loss | 202 | | 875 |
| 9 | 86190067 | 86196526 | 6459 | loss | 253 | | 875 |
| 9 | 86190067 | 86196526 | 6459 | loss | 332 | | 875 |
| 9 | 86190067 | 86196526 | 6459 | loss | 339 | | 875 |
| 9 | 86190067 | 86196526 | 6459 | loss | 340 | | 875 |
| 9 | 86190067 | 86196526 | 6459 | loss | 358 | | 875 |
| 9 | 86190067 | 86196526 | 6459 | loss | 545 | | 875 |
| 9 | 86190067 | 86196526 | 6459 | loss | 608 | | 875 |
| 9 | 86192876 | 86196526 | 3650 | loss | 618 | | 876 |
| 9 | 86192876 | 86196526 | 3650 | loss | 664 | | 876 |
| 9 | 86192876 | 86196526 | 3650 | loss | 784 | | 876 |
| 9 | 86192876 | 86196526 | 3650 | loss | 785 | | 876 |
| 9 | 86190067 | 86196526 | 6459 | loss | 899 | | 875 |
| 9 | 86190067 | 86196526 | 6459 | loss | 928 | | 875 |
| 9 | 86190067 | 86196526 | 6459 | loss | 2343 | | 875 |
| 9 | 86192876 | 86196526 | 3650 | loss | 2508 | | 876 |
| 9 | 134613502 | 134616971 | 3469 | loss | 31 | AK8 | 877 |
| 9 | 134613502 | 134616971 | 3469 | loss | 78 | AK8 | 877 |
| 9 | 134613502 | 134616971 | 3469 | loss | 111 | AK8 | 877 |
| 9 | 134613502 | 134616971 | 3469 | loss | 114 | AK8 | 877 |
| 9 | 134613502 | 134616971 | 3469 | loss | 136 | AK8 | 877 |
| 9 | 134613502 | 134616971 | 3469 | loss | 161 | AK8 | 877 |
| 9 | 134613502 | 134616971 | 3469 | loss | 170 | AK8 | 877 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 9 | 134613502 | 134616971 | 3469 | loss | 209 | AK8 | 877 |
| 9 | 134613502 | 134616971 | 3469 | loss | 236 | AK8 | 877 |
| 9 | 134613502 | 134616971 | 3469 | loss | 261 | AK8 | 877 |
| 9 | 134613502 | 134616971 | 3469 | loss | 299 | AK8 | 877 |
| 9 | 134613502 | 134616971 | 3469 | loss | 422 | AK8 | 877 |
| 9 | 134613502 | 134616971 | 3469 | loss | 424 | AK8 | 877 |
| 9 | 134613502 | 134616971 | 3469 | loss | 464 | AK8 | 877 |
| 9 | 134579586 | 134729475 | 149889 | gain | 468 | AK8 | 878 |
| 9 | 134613502 | 134616971 | 3469 | loss | 477 | AK8 | 877 |
| 9 | 134613502 | 134616971 | 3469 | loss | 491 | AK8 | 877 |
| 9 | 134613502 | 134616971 | 3469 | loss | 504 | AK8 | 877 |
| 9 | 134613502 | 134616971 | 3469 | loss | 530 | AK8 | 877 |
| 9 | 134613502 | 134616971 | 3469 | loss | 598 | AK8 | 877 |
| 9 | 134613502 | 134616971 | 3469 | loss | 629 | AK8 | 877 |
| 9 | 134613502 | 134616971 | 3469 | loss | 632 | AK8 | 877 |
| 9 | 134613502 | 134616971 | 3469 | loss | 649 | AK8 | 877 |
| 9 | 134613502 | 134616971 | 3469 | loss | 662 | AK8 | 877 |
| 9 | 134613502 | 134616971 | 3469 | loss | 691 | AK8 | 877 |
| 9 | 134613502 | 134616971 | 3469 | loss | 730 | AK8 | 877 |
| 9 | 134613502 | 134616971 | 3469 | loss | 831 | AK8 | 877 |
| 9 | 134579586 | 134729475 | 149889 | gain | 852 | AK8 | 878 |
| 9 | 134613502 | 134616971 | 3469 | loss | 891 | AK8 | 877 |
| 9 | 134613502 | 134616971 | 3469 | loss | 918 | AK8 | 877 |
| 9 | 134613502 | 134616971 | 3469 | loss | 1171 | AK8 | 877 |
| 9 | 134613502 | 134616971 | 3469 | loss | 1183 | AK8 | 877 |
| 9 | 134613502 | 134616971 | 3469 | loss | 1217 | AK8 | 877 |
| 9 | 134613502 | 134616971 | 3469 | loss | 2054 | AK8 | 877 |
| 9 | 134613502 | 134616971 | 3469 | loss | 2182 | AK8 | 877 |
| 9 | 134613502 | 134616971 | 3469 | loss | 2291 | AK8 | 877 |
| 9 | 134613502 | 134616971 | 3469 | loss | 2298 | AK8 | 877 |
| 9 | 134613502 | 134616971 | 3469 | loss | 2371 | AK8 | 877 |
| 9 | 134613502 | 134616971 | 3469 | loss | 2458 | AK8 | 877 |
| 9 | 134613502 | 134616971 | 3469 | loss | 2522 | AK8 | 877 |
| 9 | 138787852 | 138794487 | 6635 | loss | 80 | | 879 |
| 9 | 138787852 | 138794487 | 6635 | loss | 106 | | 879 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 9 | 138787852 | 138794487 | 6635 | loss | 124 | | 879 |
| 9 | 138787852 | 138794487 | 6635 | loss | 145 | | 879 |
| 9 | 138787852 | 138794487 | 6635 | loss | 147 | | 879 |
| 9 | 138787852 | 138794487 | 6635 | loss | 173 | | 879 |
| 9 | 138787852 | 138794487 | 6635 | loss | 189 | | 879 |
| 9 | 138787852 | 138794487 | 6635 | loss | 200 | | 879 |
| 9 | 138787852 | 138794487 | 6635 | loss | 201 | | 879 |
| 9 | 138787852 | 138794487 | 6635 | loss | 242 | | 879 |
| 9 | 138787852 | 138794487 | 6635 | loss | 252 | | 879 |
| 9 | 138787852 | 138794487 | 6635 | loss | 290 | | 879 |
| 9 | 138787852 | 138794487 | 6635 | loss | 292 | | 879 |
| 9 | 138787852 | 138794487 | 6635 | loss | 336 | | 879 |
| 9 | 138787852 | 138794487 | 6635 | loss | 367 | | 879 |
| 9 | 138787852 | 138794487 | 6635 | loss | 429 | | 879 |
| 9 | 138787852 | 138794487 | 6635 | loss | 445 | | 879 |
| 9 | 138784932 | 138794487 | 9555 | loss | 486 | | 880 |
| 9 | 138787852 | 138794487 | 6635 | loss | 489 | | 879 |
| 9 | 138787852 | 138794487 | 6635 | loss | 500 | | 879 |
| 9 | 138787852 | 138794487 | 6635 | loss | 516 | | 879 |
| 9 | 138787852 | 138794487 | 6635 | loss | 531 | | 879 |
| 9 | 138787852 | 138794487 | 6635 | loss | 536 | | 879 |
| 9 | 138787852 | 138794487 | 6635 | loss | 544 | | 879 |
| 9 | 138787852 | 138794487 | 6635 | loss | 579 | | 879 |
| 9 | 138787852 | 138794487 | 6635 | loss | 583 | | 879 |
| 9 | 138784932 | 138794487 | 9555 | loss | 600 | | 880 |
| 9 | 138787852 | 138794487 | 6635 | loss | 618 | | 879 |
| 9 | 138787852 | 138794487 | 6635 | loss | 621 | | 879 |
| 9 | 138787852 | 138791196 | 3344 | loss | 637 | | 881 |
| 9 | 138787852 | 138794487 | 6635 | loss | 659 | | 879 |
| 9 | 138787852 | 138794487 | 6635 | loss | 660 | | 879 |
| 9 | 138787852 | 138794487 | 6635 | loss | 690 | | 879 |
| 9 | 138787852 | 138794487 | 6635 | loss | 745 | | 879 |
| 9 | 138787852 | 138794487 | 6635 | loss | 753 | | 879 |
| 9 | 138787852 | 138794487 | 6635 | loss | 760 | | 879 |
| 9 | 138787852 | 138794487 | 6635 | loss | 763 | | 879 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 9 | 138787852 | 138794487 | 6635 | loss | 771 | | 879 |
| 9 | 138787852 | 138794487 | 6635 | loss | 795 | | 879 |
| 9 | 138787852 | 138794487 | 6635 | loss | 876 | | 879 |
| 9 | 138787852 | 138794487 | 6635 | loss | 885 | | 879 |
| 9 | 138784932 | 138794487 | 9555 | loss | 894 | | 880 |
| 9 | 138787852 | 138794487 | 6635 | loss | 914 | | 879 |
| 9 | 138787852 | 138794487 | 6635 | loss | 920 | | 879 |
| 9 | 138787852 | 138794487 | 6635 | loss | 1163 | | 879 |
| 9 | 138787852 | 138794487 | 6635 | loss | 1179 | | 879 |
| 9 | 138787852 | 138794487 | 6635 | loss | 1210 | | 879 |
| 9 | 138787852 | 138794487 | 6635 | loss | 1215 | | 879 |
| 9 | 138787852 | 138794487 | 6635 | loss | 2050 | | 879 |
| 9 | 138787852 | 138794487 | 6635 | loss | 2186 | | 879 |
| 9 | 138787852 | 138794487 | 6635 | loss | 2244 | | 879 |
| 9 | 138787852 | 138794487 | 6635 | loss | 2377 | | 879 |
| 9 | 138787852 | 138794487 | 6635 | loss | 2388 | | 879 |
| 9 | 138787852 | 138794487 | 6635 | loss | 2464 | | 879 |
| 9 | 138787852 | 138794487 | 6635 | loss | 2488 | | 879 |
| 9 | 138787852 | 138794487 | 6635 | loss | 2616 | | 879 |
| 9 | 138787852 | 138794487 | 6635 | loss | 2626 | | 879 |
| 10 | 67965576 | 68078308 | 112732 | loss | 113 | CTNNA3 | 882 |
| 10 | 67958466 | 67996480 | 38014 | loss | 244 | CTNNA3 | 883 |
| 10 | 67981351 | 67984288 | 2937 | loss | 273 | CTNNA3 | 884 |
| 10 | 67981351 | 67984288 | 2937 | loss | 276 | CTNNA3 | 884 |
| 10 | 67981351 | 68170524 | 189173 | loss | 477 | CTNNA3 | 885 |
| 10 | 67972803 | 68087163 | 114360 | loss | 596 | CTNNA3 | 886 |
| 10 | 67861691 | 68087163 | 225472 | loss | 728 | CTNNA3 | 887 |
| 10 | 67981351 | 68057492 | 76141 | loss | 1175 | CTNNA3 | 888 |
| 10 | 67981351 | 67984288 | 2937 | loss | 2607 | CTNNA3 | 884 |
| 10 | 67965576 | 68078308 | 112732 | loss | 113 | CTNNA3 | 882 |
| 10 | 68018232 | 68032304 | 14072 | loss | 154 | CTNNA3 | 889 |
| 10 | 68023387 | 68070986 | 47599 | loss | 381 | CTNNA3 | 890 |
| 10 | 67981351 | 68170524 | 189173 | loss | 477 | CTNNA3 | 885 |
| 10 | 67972803 | 68087163 | 114360 | loss | 596 | CTNNA3 | 886 |
| 10 | 67861691 | 68087163 | 225472 | loss | 728 | CTNNA3 | 887 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 10 | 68018232 | 68211417 | 193185 | loss | 858 | CTNNA3 | 891 |
| 10 | 67981351 | 68057492 | 76141 | loss | 1175 | CTNNA3 | 888 |
| 10 | 68023387 | 68070986 | 47599 | loss | 2299 | CTNNA3 | 890 |
| 10 | 116629173 | 116872694 | 243521 | gain | 2264 | ATRNL1,FAM160B1,TRUB1 | 892 |
| 11 | 69754380 | 69760985 | 6605 | loss | 27 | | 893 |
| 11 | 69754380 | 69760985 | 6605 | loss | 115 | | 893 |
| 11 | 69754380 | 69760985 | 6605 | loss | 125 | | 893 |
| 11 | 69754380 | 69760985 | 6605 | loss | 129 | | 893 |
| 11 | 69754380 | 69760985 | 6605 | loss | 255 | | 893 |
| 11 | 69754380 | 69760985 | 6605 | loss | 276 | | 893 |
| 11 | 69754380 | 69760985 | 6605 | loss | 319 | | 893 |
| 11 | 69754380 | 69760985 | 6605 | loss | 513 | | 893 |
| 11 | 69754380 | 69760985 | 6605 | loss | 520 | | 893 |
| 11 | 69754380 | 69760985 | 6605 | loss | 530 | | 893 |
| 11 | 69754380 | 69760985 | 6605 | loss | 597 | | 893 |
| 11 | 69754380 | 69760985 | 6605 | loss | 601 | | 893 |
| 11 | 69754380 | 69760985 | 6605 | loss | 629 | | 893 |
| 11 | 69754380 | 69760985 | 6605 | loss | 670 | | 893 |
| 11 | 69754380 | 69760985 | 6605 | loss | 721 | | 893 |
| 11 | 69754380 | 69760985 | 6605 | loss | 767 | | 893 |
| 11 | 69754380 | 69760985 | 6605 | loss | 787 | | 893 |
| 11 | 69754380 | 69760985 | 6605 | loss | 790 | | 893 |
| 11 | 69754380 | 69760985 | 6605 | loss | 847 | | 893 |
| 11 | 69754380 | 69760985 | 6605 | loss | 852 | | 893 |
| 11 | 69754380 | 69760985 | 6605 | loss | 883 | | 893 |
| 11 | 69754380 | 69760985 | 6605 | loss | 887 | | 893 |
| 11 | 69754380 | 69760985 | 6605 | loss | 1209 | | 893 |
| 11 | 69754380 | 69760985 | 6605 | loss | 1217 | | 893 |
| 11 | 69754380 | 69760985 | 6605 | loss | 1219 | | 893 |
| 11 | 69754380 | 69760985 | 6605 | loss | 2417 | | 893 |
| 11 | 69754380 | 69760985 | 6605 | loss | 2438 | | 893 |
| 11 | 69754380 | 69760985 | 6605 | loss | 2626 | | 893 |
| 11 | 69754380 | 69760985 | 6605 | loss | 2645 | | 893 |
| 11 | 125741939 | 125755749 | 13810 | gain | 276 | ST3GAL4 | 894 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 11 | 125738617 | 125755749 | 17132 | gain | 350 | ST3GAL4 | 895 |
| 11 | 125741939 | 125755749 | 13810 | gain | 708 | ST3GAL4 | 894 |
| 11 | 125741939 | 125755749 | 13810 | gain | 721 | ST3GAL4 | 894 |
| 11 | 125741939 | 125755749 | 13810 | gain | 751 | ST3GAL4 | 894 |
| 11 | 125741939 | 125759256 | 17317 | gain | 924 | ST3GAL4 | 896 |
| 11 | 129500616 | 129567879 | 67263 | gain | 2581 | APLP2,ST14 | 897 |
| 12 | 99462740 | 99468590 | 5850 | loss | 8 | NR1H4 | 898 |
| 12 | 99462740 | 99468590 | 5850 | loss | 12 | NR1H4 | 898 |
| 12 | 99462740 | 99468590 | 5850 | loss | 115 | NR1H4 | 898 |
| 12 | 99462740 | 99468590 | 5850 | loss | 151 | NR1H4 | 898 |
| 12 | 99462740 | 99468590 | 5850 | loss | 450 | NR1H4 | 898 |
| 12 | 99462740 | 99468590 | 5850 | loss | 540 | NR1H4 | 898 |
| 12 | 99462740 | 99468590 | 5850 | loss | 627 | NR1H4 | 898 |
| 12 | 99462740 | 99468590 | 5850 | loss | 697 | NR1H4 | 898 |
| 12 | 99462740 | 99468590 | 5850 | loss | 785 | NR1H4 | 898 |
| 13 | 49475817 | 49964838 | 489021 | loss | 2615 | DLEU1,DLEU2,KCNRG,MIR15A,MIR16-1,ST13P4,TRIM13 | 899 |
| 15 | 51761901 | 51763629 | 1728 | loss | 138 | WDR72 | 900 |
| 15 | 51761901 | 51763629 | 1728 | loss | 339 | WDR72 | 900 |
| 15 | 51761901 | 51763629 | 1728 | loss | 383 | WDR72 | 900 |
| 15 | 51761901 | 51763629 | 1728 | loss | 419 | WDR72 | 900 |
| 15 | 51761901 | 51763629 | 1728 | loss | 593 | WDR72 | 900 |
| 15 | 51761901 | 51763629 | 1728 | loss | 643 | WDR72 | 900 |
| 15 | 51761901 | 51763629 | 1728 | loss | 681 | WDR72 | 900 |
| 15 | 51761901 | 51763629 | 1728 | loss | 1190 | WDR72 | 900 |
| 15 | 51761901 | 51763629 | 1728 | loss | 1204 | WDR72 | 900 |
| 15 | 55439125 | 55474767 | 35642 | gain | 26 | CGNL1 | 901 |
| 15 | 55430340 | 55566824 | 136484 | gain | 164 | CGNL1 | 902 |
| 15 | 55430340 | 55569543 | 139203 | gain | 185 | CGNL1 | 903 |
| 15 | 55430340 | 55569543 | 139203 | gain | 594 | CGNL1 | 903 |
| 15 | 55430340 | 55566824 | 136484 | gain | 731 | CGNL1 | 902 |

Figure 8D (Continued)

| Figure 8D | | | | | | |
|---|---|---|---|---|---|---|
| Chr | Original CNV Start | Original CNV Stop | Original CNV Size | CNV Type | PD Case ID | RefSeq Gene Symbol | SEQ_ID |
| 15 | 55423602 | 55566824 | 143222 | gain | 736 | CGNL1 | 904 |
| 15 | 55430340 | 55566824 | 136484 | gain | 751 | CGNL1 | 902 |
| 15 | 55430340 | 55566824 | 136484 | gain | 855 | CGNL1 | 902 |
| 19 | 61411350 | 61448728 | 37378 | gain | 2054 | | 905 |
| 19 | 61436857 | 61445887 | 9030 | loss | 2318 | | 906 |
| 19 | 61436857 | 61445887 | 9030 | loss | 2462 | | 906 |
| 19 | 61455201 | 61500757 | 45556 | loss | 2547 | | 907 |
| 20 | 24366891 | 24373694 | 6803 | gain | 169 | | 908 |
| 20 | 24366891 | 24373694 | 6803 | gain | 260 | | 908 |
| 20 | 24366891 | 24373694 | 6803 | gain | 305 | | 908 |
| 20 | 24366891 | 24373694 | 6803 | gain | 361 | | 908 |
| 20 | 24366891 | 24373694 | 6803 | gain | 843 | | 908 |
| 20 | 24366891 | 24375768 | 8877 | gain | 880 | | 909 |
| 20 | 24366891 | 24373694 | 6803 | gain | 887 | | 908 |
| 22 | 20643128 | 20904936 | 261808 | gain | 39 | TOP3B | 910 |
| 22 | 20647851 | 20904936 | 257085 | gain | 59 | TOP3B | 911 |
| 22 | 20643128 | 20904936 | 261808 | gain | 131 | TOP3B | 910 |
| 22 | 20643128 | 20904936 | 261808 | loss | 213 | TOP3B | 910 |
| 22 | 20643128 | 20904936 | 261808 | gain | 347 | TOP3B | 910 |
| 22 | 20643128 | 20904936 | 261808 | loss | 435 | TOP3B | 910 |
| 22 | 20647851 | 20904936 | 257085 | gain | 571 | TOP3B | 911 |
| 22 | 20643128 | 20904936 | 261808 | gain | 581 | TOP3B | 910 |
| 22 | 20643128 | 20904936 | 261808 | gain | 709 | TOP3B | 910 |
| 22 | 20643128 | 20904936 | 261808 | loss | 756 | TOP3B | 910 |
| 22 | 20643128 | 20904936 | 261808 | loss | 857 | TOP3B | 910 |
| 22 | 20643128 | 20904936 | 261808 | loss | 1180 | TOP3B | 910 |
| 22 | 20643128 | 20904936 | 261808 | loss | 2625 | TOP3B | 910 |
| 22 | 31759670 | 31764719 | 5049 | loss | 2628 | SYN3 | 912 |
| 22 | 31790222 | 31799728 | 9506 | loss | 2219 | | 913 |
| 22 | 31790222 | 31799728 | 9506 | loss | 2588 | | 913 |
| 23 | 129362139 | 130000884 | 638745 | gain | 2634 | ENOX2 | 914 |
| 23 | 151373005 | 151479079 | 106074 | loss | 559 | | 915 |
| 23 | 151404321 | 151407087 | 2766 | loss | 2197 | | 916 |
| 23 | 151388712 | 151479079 | 90367 | loss | 2268 | | 917 |
| 23 | 151404321 | 151407087 | 2766 | loss | 2430 | | 916 |

| SRN | Chromo-some | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 1 | 2 | 99221389 | 99281387 | 59998 | gain | 2362 | LYG1,LYG2 | Y | 1 | 3 | 0.135816765 | 5.36 | biology |
| 2 | 2 | 99221389 | 99281387 | 59998 | gain | 2829 | LYG1,LYG2 | Y | 1 | 3 | 0.135816765 | 5.36 | biology |
| 3 | 2 | 99221389 | 99281387 | 59998 | gain | 1015 | LYG1,LYG2 | Y | 1 | 3 | 0.135816765 | 5.36 | biology stats_biol |
| 4 | 12 | 63383870 | 63385104 | 1234 | loss | 2185 | | N | 1 | 5 | 0.025129091 | 8.96 | ogy stats_biol |
| 5 | 12 | 63383870 | 63385104 | 1234 | loss | 2219 | | N | 1 | 5 | 0.025129091 | 8.96 | ogy stats_biol |
| 6 | 12 | 63383870 | 63385104 | 1234 | loss | 2260 | | N | 1 | 5 | 0.025129091 | 8.96 | ogy stats_biol |
| 7 | 12 | 63383870 | 63385104 | 1234 | loss | 2439 | | N | 1 | 5 | 0.025129091 | 8.96 | ogy stats_biol |
| 8 | 12 | 63383870 | 63385104 | 1234 | loss | 2591 | | N | 1 | 5 | 0.025129091 | 8.96 | ogy stats_biol |
| 9 | 8 | 16508165 | 16540658 | 32493 | loss | 2199 | | N | 0 | 4 | 0.016691719 | 16.12 | ogy stats_biol |
| 10 | 8 | 16508165 | 16540658 | 32493 | gain | 2245 | | N | 0 | 4 | 0.016691719 | 16.12 | ogy stats_biol |
| 11 | 8 | 16508165 | 16540658 | 32493 | loss | 2494 | | N | 0 | 4 | 0.016691719 | 16.12 | ogy stats_biol |
| 12 | 8 | 16508165 | 16540658 | 32493 | loss | 2626 | | N | 0 | 4 | 0.016691719 | 16.12 | ogy stats_biol |
| 13 | 10 | 92303130 | 92324088 | 20958 | loss | 2323 | | N | 0 | 3 | 0.016691719 | 12.51 | ogy stats_biol |
| 14 | 10 | 92303130 | 92324088 | 20958 | gain | 2431 | | N | 0 | 3 | 0.016691719 | 12.51 | ogy stats_biol |
| 15 | 10 | 92303130 | 92324088 | 20958 | gain | 2614 | | N | 0 | 3 | 0.016691719 | 12.51 | ogy |
| 16 | 10 | 92324089 | 92595197 | 271108 | gain | 2431 | HTR7 | Y | 0 | 2 | 0.129489977 | 8.92 | biology |
| 17 | 10 | 92324089 | 92595197 | 271108 | gain | 2614 | HTR7 | Y | 0 | 2 | 0.129489977 | 8.92 | biology |

| SRN | Chromo-some | CNV_Subregion_Start | CNV_Subregion_Stop | CNV_Subregion_Size | CNV_Type | PD_Case_ID(s) | RefSeq_Gene_Symbol | Exon_over-lap | NVE_cases | PD_cases | Fisher's Detailed Exact (FET) | odds ratio | Category |
|---|---|---|---|---|---|---|---|---|---|---|---|---|---|
| 18 | 3 | 185220747 | 185231271 | 10524 | gain | 2288 | | N | 1 | 4 | 0.059421524 | 7.16 | biology |
| 19 | 3 | 185220747 | 185231271 | 10524 | gain | 2320 | | N | 1 | 4 | 0.059421524 | 7.16 | biology |
| 20 | 3 | 185220747 | 185231271 | 10524 | gain | 2433 | | N | 1 | 4 | 0.059421524 | 7.16 | biology |
| 21 | 3 | 185220747 | 185231271 | 10524 | gain | 2443 | | N | 1 | 4 | 0.059421524 | 7.16 | biology |
| 22 | 3 | 3979406 | 4048901 | 69495 | loss | 2218 | | N | 0 | 2 | 0.129489977 | 8.92 | biology |
| 23 | 3 | 3979406 | 4048901 | 69495 | loss | 2467 | | N | 0 | 2 | 0.129489977 | 8.92 | biology |
| 24 | 3 | 4351923 | 4398938 | 47015 | loss | 2178 | SUMF1 | Y | 0 | 1 | 0.129489977 | 5.34 | biology |
| 25 | 15 | 52149940 | 52154416 | 4476 | gain | 2487 | UNC13C | N | 0 | 2 | 0.129489977 | 5.34 | biology |
| 26 | 15 | 52301382 | 52309859 | 8477 | gain | 2407 | UNC13C | N | 0 | 2 | 0.129489977 | 8.92 | biology |
| 27 | 15 | 52301382 | 52309859 | 8477 | gain | 2533 | UNC13C | N | 0 | 2 | 0.129489977 | 8.92 | biology |
| 28 | 15 | 52697607 | 52710467 | 12860 | loss | 2424 | UNC13C | Y | 0 | 2 | 0.129489977 | 8.92 | biology |
| 29 | 15 | 52697607 | 52710467 | 12860 | loss | 2571 | UNC13C | Y | 0 | 2 | 0.129489977 | 8.92 | biology |
| 30 | 10 | 108944672 | 109173307 | 228635 | gain | 2353 | | N | 0 | 2 | 0.129489977 | 8.92 | biology |
| 1 | 10 | 108944672 | 109173307 | 228635 | gain | 2453 | | N | 0 | 2 | 0.129489977 | 8.92 | biology |
| 2 | 2 | 62049841 | 62084882 | 35041 | loss | 2282 | COMMD1 | Y | 0 | 1 | 0.129489977 | 5.34 | biology |
| 3 | 2 | 62108133 | 62132094 | 23961 | loss | 2319 | COMMD1 | N | 0 | 1 | 0.129489977 | 5.34 | biology |
| 4 | 23 | 15425168 | 15576975 | 151807 | gain | 2219 | ACE2, BMX, TMEM27 | Y | 0 | 1 | 0.129489977 | 5.34 | biology |
| 5 | 22 | 17662875 | 17765355 | 102480 | loss | 2319 | HIRA | Y | 1 | 2 | 0.295188364 | 3.57 | biology |
| 6 | 22 | 17662875 | 17765355 | 102480 | gain | 2533 | HIRA | Y | 1 | 2 | 0.295188364 | 3.57 | biology |
| 7 | 20 | 40230903 | 40244704 | 13801 | loss | 2382 | PTPRT | N | 0 | 2 | 0.129489977 | 8.92 | biology |
| 8 | 20 | 40230903 | 40244704 | 13801 | loss | 2434 | PTPRT | N | 0 | 2 | 0.129489977 | 8.92 | biology |
| 9 | 20 | 40622703 | 40639181 | 16478 | loss | 2276 | PTPRT | N | 2 | 3 | 0.357505588 | 2.68 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 40 | 20 | 40622703 | 40639181 | 16478 | loss | 2385 | PTPRT | N | 2 | 3 | 0.357505588 | 2.68 | biology |
| 1 | 20 | 40622703 | 40639181 | 16478 | loss | 2434 | PTPRT | N | 2 | 3 | 0.357505588 | 2.68 | biology |
| 2 | 20 | 40683935 | 40702229 | 18294 | loss | 2199 | PTPRT | N | 2 | 3 | 0.357505588 | 2.68 | biology |
| 3 | 20 | 40683935 | 40702229 | 18294 | loss | 2276 | PTPRT | N | 2 | 3 | 0.357505588 | 2.68 | biology |
| 4 | 20 | 40683935 | 40702229 | 18294 | loss | 2434 | PTPRT | N | 2 | 3 | 0.357505588 | 2.68 | biology |
| 5 | 8 | 13973514 | 14055124 | 81613 | loss | 2527 | SGCZ | Y | 0 | 1 | 0.129489977 | 5.34 | biology |
| 6 | 8 | 14055349 | 14093586 | 38237 | loss | 2622 | SGCZ | Y | 0 | 1 | 0.129489977 | 5.34 | biology |
| 7 | 8 | 14467327 | 14472201 | 4874 | loss | 2487 | SGCZ | N | 1 | 1 | 1 | 1.78 | biology |
| 8 | 8 | 14486018 | 14551558 | 65540 | loss | 2432 | SGCZ | N | 0 | 1 | 0.129489977 | 5.34 | biology |
| 9 | 8 | 15074365 | 15077735 | 3370 | loss | 2203 | SGCZ | N | 0 | 1 | 0.129489977 | 5.34 | biology |
| 50 | 22 | 17519027 | 17560202 | 41175 | loss | 2319 | CLTCL1,SLC25A1 | Y | 1 | 2 | 0.295188364 | 3.57 | biology |
| 1 | 22 | 17519027 | 17560202 | 41175 | gain | 2533 | CLTCL1,SLC25A1 | Y | 1 | 2 | 0.295188364 | 3.57 | biology |
| 2 | 16 | 87850526 | 87877204 | 26678 | gain | 2350 | ANKRD11 | Y | 0 | 1 | 0.129489977 | 5.34 | biology |
| 3 | 16 | 88039987 | 88042486 | 2499 | gain | 2358 | ANKRD11 | N | 3 | 4 | 0.259684606 | 2.38 | biology |
| 4 | 16 | 88039987 | 88042486 | 2499 | gain |  | ANKRD11 | N | 3 | 4 | 0.259684606 | 2.38 | biology |
| 5 | 16 | 88039987 | 88042486 | 2499 | gain |  | ANKRD11 | N | 3 | 4 | 0.259684606 | 2.38 | biology |
| 6 | 16 | 88039987 | 88042486 | 2499 | gain |  | ANKRD11 | N | 3 | 4 | 0.259684606 | 2.38 | biology |
| 7 | 5 | 147081728 | 147275346 | 193618 | gain | 2537 | B3A2,SPINK1 | Y | 0 | 1 | 0.129489977 | 5.34 | biology stats_biol |
| 8 | 2 | 191869063 | 191873037 | 3974 | loss | 2053 | MYO1B | Y | 22 | 54 | 3.20E-10 | 4.72 | ogy stats_biol |
| 9 | 2 | 191869063 | 191873037 | 3974 | loss | 2057 | MYO1B | Y | 22 | 54 | 3.20E-10 | 4.72 | ogy stats_biol |
| 60 | 2 | 191869063 | 191873037 | 3974 | loss | 2185 | MYO1B | Y | 22 | 54 | 3.20E-10 | 4.72 | ogy stats_b |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 1 | 2 | 191869063 | 191873037 | 3974 | loss | 2188 | MYO1B | Y | 22 | 54 | 3.20E-10 | 4.72 | ogy_stats_biol |
| 2 | 2 | 191869063 | 191873037 | 3974 | loss | 2203 | MYO1B | Y | 22 | 54 | 3.20E-10 | 4.72 | ogy_stats_biol |
| 3 | 2 | 191869063 | 191873037 | 3974 | loss | 2208 | MYO1B | Y | 22 | 54 | 3.20E-10 | 4.72 | ogy_stats_biol |
| 4 | 2 | 191869063 | 191873037 | 3974 | loss | 2211 | MYO1B | Y | 22 | 54 | 3.20E-10 | 4.72 | ogy_stats_biol |
| 5 | 2 | 191869063 | 191873037 | 3974 | loss | 2214 | MYO1B | Y | 22 | 54 | 3.20E-10 | 4.72 | ogy_stats_biol |
| 6 | 2 | 191869063 | 191873037 | 3974 | loss | 2221 | MYO1B | Y | 22 | 54 | 3.20E-10 | 4.72 | ogy_stats_biol |
| 7 | 2 | 191869063 | 191873037 | 3974 | loss | 2223 | MYO1B | Y | 22 | 54 | 3.20E-10 | 4.72 | ogy_stats_biol |
| 8 | 2 | 191869063 | 191873037 | 3974 | gain | 2261 | MYO1B | Y | 22 | 54 | 3.20E-10 | 4.72 | ogy_stats_biol |
| 9 | 2 | 191869063 | 191873037 | 3974 | gain | 2267 | MYO1B | Y | 22 | 54 | 3.20E-10 | 4.72 | ogy_stats_biol |
| 70 | 2 | 191869063 | 191873037 | 3974 | gain | 2280 | MYO1B | Y | 22 | 54 | 3.20E-10 | 4.72 | ogy_stats_biol |
| 71 | 2 | 191869063 | 191873037 | 3974 | gain | 2290 | MYO1B | Y | 22 | 54 | 3.20E-10 | 4.72 | ogy_stats_biol |
| 72 | 2 | 191869063 | 191873037 | 3974 | gain | 2294 | MYO1B | Y | 22 | 54 | 3.20E-10 | 4.72 | ogy_stats_biol |
| 73 | 2 | 191869063 | 191873037 | 3974 | gain | 2295 | MYO1B | Y | 22 | 54 | 3.20E-10 | 4.72 | ogy_stats_biol |
| 74 | 2 | 191869063 | 191873037 | 3974 | gain | 2299 | MYO1B | Y | 22 | 54 | 3.20E-10 | 4.72 | ogy_stats_biol |
| 75 | 2 | 191869063 | 191873037 | 3974 | gain | 2304 | MYO1B | Y | 22 | 54 | 3.20E-10 | 4.72 | ogy_stats_biol |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 76 | 2 | 191869063 | 191873037 | 3974 | gain | 2339 | MYO1B | Y | 22 | 54 | 3.20E-10 | 4.72 | ogy_stats_biol |
| 77 | 2 | 191869063 | 191873037 | 3974 | gain | 2340 | MYO1B | Y | 22 | 54 | 3.20E-10 | 4.72 | ogy_stats_biol |
| 78 | 2 | 191869063 | 191873037 | 3974 | gain | 2348 | MYO1B | Y | 22 | 54 | 3.20E-10 | 4.72 | ogy_stats_biol |
| 79 | 2 | 191869063 | 191873037 | 3974 | gain | 2373 | MYO1B | Y | 22 | 54 | 3.20E-10 | 4.72 | ogy_stats_biol |
| 80 | 2 | 191869063 | 191873037 | 3974 | gain | 2376 | MYO1B | Y | 22 | 54 | 3.20E-10 | 4.72 | ogy_stats_biol |
| 1 | 2 | 191869063 | 191873037 | 3974 | gain | 2377 | MYO1B | Y | 22 | 54 | 3.20E-10 | 4.72 | ogy_stats_biol |
| 2 | 2 | 191869063 | 191873037 | 3974 | gain | 2393 | MYO1B | Y | 22 | 54 | 3.20E-10 | 4.72 | ogy_stats_biol |
| 3 | 2 | 191869063 | 191873037 | 3974 | gain | 2396 | MYO1B | Y | 22 | 54 | 3.20E-10 | 4.72 | ogy_stats_biol |
| 4 | 2 | 191869063 | 191873037 | 3974 | gain | 2400 | MYO1B | Y | 22 | 54 | 3.20E-10 | 4.72 | ogy_stats_biol |
| 5 | 2 | 191869063 | 191873037 | 3974 | gain | 2401 | MYO1B | Y | 22 | 54 | 3.20E-10 | 4.72 | ogy_stats_biol |
| 6 | 2 | 191869063 | 191873037 | 3974 | gain | 2402 | MYO1B | Y | 22 | 54 | 3.20E-10 | 4.72 | ogy_stats_biol |
| 7 | 2 | 191869063 | 191873037 | 3974 | gain | 2403 | MYO1B | Y | 22 | 54 | 3.20E-10 | 4.72 | ogy_stats_biol |
| 8 | 2 | 191869063 | 191873037 | 3974 | gain | 2411 | MYO1B | Y | 22 | 54 | 3.20E-10 | 4.72 | ogy_stats_biol |
| 9 | 2 | 191869063 | 191873037 | 3974 | gain | 2428 | MYO1B | Y | 22 | 54 | 3.20E-10 | 4.72 | ogy_stats_biol |
| 90 | 2 | 191869063 | 191873037 | 3974 | gain | 2429 | MYO1B | Y | 22 | 54 | 3.20E-10 | 4.72 | ogy_stats_biol |
| 1 | 2 | 191869063 | 191873037 | 3974 | gain | 2434 | MYO1B | Y | 22 | 54 | 3.20E-10 | 4.72 | ogy_stats_b |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| | | | | | | | | | | | | | iol |
| 2 | 2 | 191869063 | 191873037 | 3974 | gain | 2444 | MYO1B | Y | 22 | 54 | 3.20E-10 | 4.72 | ogy_stats_biol |
| 3 | 2 | 191869063 | 191873037 | 3974 | loss | 2450 | MYO1B | Y | 22 | 54 | 3.20E-10 | 4.72 | ogy_stats_biol |
| 4 | 2 | 191869063 | 191873037 | 3974 | loss | 2459 | MYO1B | Y | 22 | 54 | 3.20E-10 | 4.72 | ogy_stats_biol |
| 5 | 2 | 191869063 | 191873037 | 3974 | loss | 2465 | MYO1B | Y | 22 | 54 | 3.20E-10 | 4.72 | ogy_stats_biol |
| 6 | 2 | 191869063 | 191873037 | 3974 | loss | 2481 | MYO1B | Y | 22 | 54 | 3.20E-10 | 4.72 | ogy_stats_biol |
| 7 | 2 | 191869063 | 191873037 | 3974 | loss | 2491 | MYO1B | Y | 22 | 54 | 3.20E-10 | 4.72 | ogy_stats_biol |
| 8 | 2 | 191869063 | 191873037 | 3974 | loss | 2512 | MYO1B | Y | 22 | 54 | 3.20E-10 | 4.72 | ogy_stats_biol |
| 9 | 2 | 191869063 | 191873037 | 3974 | loss | 2514 | MYO1B | Y | 22 | 54 | 3.20E-10 | 4.72 | ogy_stats_biol |
| 100 | 2 | 191869063 | 191873037 | 3974 | loss | 2531 | MYO1B | Y | 22 | 54 | 3.20E-10 | 4.72 | ogy_stats_biol |
| 1 | 2 | 191869063 | 191873037 | 3974 | loss | 2535 | MYO1B | Y | 22 | 54 | 3.20E-10 | 4.72 | ogy_stats_biol |
| 2 | 2 | 191869063 | 191873037 | 3974 | loss | 2539 | MYO1B | Y | 22 | 54 | 3.20E-10 | 4.72 | ogy_stats_biol |
| 3 | 2 | 191869063 | 191873037 | 3974 | loss | 2546 | MYO1B | Y | 22 | 54 | 3.20E-10 | 4.72 | ogy_stats_biol |
| 4 | 2 | 191869063 | 191873037 | 3974 | loss | 2550 | MYO1B | Y | 22 | 54 | 3.20E-10 | 4.72 | ogy_stats_biol |
| 5 | 2 | 191869063 | 191873037 | 3974 | loss | 2559 | MYO1B | Y | 22 | 54 | 3.20E-10 | 4.72 | ogy_stats_biol |
| 6 | 2 | 191869063 | 191873037 | 3974 | loss | 2575 | MYO1B | Y | 22 | 54 | 3.20E-10 | 4.72 | ogy_stats_biol |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 7 | 2 | 191869063 | 191873037 | 3974 | loss | 2577 | MYO1B | Y | 22 | 54 | 3.20E-10 | 4.72 | ogy stats_biol |
| 8 | 2 | 191869063 | 191873037 | 3974 | loss | 2586 | MYO1B | Y | 22 | 54 | 3.20E-10 | 4.72 | ogy stats_biol |
| 9 | 2 | 191869063 | 191873037 | 3974 | loss | 2591 | MYO1B | Y | 22 | 54 | 3.20E-10 | 4.72 | ogy stats_biol |
| 10 | 2 | 191869063 | 191873037 | 3974 | loss | 2625 | MYO1B | Y | 22 | 54 | 3.20E-10 | 4.72 | ogy stats_biol |
| 1 | 2 | 191869063 | 191873037 | 3974 | loss | 2635 | MYO1B | Y | 22 | 54 | 3.20E-10 | 4.72 | ogy stats_biol |
| 2 | 5 | 75890947 | 75892204 | 1257 | gain | 2054 | IQGAP2 | N | 13 | 32 | 1.74E-06 | 4.58 | ogy stats_biol |
| 3 | 5 | 75890947 | 75892204 | 1257 | gain | 2251 | IQGAP2 | N | 13 | 32 | 1.74E-06 | 4.58 | ogy stats_biol |
| 4 | 5 | 75890947 | 75892204 | 1257 | gain | 2254 | IQGAP2 | N | 13 | 32 | 1.74E-06 | 4.58 | ogy stats_biol |
| 5 | 5 | 75890947 | 75892204 | 1257 | gain | 2269 | IQGAP2 | N | 13 | 32 | 1.74E-06 | 4.58 | ogy stats_biol |
| 6 | 5 | 75890947 | 75892204 | 1257 | gain | 2270 | IQGAP2 | N | 13 | 32 | 1.74E-06 | 4.58 | ogy stats_biol |
| 7 | 5 | 75890947 | 75892204 | 1257 | gain | 2283 | IQGAP2 | N | 13 | 32 | 1.74E-06 | 4.58 | ogy stats_biol |
| 8 | 5 | 75890947 | 75892204 | 1257 | gain | 2292 | IQGAP2 | N | 13 | 32 | 1.74E-06 | 4.58 | ogy stats_biol |
| 9 | 5 | 75890947 | 75892204 | 1257 | gain | 2334 | IQGAP2 | N | 13 | 32 | 1.74E-06 | 4.58 | ogy stats_biol |
| 120 | 5 | 75890947 | 75892204 | 1257 | gain | 2335 | IQGAP2 | N | 13 | 32 | 1.74E-06 | 4.58 | ogy stats_biol |
| 1 | 5 | 75890947 | 75892204 | 1257 | gain | 2344 | IQGAP2 | N | 13 | 32 | 1.74E-06 | 4.58 | ogy stats_biol |
| 2 | 5 | 75890947 | 75892204 | 1257 | gain | 2348 | IQGAP2 | N | 13 | 32 | 1.74E-06 | 4.58 | ogy stats_b |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| | | | | | | | | | | | | | iol |
| 3 | 5 | 75890947 | 75892204 | 1257 | gain | 2360 | IQGAP2 | N | 13 | 32 | 1.74E-06 | 4.58 | ogy_stats_biol |
| 4 | 5 | 75890947 | 75892204 | 1257 | gain | 2366 | IQGAP2 | N | 13 | 32 | 1.74E-06 | 4.58 | ogy_stats_biol |
| 5 | 5 | 75890947 | 75892204 | 1257 | gain | 2370 | IQGAP2 | N | 13 | 32 | 1.74E-06 | 4.58 | ogy_stats_biol |
| 6 | 5 | 75890947 | 75892204 | 1257 | gain | 2374 | IQGAP2 | N | 13 | 32 | 1.74E-06 | 4.58 | ogy_stats_biol |
| 7 | 5 | 75890947 | 75892204 | 1257 | gain | 2375 | IQGAP2 | N | 13 | 32 | 1.74E-06 | 4.58 | ogy_stats_biol |
| 8 | 5 | 75890947 | 75892204 | 1257 | gain | 2390 | IQGAP2 | N | 13 | 32 | 1.74E-06 | 4.58 | ogy_stats_biol |
| 9 | 5 | 75890947 | 75892204 | 1257 | gain | 2399 | IQGAP2 | N | 13 | 32 | 1.74E-06 | 4.58 | ogy_stats_biol |
| 130 | 5 | 75890947 | 75892204 | 1257 | gain | 2401 | IQGAP2 | N | 13 | 32 | 1.74E-06 | 4.58 | ogy_stats_biol |
| 1 | 5 | 75890947 | 75892204 | 1257 | gain | 2409 | IQGAP2 | N | 13 | 32 | 1.74E-06 | 4.58 | ogy_stats_biol |
| 2 | 5 | 75890947 | 75892204 | 1257 | gain | 2412 | IQGAP2 | N | 13 | 32 | 1.74E-06 | 4.58 | ogy_stats_biol |
| 3 | 5 | 75890947 | 75892204 | 1257 | gain | 2434 | IQGAP2 | N | 13 | 32 | 1.74E-06 | 4.58 | ogy_stats_biol |
| 4 | 5 | 75890947 | 75892204 | 1257 | gain | 2548 | IQGAP2 | N | 13 | 32 | 1.74E-06 | 4.58 | ogy_stats_biol |
| 5 | 5 | 75890947 | 75892204 | 1257 | gain | 2575 | IQGAP2 | N | 13 | 32 | 1.74E-06 | 4.58 | ogy_stats_biol |
| 6 | 5 | 75890947 | 75892204 | 1257 | gain | 2588 | IQGAP2 | N | 13 | 32 | 1.74E-06 | 4.58 | ogy_stats_biol |
| 7 | 5 | 75890947 | 75892204 | 1257 | gain | 2599 | IQGAP2 | N | 13 | 32 | 1.74E-06 | 4.58 | ogy_stats_biol |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 8 | 5 | 75890947 | 75892204 | 1257 | gain | 2602 | IQGAP2 | N | 13 | 32 | 1.74E-06 | 4.58 | ogy_stats_biol |
| 9 | 5 | 75890947 | 75892204 | 1257 | gain | 2604 | IQGAP2 | N | 13 | 32 | 1.74E-06 | 4.58 | ogy_stats_biol |
| 140 | 5 | 75890947 | 75892204 | 1257 | gain | 2608 | IQGAP2 | N | 13 | 32 | 1.74E-06 | 4.58 | ogy_stats_biol |
| 1 | 5 | 75890947 | 75892204 | 1257 | gain | 2609 | IQGAP2 | N | 13 | 32 | 1.74E-06 | 4.58 | ogy_stats_biol |
| 2 | 5 | 75890947 | 75892204 | 1257 | gain | 2627 | IQGAP2 | N | 13 | 32 | 1.74E-06 | 4.58 | ogy_stats_biol |
| 3 | 5 | 75890947 | 75892204 | 1257 | gain | 2642 | IQGAP2 | N | 13 | 32 | 1.74E-06 | 4.58 | ogy_stats_biol |
| 4 | 18 | 3707709 | 3714325 | 6616 | gain | 2338 | DLGAP1 | N | 0 | 2 | 1.29E-01 | 8.92 | biology |
| 5 | 18 | 3707709 | 3714325 | 6616 | loss | 2423 | DLGAP1 | N | 0 | 2 | 1.29E-01 | 8.92 | biology |
| 6 | 14 | 54693682 | 54695022 | 1340 | gain | 2444 | DLGAP5 | Y | 0 | 2 | 1.29E-01 | 8.92 | biology |
| 7 | 14 | 54693682 | 54695022 | 1340 | loss | 2520 | DLGAP5 | Y | 0 | 2 | 1.29E-01 | 8.92 | biology |
| 8 | 3 | 1100700 | 1111648 | 10948 | gain | 2246 | CNTN6 | Y | 3 | 4 | 0.259684606 | 2.38 | biology |
| 9 | 3 | 1100700 | 1111648 | 10948 | gain | 2277 | CNTN6 | Y | 3 | 4 | 0.259684606 | 2.38 | biology |
| 150 | 3 | 1100700 | 1111648 | 10948 | gain | 2362 | CNTN6 | Y | 3 | 4 | 0.259684606 | 2.38 | biology |
| 1 | 3 | 1100700 | 1111648 | 10948 | gain | 2440 | CNTN6 | Y | 3 | 4 | 0.259684606 | 2.38 | biology |
| 2 | 3 | 1410291 | 1435901 | 25610 | gain | 2386 | CNTN6 | Y | 2 | 1 | 1 | 0.89 | biology |
| 3 | 2 | 187807252 | 187811424 | 4172 | loss | 2408 |  | N | 0 | 2 | 0.129489977 | 8.92 | biology |
| 4 | 2 | 187807252 | 187811424 | 4172 | loss | 2409 |  | N | 0 | 2 | 0.129489977 | 8.92 | biology |
| 5 | 2 | 187811424 | 187859213 | 47789 | loss | 2383 |  | N | 1 | 2 | 0.295188364 | 3.57 | biology |
| 6 | 2 | 187807252 | 187811424 | 4172 | loss | 2408 |  | N | 0 | 2 | 0.129489977 | 8.92 | biology |
| 7 | 2 | 187940149 | 187947864 | 7715 | loss | 2313 | CALCRL | N | 1 | 1 | 1 | 1.78 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 8 | 16 | 86251331 | 86262922 | 11591 | gain | 2213 | JPH3 | N | 3 | 5 | 0.145194767 | 2.98 | biology |
| 9 | 16 | 86251331 | 86262922 | 11591 | gain | 2291 | JPH3 | N | 3 | 5 | 0.145194767 | 2.98 | biology |
| 160 | 16 | 86251331 | 86262922 | 11591 | gain | 2316 | JPH3 | N | 3 | 5 | 0.145194767 | 2.98 | biology |
| 1 | 16 | 86251331 | 86262922 | 11591 | gain | 2357 | JPH3 | N | 3 | 5 | 0.145194767 | 2.98 | biology |
| 2 | 16 | 86251331 | 86262922 | 11591 | gain | 2569 | JPH3 | N | 3 | 5 | 0.145194767 | 2.98 | biology |
| 3 | 5 | 58894481 | 59098459 | 203978 | loss | 2278 | PDE4D | Y | 0 | 1 | 0.129489977 | 5.34 | biology |
| 4 | 5 | 59226196 | 59300771 | 74575 | loss | 2383 | PDE4D | N | 1 | 1 | 1 | 1.78 | biology |
| 5 | 12 | 123880351 | 123881951 | 1600 | loss | 2052 | SCARB1 | N | 0 | 2 | 0.129489977 | 8.92 | biology |
| 6 | 12 | 123880351 | 123881951 | 1600 | loss | 2631 | SCARB1 | N | 0 | 2 | 0.129489977 | 8.92 | biology |
| 7 | 7 | 132556508 | 132562410 | 2902 | gain | 2530 | | N | 0 | 1 | 0.129489977 | 5.34 | biology |
| 8 | 7 | 133261876 | 133332734 | 70858 | gain | 2280 | EXOC4 | Y | 0 | 1 | 0.129489977 | 5.34 | biology |
| 9 | 7 | 133332735 | 133337522 | 4787 | loss | 2280 | EXOC4 | Y | 0 | 2 | 0.129489977 | 8.92 | biology |
| 170 | 7 | 133332735 | 133337522 | 4787 | loss | 2280 | EXOC4 | Y | 0 | 2 | 0.129489977 | 8.92 | biology |
| 1 | 6 | 146479425 | 146480848 | 1423 | gain | 2385 | GRM1 | N | 0 | 1 | 0.129489977 | 5.34 | biology |
| 2 | 2 | 146535737 | 146537005 | 1268 | loss | 2620 | GRM1 | N | 1 | 1 | 1 | 1.78 | biology |
| 3 | 6 | 146576017 | 146587408 | 4095 | gain | 2293 | GRIP1 | N | 0 | 1 | 0.129489977 | 5.34 | biology |
| 4 | 12 | 65197400 | 65201495 | 4095 | gain | 2425 | GRIP1 | Y | 0 | 1 | 0.129489977 | 5.34 | biology |
| 5 | 12 | 65346329 | 65663755 | 317426 | loss | 2314 | GRIP1 | Y | 0 | 1 | 0.129489977 | 5.34 | biology |
| 6 | 11 | 14828676 | 14859461 | 30785 | gain | 2052 | CYP2R1,PDE3B | Y | 0 | 2 | 0.129489977 | 8.92 | biology |
| 7 | 11 | 14828676 | 14859461 | 30785 | gain | 2461 | CYP2R1,PDE3B | Y | 0 | 2 | 0.129489977 | 8.92 | biology |
| 8 | 15 | 91815727 | 91819844 | 4117 | loss | 2374 | | N | 0 | 3 | 0.016691719 | 12.51 | ogy stats_biol |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 9 | 15 | 91815727 | 91819844 | 4117 | loss | 2379 | | N | 0 | 3 | 0.016691719 | 12.51 | ogy stats_biol |
| 180 | 15 | 91815727 | 91819844 | 4117 | loss | 2395 | | N | 0 | 3 | 0.016691719 | 12.51 | ogy stats_biol |
| 1 | 3 | 147874434 | 148199108 | 324674 | gain | 2287 | | N | 0 | 3 | 0.129489977 | 8.92 | biology |
| 2 | 3 | 147874434 | 148199108 | 324674 | gain | 2562 | | N | 0 | 3 | 0.129489977 | 8.92 | biology |
| 3 | 8 | 53834519 | 53903530 | 69011 | gain | 2188 | | N | 1 | 2 | 0.295188364 | 3.57 | biology |
| 4 | 8 | 53834519 | 53903530 | 69011 | gain | 2527 | | N | 1 | 2 | 0.295188364 | 3.57 | biology |
| 5 | 10 | 67627258 | 67745378 | 118120 | loss | 2511 | CTNNA3 | Y | 0 | 1 | 0.129489977 | 3.57 | biology |
| 6 | 10 | 68234436 | 68253916 | 118120 | loss | 2431 | CTNNA3 | N | 0 | 1 | 0.129489977 | 5.34 | biology |
| 7 | 10 | 35466684 | 35492204 | 25520 | gain | 2175 | CREM | Y | 0 | 2 | 0.129489977 | 8.92 | biology |
| 8 | 10 | 35466684 | 35492204 | 25520 | gain | 2587 | CREM | Y | 0 | 2 | 0.129489977 | 8.92 | biology |
| 9 | 10 | 35348062 | 35355422 | 7480 | gain | 2175 | CUL2 | Y | 1 | 2 | 0.295188364 | 3.57 | biology |
| 190 | 10 | 35348062 | 35355542 | 7480 | gain | 2587 | CUL2 | Y | 1 | 2 | 0.295188364 | 3.57 | biology stats_biol |
| 1 | 5 | 113625639 | 113630429 | 4790 | loss | 2253 | | N | 0 | 3 | 0.016691719 | 12.51 | ogy stats_biol |
| 2 | 5 | 113625639 | 113630429 | 4790 | loss | 2524 | | N | 0 | 3 | 0.016691719 | 12.51 | ogy stats_biol |
| 3 | 5 | 113625639 | 113630429 | 4790 | loss | 2627 | | N | 0 | 3 | 0.016691719 | 12.51 | ogy |
| 4 | 5 | 113828411 | 113833132 | 4721 | loss | 2487 | KCNN2 | N | 0 | 1 | 0.129489977 | 5.34 | biology |
| 5 | 20 | 42957116 | 43003149 | 46033 | gain | 2250 | PABPC1L,YWHAB | Y | 0 | 2 | 0.129489977 | 8.92 | biology |
| 6 | 20 | 42957116 | 43003149 | 46033 | loss | 2434 | PABPC1L,YWHAB | Y | 0 | 2 | 0.129489977 | 8.92 | biology |
| 7 | 20 | 43003150 | 43123262 | 120112 | loss | 2434 | STK4, STK4-AS1,TOMM3 | Y | 0 | 1 | 0.129489977 | 5.34 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| | | | | | | 4 | | | | | | | |
| 8 | 2 | 132981323 | 133073531 | 92208 | gain | 2192 | GPR39 | N | 1 | 2 | 0.295188364 | 3.57 | biology |
| 9 | 2 | 132981323 | 133073531 | 92208 | gain | 2257 | GPR39 | N | 1 | 2 | 0.295188364 | 3.57 | biology |
| 200 | 21 | 36433486 | 36541621 | 108135 | gain | 2425 | CBR3,CBR3-AS1,DOPEY2 | Y | 4 | 3 | 0.707201496 | 1.34 | biology |
| 1 | 21 | 36433486 | 36541621 | 108135 | gain | 2562 | CBR3,CBR3-AS1,DOPEY2 | Y | 4 | 3 | 0.707201496 | 1.34 | biology |
| 2 | 21 | 36433486 | 36541621 | 108135 | gain | 2594 | CBR3,CBR3-AS1,DOPEY2 | Y | 4 | 3 | 0.707201496 | 1.34 | biology |
| 3 | 2 | 237598087 | 237611737 | 13650 | loss | 2302 | | N | 0 | 2 | 0.129489977 | 8.92 | biology |
| 4 | 2 | 237598087 | 237611737 | 13650 | loss | 2576 | | N | 0 | 2 | 0.129489977 | 8.92 | biology |
| 5 | 7 | 89573427 | 89722512 | 149085 | gain | 2407 | C7orf63,DPY19L2P4,STEAP1,STEAP2 | Y | 1 | 2 | 0.295188364 | 3.57 | biology |
| 6 | 7 | 89573427 | 89722512 | 149085 | gain | 2414 | C7orf63,DPY19L2P4,STEAP1,STEAP2 | Y | 1 | 2 | 0.295188364 | 3.57 | biology |
| 7 | 13 | 83002653 | 83050863 | 48210 | loss | 2198 | | N | 1 | 3 | 0.135816765 | 5.36 | biology |
| 8 | 13 | 83002653 | 83050863 | 48210 | loss | 2404 | | N | 1 | 3 | 0.135816765 | 5.36 | biology |
| 9 | 13 | 83002653 | 83050863 | 48210 | loss | 2616 | | N | 1 | 3 | 0.135816765 | 5.36 | biology |
| 210 | 1 | 190868384 | 190949255 | 80871 | loss | 2374 | RGS13 | Y | 0 | 2 | 0.129489977 | 8.92 | biology |
| 1 | 1 | 190868384 | 190949255 | 80871 | loss | 2379 | RGS13 | Y | 0 | 2 | 0.129489977 | 8.92 | biology |
| 2 | 12 | 71553630 | 71727215 | 173585 | gain | 2433 | | N | 0 | 2 | 0.129489977 | 8.92 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 3 | 12 | 71553630 | 71727215 | 173585 | gain | 2443 |  | N | 0 | 2 | 0.129489977 | 8.92 | biology |
| 4 | 12 | 76988327 | 76993905 | 5578 | loss | 2353 | NAV3 | N | 0 | 2 | 0.129489977 | 8.92 | biology |
| 5 | 12 | 76988327 | 76993905 | 5578 | gain | 2599 | NAV3 | N | 0 | 2 | 0.129489977 | 8.92 | biology |
| 6 | 12 | 77070369 | 77071720 | 1351 | gain | 2488 | NAV3 | N | 2 | 3 | 0.357505588 | 2.68 | biology |
| 7 | 12 | 77070369 | 77071720 | 1351 | gain | 2502 | NAV3 | N | 2 | 3 | 0.357505588 | 2.68 | biology |
| 8 | 12 | 77070369 | 77071720 | 1351 | gain | 2599 | NAV3 | N | 2 | 3 | 0.357505588 | 2.68 | biology |
| 9 | 14 | 27578780 | 27587830 | 9050 | gain | 2360 |  | N | 0 | 3 | 0.016691719 | 12.51 | stats_biology |
| 10 | 14 | 27578780 | 27587830 | 9050 | loss | 2520 |  | N | 0 | 3 | 0.016691719 | 12.51 | stats_biology |
| 220 | 14 | 27578780 | 27587830 | 9050 | loss | 2603 |  | N | 0 | 3 | 0.016691719 | 12.51 | stats_biology |
| 1 | 7 | 90130428 | 90272345 | 141917 | gain | 2407 | CDK14 | Y | 0 | 1 | 0.129489977 | 5.34 | biology |
| 2 | 7 | 90481345 | 90483589 | 2244 | loss | 2254 | CDK14 | N | 1 | 2 | 0.295188364 | 3.57 | biology |
| 3 | 7 | 90481345 | 90483589 | 2244 | loss | 2542 | CDK14 | N | 1 | 2 | 0.295188364 | 3.57 | biology |
| 4 | 18 | 23888647 | 23894591 | 5944 | loss | 2197 | CDH2 | N | 0 | 1 | 0.129489977 | 5.34 | biology |
| 5 | 18 | 24005554 | 24021722 | 16168 | gain | 2227 | CDH2 | Y | 0 | 1 | 0.129489977 | 5.34 | biology |
| 6 | 6 | 44952593 | 44954183 | 1590 | loss | 2543 | SUPT3H | N | 0 | 1 | 0.129489977 | 5.34 | biology |
| 7 | 6 | 45248986 | 45257622 | 8636 | gain | 2318 | SUPT3H | N | 0 | 1 | 0.129489977 | 5.34 | biology |
| 8 | 6 | 45311377 | 45354217 | 42840 | loss | 2493 | SUPT3H | N | 0 | 1 | 0.129489977 | 5.34 | biology |
| 9 | 2 | 55626865 | 55630604 | 3739 | loss | 2524 | SMEK2 | Y | 0 | 2 | 0.129489977 | 8.92 | biology |
| 230 | 2 | 55626865 | 55630604 | 3739 | gain | 2171 | SMEK2 | Y | 0 | 2 | 0.129489977 | 8.92 | biology |
| 1 | 7 | 21498454 | 21586526 | 88072 | gain | 2247 | DNAH11,SP4 | Y | 0 | 1 | 0.129489977 | 5.34 | biology |
| 2 | 7 | 21879785 | 21949880 | 70095 | gain | 2372 | CDCA7L,DNAH11 | Y | 0 | 1 | 0.129489977 | 5.34 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 3 | 4 | 175871609 | 176211042 | 339433 | gain | 2202 | ADAM29,GLRA3 | Y | 0 | 1 | 0.129489977 | 5.34 | biology |
| 4 | 4 | 175900638 | 175901419 | 781 | loss | 2204 | GLAR3 | N | 0 | 1 | 0.129489977 | 5.34 | biology |
| 5 | 4 | 175903222 | 175905511 | 2289 | loss | 1001 | GLRA3 | N | 0 | 1 | 0.129489977 | 5.34 | biology |
| 6 | 4 | 20248905 | 20361961 | 113056 | gain | 2260 | KCNIP4,PACRGL | Y | 0 | 1 | 0.129489977 | 5.34 | biology |
| 7 | 4 | 21129054 | 21183240 | 54186 | loss | 2186 | KCNIP4 | Y | 0 | 1 | 0.129489977 | 5.34 | biology |
| 8 | 6 | 163145133 | 163226084 | 80951 | loss | 2481 | PACRG | Y | 0 | 1 | 0.129489977 | 5.34 | biology |
| 9 | 6 | 163236692 | 163239980 | 3288 | gain | 2549 | PACRG | N | 0 | 1 | 0.129489977 | 5.34 | biology |
| 240 | 15 | 53288438 | 53291249 | 2811 | loss | 2299 | RAB27A | N | 0 | 1 | 0.129489977 | 5.34 | biology |
| 1 | 15 | 53294639 | 53296511 | 1872 | loss | 2583 | RAB27A | N | 0 | 1 | 0.129489977 | 5.34 | biology |
| 2 | 5 | 60236661 | 60322623 | 85962 | loss | 2396 | ERCC8,NDUFAF2 | Y | 0 | 1 | 0.129489977 | 5.34 | Biology |
| 3 | 5 | 60334124 | 60336373 | 2249 | loss | 2578 | NDUFAF2 | N | 1 | 1 | 1 | 1.78 | biology |
| 4 | 4 | 77268570 | 77331259 | 62689 | gain | 2459 | NUP54,SCARB2 | Y | 0 | 1 | 0.129489977 | 5.34 | biology |
| 5 | 10 | 73262822 | 73480140 | 217318 | gain | 2477 | CHST3,PSAP | Y | 0 | 1 | 0.129489977 | 5.34 | biology |
| 6 | 2 | 130476076 | 130645445 | 169369 | gain | 2356 | CCDC74B,CCDC74B-AS1,LOC440905,POTEF,SMPD4 | Y | 0 | 1 | 0.129489977 | 5.34 | biology |
| 7 | 5 | 78312409 | 78313924 | 1515 | gain | 2470 | ARSB | N | 0 | 1 | 0.129489977 | 5.34 | biology |
| 8 | 22 | 36857573 | 36869386 | 11813 | gain | 2608 | PLA2G6 | Y | 0 | 1 | 0.129489977 | 5.34 | biology |
| 9 | 20 | 29609631 | 29767994 | 158363 | gain | 2299 | BCL2L1,C0X412,HM | Y | 0 | 1 | 0.129489977 | 5.34 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| | | | | | | | 13,HM13-AS1,ID1,MIR3193 | | | | | | |
| 250 | 16 | 87418867 | 87579130 | 160263 | gain | 2333 | CBFA2T3,GALNS,PABPN1L,TRAPPC2L | Y | 0 | 1 | 0.129489977 | 5.34 | biology |
| 1 | 16 | 68304615 | 68314645 | 10030 | loss | 2359 | NQO1 | Y | 0 | 1 | 0.129489977 | 5.34 | biology |
| 2 | 11 | 47566723 | 47620969 | 54246 | gain | 2478 | C1QTNF4,FAM180B,MTCH2 | Y | 0 | 1 | 0.129489977 | 5.34 | biology |
| 3 | 5 | 52947658 | 52952260 | 4602 | loss | 2266 | NDUFS4 | N | 1 | 1 | 1 | 1.78 | biology |
| 4 | 9 | 70809673 | 70928470 | 118797 | gain | 2616 | FXN,PIP5K1B,PRKACG,TJP2 | Y | 0 | 1 | 0.129489977 | 5.34 | biology |
| 5 | 5 | 137617658 | 137682772 | 65114 | gain | 2218 | CDC25C,GFRA3 | Y | 0 | 1 | 0.129489977 | 5.34 | biology |
| 6 | 23 | 122378954 | 122486760 | 107806 | gain | 2593 | GRIA3 | Y | 0 | 1 | 0.129489977 | 5.34 | biology |
| 7 | 11 | 67101848 | 67330919 | 229071 | gain | 2346 | ACY3,ALDH3B2,DOC2GP,FAM86C2P,GSTP1,NDUFV1,NUDT8,TBX10 | Y | 0 | 1 | 0.129489977 | 5.34 | biology |
| 8 | 1 | 144093719 | 144337286 | 243567 | gain | 2478 | ANKRD34A,ANKRD35,GNRH | Y | 0 | 1 | 0.129489977 | 5.34 | biology |

Figure 9A

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| | | | | | | | R2,HFE2,ITGA10,LIX1L,NUDT17,PEX11B,PIAS3,POLR3C,POLR3GL,RBM8A,RNF115,TXNIP | | | | | | |
| 9 | 1 | 151567338 | 151700811 | 133473 | gain | 2339 | PGLYRP4,S100A7,S100A7A,S100A7L2,S100A8,S100A9,S100Al2 | Y | 0 | 1 | 0.129489977 | 5.34 | biology |
| 260 | 2 | 31453743 | 31572223 | 118480 | gain | 2583 | XDH | Y | 0 | 1 | 0.129489977 | 5.34 | biology |
| 1 | 2 | 31579343 | 31668084 | 88741 | gain | 2583 | SRD5A2 | Y | 0 | 1 | 0.129489977 | 5.34 | biology |
| 2 | 2 | 55105225 | 55112274 | 7049 | gain | 2226 | RTN4 | Y | 0 | 1 | 0.129489977 | 5.34 | biology |
| 3 | 5 | 40821402 | 40893568 | 72166 | gain | 2334 | CARD6,LOC100506548,PRKAA1,RPL37,SNORD72 | Y | 1 | 1 | 1 | 1.78 | biology |
| 4 | 7 | 151138075 | 151140124 | 2049 | loss | 2238 | PRKAG2 | N | 0 | 1 | 0.129489977 | 5.34 | biology |
| 5 | 12 | 51828389 | 51994054 | 165665 | gain | 2207 | AAAS,C12orf10,CSAD,ESPL1| | Y | 0 | 1 | 0.129489977 | 5.34 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| | | | | | | | TGB7,MFSD5,PFDN5,RARG,ZNF740 | | | | | | |
| 6 | 17 | 6547639 | 6553756 | 6117 | loss | 2271 | SLC13A5 | Y | 0 | 1 | 0.129489977 | 5.34 | biology |
| 7 | 23 | 15708102 | 15719415 | 11313 | gain | 2641 | CA5B,INE2,ZRSR2 | Y | 0 | 1 | 0.129489977 | 5.34 | biology |
| 8 | 12 | 2274118 | 2280757 | 6639 | loss | 2617 | CACNA1C | N | 0 | 1 | 0.129489977 | 5.34 | biology |
| 9 | 22 | 18618206 | 19232773 | 614567 | loss | 2319 | DGCR6L,KLHL22,LOC729444,MED15,PI4KAP1,RIMBP3,RTN4R,SCARF2,TMEM191B,ZNF74 | Y | 1 | 1 | 1 | 1.78 | biology |
| 270 | 11 | 77404906 | 77409447 | 4541 | loss | 2518 | KCTD14,NDUFC2-KCTD14 | Y | 1 | 1 | 1 | 1.78 | biology |
| 1 | 12 | 119355352 | 119372494 | 17142 | gain | 2048 | COX6A1,GATC,TRIAP1 | Y | 1 | 1 | 1 | 1.78 | biology |
| 2 | 2 | 97534598 | 97640710 | 106112 | gain | 2307 | ACTR1B,ANKRD36B,COX5B | Y | 0 | 2 | 0.129489977 | 8.92 | biology |
| 3 | 2 | 97534598 | 97640710 | 106112 | gain | 2317 | ACTR1B,ANKRD36B,COX5B | Y | 0 | 2 | 0.129489977 | 8.92 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 4 | 12 | 110665203 | 110799506 | 134303 | gain | 2322 | ACAD10,ALDH2,MAPKAPK5,MAPKAPK5-AS1 | Y | 0 | 1 | 0.129489977 | 5.34 | biology |
| 5 | 11 | 7027544 | 7060093 | 32549 | gain | 2489 | NLRP14 | Y | 0 | 1 | 0.129489977 | 5.34 | biology |
| 6 | 1 | 245641060 | 245670131 | 29071 | gain | 2549 | NLRP3 | Y | 1 | 1 | 1 | 1.78 | biology |
| 7 | 23 | 96718563 | 96816526 | 97963 | gain | 2297 | DIAPH2 | Y | 0 | 1 | 0.129489977 | 5.34 | biology |
| 8 | 13 | 59330626 | 59449554 | 118928 | loss | 2319 | DIAPH3 | Y | 0 | 1 | 0.129489977 | 5.34 | biology |
| 9 | 8 | 38204506 | 38240266 | 35760 | loss | 2191 | DDHD2,PPAPDC1B | Y | 0 | 1 | 0.129489977 | 5.34 | biology |
| 280 | 7 | 122112008 | 122160357 | 48349 | loss | 2200 | CADPS2,RNF133,RNF148 | Y | 0 | 1 | 0.129489977 | 5.34 | biology |
| 1 | 13 | 19042791 | 19230464 | 187673 | gain | 2227 | MPHOSPH8,PSPC1 | Y | 0 | 1 | 0.129489977 | 5.34 | biology |
| 2 | 12 | 69559974 | 69653136 | 93162 | loss | 2363 | PTPRR | Y | 0 | 1 | 0.129489977 | 5.34 | biology |
| 3 | 15 | 30701373 | 30780512 | 79139 | gain | 2452 | ARHGAP11A,SCG5 | Y | 0 | 1 | 0.129489977 | 5.34 | biology |
| 4 | 3 | 122766784 | 122876107 | 109323 | gain | 2630 | ARGFX,FBXO40,GOLGB1,HCLS1 | Y | 0 | 1 | 0.129489977 | 5.34 | biology |
| 5 | 22 | 22504477 | 22586421 | 81944 | gain | 2617 | DERL3,LOC284889,MIF,SLC2A11,SMARCB1 | Y | 0 | 1 | 0.129489977 | 5.34 | biology |
| 6 | 15 | 30845066 | 30873303 | 28237 | gain | 2452 | FMN1 | Y | 0 | 1 | 0.129489977 | 5.34 | biology |

| SRN | Chromo-some | CNV_Subregion_Start | CNV_Subregion_Stop | CNV_Subregion_Size | CNV_Type | PD_Case_ID(s) | RefSeq_Gene_Symbol | Exon_over-lap | NVE_cases | PD_cases | Fisher's Detailed Exact (FET) | odds ratio | Category |
|---|---|---|---|---|---|---|---|---|---|---|---|---|---|
| 7 | 11 | 74317336 | 74468904 | 151568 | gain | 2191 | NEU3,SPCS2,XRRA1 | Y | 0 | 1 | 0.129489977 | 5.34 | biology |
| 8 | 15 | 38248407 | 38309734 | 61327 | loss | 2519 | BUB1B,PAK6 | Y | 0 | 1 | 0.129489977 | 5.34 | biology |
| 9 | 14 | 102155993 | 102250716 | 94723 | gain | 2378 | RCOR1 | Y | 0 | 1 | 0.129489977 | 5.34 | biology |
| 290 | 5 | 136320037 | 136407927 | 87890 | loss | 2392 | SPOCK1 | Y | 0 | 1 | 0.129489977 | 5.34 | biology |
| 1 | 11 | 74722504 | 74748605 | 26101 | gain | 2191 | ARRB1,MIR326 | Y | 0 | 1 | 0.129489977 | 5.34 | biology |
| 2 | 15 | 27124218 | 27170967 | 46749 | gain | 2452 | APBA2 | Y | 0 | 1 | 0.129489977 | 5.34 | biology |
| 3 | 21 | 36795373 | 36822143 | 26770 | gain | 2185 | CLDN14 | Y | 0 | 1 | 0.129489977 | 5.34 | biology |
| 4 | 2 | 233929889 | 234004039 | 74150 | gain | 2488 | DGKD | Y | 0 | 1 | 0.129489977 | 5.34 | biology |
| 5 | 15 | 30785246 | 30838135 | 52889 | gain | 2452 | GREM1 | Y | 0 | 1 | 0.129489977 | 5.34 | biology |
| 6 | 21 | 37080782 | 37163786 | 83004 | gain | 2267 | HLCS | N | 0 | 1 | 0.129489977 | 5.34 | biology |
| 7 | 7 | 119962649 | 120036540 | 73891 | loss | 2253 | KCND2 | N | 0 | 1 | 0.129489977 | 5.34 | biology |
| 8 | 2 | 1.12373466 | 112628177 | 254711 | gain | 2216 | FBLN7,MERTK,TMEM87B | Y | 0 | 1 | 0.129489977 | 5.34 | biology |
| 9 | 9 | 70228702 | 70579195 | 350493 | gain | 2314 | PGM5,PIP5K1B,TMEM252 | Y | 1 | 1 | 1 | 1.78 | biology |
| 300 | 14 | 72660748 | 72737170 | 76422 | gain | 2331 | PSEN1 | Y | 0 | 1 | 0.129489977 | 5.34 | biology |
| 1 | 13 | 50381620 | 50570709 | 189089 | loss | 2615 | GUCY1B2,RNASEH2B,RNASEH2B-AS1 | Y | 0 | 1 | 0.129489977 | 5.34 | biology |
| 2 | 14 | 101853463 | 102041421 | 187958 | gain | 2378 | CINP,TECPR2,ZNF83 | Y | 0 | 1 | 0.129489977 | 5.34 | biology |

| SRN | Chromo-some | CNV_Subregion_Start | CNV_Subregion_Stop | CNV_Subregion_Size | CNV_Type | PD_Case_ID(s) | RefSeq_Gene_Symbol | Exon_over-lap | NVE_cases | PD_cases | Fisher's Detailed Exact (FET) | odds ratio | Category |
|---|---|---|---|---|---|---|---|---|---|---|---|---|---|
| | | | | | | 9 | | | | | | | |
| 3 | 11 | 8007424 | 8048689 | 41265 | gain | 2489 | TUB | Y | 0 | 1 | 0.129489977 | 5.34 | biology |
| 4 | 1 | 28656279 | 28748021 | 91742 | gain | 2471 | PHACTR4,RCC1,SNHG3 | Y | 0 | 1 | 0.129489977 | 5.34 | biology |
| 5 | 1 | 153872608 | 153953798 | 81190 | loss | 2206 | DAP3,YY1AP1 | Y | 0 | 1 | 0.129489977 | 5.34 | biology |
| 6 | 1 | 221711442 | 222013960 | 302518 | loss | 2261 | CAPN2,CAPN8 | Y | 0 | 1 | 0.129489977 | 5.34 | biology |
| 7 | 2 | 32205470 | 32397931 | 192461 | gain | 2306 | NLRC4,SLC30A6,SPAST,YIPF4 | Y | 0 | 1 | 0.129489977 | 5.34 | biology |
| 8 | 2 | 222117216 | 222123097 | 5881 | gain | 2053 | EPHA4 | N | 0 | 1 | 0.129489977 | 5.34 | biology |
| 9 | 2 | 233864383 | 233925914 | 61531 | gain | 2488 | ATG16L1,SAG | Y | 0 | 1 | 0.129489977 | 5.34 | biology |
| 310 | 3 | 11454506 | 11511697 | 57191 | loss | 2382 | ATG7 | N | 0 | 1 | 0.129489977 | 5.34 | biology |
| 1 | 7 | 5194083 | 5252229 | 58146 | loss | 2410 | WIPI2 | Y | 0 | 1 | 0.129489977 | 5.34 | biology |
| 2 | 7 | 106511676 | 106514719 | 3043 | loss | 2304 | PRKAR2B | N | 1 | 2 | 0.295188364 | 3.57 | biology |
| 3 | 7 | 106511676 | 106514719 | 3043 | loss | 2361 | PRKAR2B | N | 1 | 2 | 0.295188364 | 3.57 | biology |
| 4 | 9 | 139521467 | 139572463 | 50996 | gain | 2582 | MRPL41,PNPLA7,WDR85 | Y | 0 | 1 | 0.129489977 | 5.34 | biology |
| 5 | 10 | 12126119 | 12241327 | 115208 | gain | 2255 | DHTKD1,SEC61A2 | Y | 0 | 1 | 0.129489977 | 5.34 | biology |
| 6 | 11 | 82269399 | 82384109 | 114710 | gain | 2364 | C11orf82,PRCP,RAB30 | Y | 0 | 1 | 0.129489977 | 5.34 | biology |
| 7 | 11 | 93451074 | 93529413 | 78339 | gain | 2322 | HEPHL1,PANX1 | Y | 0 | 1 | 0.129489977 | 5.34 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 8 | 12 | 121985500 | 121986227 | 727 | loss | 2227 | ABCB9 | Y | 0 | 2 | 0.129489977 | 8.92 | biology |
| 9 | 12 | 121985500 | 121986227 | 727 | loss | 2304 | ABCB9 | Y | 0 | 2 | 0.129489977 | 8.92 | biology |
| 311 | 13 | 34521247 | 34527508 | 6261 | gain | 2403 | NBEA | Y | 0 | 1 | 0.129489977 | 5.34 | biology |
| 1 | 15 | 63053972 | 63133302 | 79330 | gain | 2514 | MTFMT,RASL12,SLC51B,SPG21 | Y | 0 | 1 | 0.129489977 | 5.34 | biology |
| 2 | 15 | 88682916 | 88806981 | 124065 | gain | 2260 | GABARAPL3,IQGAP1,ZNF774 | Y | 0 | 1 | 0.129489977 | 5.34 | biology |
| 3 | 18 | 37877518 | 37966336 | 88818 | gain | 2602 | PIK3C3 | Y | 0 | 1 | 0.129489977 | 5.34 | biology |
| 4 | 20 | 57692392 | 57694510 | 2118 | loss | 2187 | PHACTR3 | N | 2 | 2 | 0.622104695 | 1.78 | biology |
| 5 | 20 | 57692392 | 57694510 | 2118 | loss | 2506 | PHACTR3 | N | 2 | 2 | 0.622104695 | 1.78 | biology |
| 6 | 20 | 57731345 | 57748610 | 17265 | loss | 2204 | PHACTR3 | N | 9 | 9 | 0.224256157 | 1.79 | biology |
| 7 | 20 | 57731345 | 57748610 | 17265 | loss | 2249 | PHACTR3 | N | 9 | 9 | 0.224256157 | 1.79 | biology |
| 8 | 20 | 57731345 | 57748610 | 17265 | loss | 2254 | PHACTR3 | N | 9 | 9 | 0.224256157 | 1.79 | biology |
| 9 | 20 | 57731345 | 57748610 | 17265 | loss | 2318 | PHACTR3 | N | 9 | 9 | 0.224256157 | 1.79 | biology |
| 312 | 20 | 57731345 | 57748610 | 17265 | loss | 2361 | PHACTR3 | N | 9 | 9 | 0.224256157 | 1.79 | biology |
| 1 | 20 | 57731345 | 57748610 | 17265 | loss | 2469 | PHACTR3 | N | 9 | 9 | 0.224256157 | 1.79 | biology |
| 2 | 20 | 57731345 | 57748610 | 17265 | loss | 2485 | PHACTR3 | N | 9 | 9 | 0.224256157 | 1.79 | biology |
| 3 | 20 | 57731345 | 57748610 | 17265 | loss | 2576 | PHACTR3 | N | 9 | 9 | 0.224256157 | 1.79 | biology |
| 4 | 20 | 57731345 | 57748610 | 17265 | loss | 2634 | PHACTR3 | N | 9 | 9 | 0.224256157 | 1.79 | biology |
| 5 | 21 | 32869796 | 33019712 | 149916 | gain | 2609 | C21orf59,SYNJ1,TCP10L | Y | 0 | 1 | 0.129489977 | 5.34 | biology |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | Fisher's Detailed Exact (FET) | odds ratio | Category |
|---|---|---|---|---|---|---|---|---|---|---|---|---|---|
| 6 | 21 | 34666916 | 34826979 | 160063 | gain | 2209 | KCNE1,RCAN1,SMIM11 | Y | 2 | 2 | 0.622104695 | 1.78 | biology |
| 7 | 21 | 34666916 | 34826979 | 160063 | gain | 2297 | KCNE1,RCAN1,SMIM11 | Y | 2 | 2 | 0.622104695 | 1.78 | biology |
| 318 | 23 | 2749116 | 2814330 | 65214 | gain | 2333 | GYG2 | Y | 0 | 1 | 0.129489977 | 5.34 | biology |

Figure 9A (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 1 | 9769722 | 9775176 | 5454 | loss | 2178 | CLSTN1 | N | 1 | 6 | 13.04 | Genic; OR > 6 |
| 1 | 9769722 | 9775176 | 5454 | loss | 2448 | CLSTN1 | N | 1 | 6 | 13.04 | Genic; OR > 6 |
| 1 | 9769722 | 9775176 | 5454 | loss | 2534 | CLSTN1 | N | 1 | 6 | 13.04 | Genic; OR > 6 |
| 1 | 9769722 | 9775176 | 5454 | loss | 2549 | CLSTN1 | N | 1 | 6 | 13.04 | Genic; OR > 6 |
| 1 | 9769722 | 9775176 | 5454 | loss | 2610 | CLSTN1 | N | 1 | 6 | 13.04 | Genic; OR > 6 |
| 1 | 9769722 | 9775176 | 5454 | loss | 2616 | CLSTN1 | N | 1 | 6 | 13.04 | Genic; OR > 6 |
| 1 | 9775178 | 9776903 | 1725 | loss | 2178 | CLSTN1 | N | 1 | 6 | 13.04 | Genic; OR > 6 |
| 1 | 9775178 | 9776903 | 1725 | loss | 2244 | CLSTN1 | N | 1 | 6 | 13.04 | Genic; OR > 6 |
| 1 | 9775178 | 9776903 | 1725 | loss | 2448 | CLSTN1 | N | 1 | 6 | 13.04 | Genic; OR > 6 |
| 1 | 9775178 | 9776903 | 1725 | loss | 2534 | CLSTN1 | N | 1 | 6 | 13.04 | Genic; OR > 6 |
| 1 | 9775178 | 9776903 | 1725 | loss | 2549 | CLSTN1 | N | 1 | 6 | 13.0 | Genic; OR > 6 |

Figure 9B

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 1 | 9775178 | 9776903 | 1725 | loss | 2610 | CLSTN1 | N | 1 | 6 | 13.004 | Genic; OR > 6 |
| 1 | 23613915 | 23617786 | 3871 | loss | 2530 | TCEA3 | Y | 0 | 3 | 6.448 | Genic; OR > 6 |
| 1 | 23613915 | 23617786 | 3871 | loss | 2561 | TCEA3 | Y | 0 | 3 | 6.448 | Genic; OR > 6 |
| 1 | 23613915 | 23617786 | 3871 | loss | 2641 | TCEA3 | Y | 0 | 3 | 6.448 | Genic; OR > 6 |
| 1 | 33571827 | 33573694 | 1867 | gain | 2283 | PHC2 | Y | 0 | 2 | 10.84 | Genic (distinct CNV-subregions); OR > 6 |
| 1 | 33571827 | 33573694 | 1867 | gain | 2349 | PHC2 | Y | 0 | 2 | 10.84 | Genic (distinct CNV-subregions); OR > 6 |
| 1 | 33573694 | 33578277 | 4583 | gain | 2430 | PHC2 | N | 0 | 1 | 10.84 | Genic (distinct CNV-subregions); OR > 6 |
| 1 | 33587183 | 33589045 | 1862 | gain | 2457 | PHC2 | Y | 1 | 1 | 10.84 | Genic (distinct CNV-subregions); OR > 6 |
| 1 | 33590327 | 33592389 | 2062 | gain | 2389 | PHC2 | N | 0 | 1 | 10.84 | Genic (distinct CNV-subregions); OR > 6 |
| 1 | 59558536 | 59603781 | 45245 | loss | 2615 | FGGY | Y | 0 | 1 | 6.448 | Genic (distinct CNV-subregions); OR > 6 |
| 1 | 59625013 | 59770305 | 145292 | loss | 2636 | FGGY | Y | 0 | 1 | 6.448 | Genic (distinct CNV-subregions); OR > 6 |
| 1 | 59770306 | 59808791 | 38485 | loss | 2636 | FGGY | Y | 0 | 2 | 6.4 | Genic (distinct CNV- |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 8 | subregions); OR > 6 |
| 1 | 59770306 | 59808791 | 38485 | loss | 2643 | FGGY | Y | 0 | 2 | 6.48 | Genic (distinct CNV-subregions); OR > 6 |
| 1 | 59808792 | 59812162 | 3370 | loss | 2636 | FGGY | N | 1 | 2 | 6.48 | Genic (distinct CNV-subregions); OR > 6 |
| 1 | 59808792 | 59812162 | 3370 | loss | 2643 | FGGY | N | 1 | 2 | 6.48 | Genic (distinct CNV-subregions); OR > 6 |
| 1 | 59812163 | 59825004 | 12841 | loss | 2636 | FGGY | N | 0 | 2 | 6.48 | Genic (distinct CNV-subregions); OR > 6 |
| 1 | 59812163 | 59825004 | 12841 | loss | 2643 | FGGY | N | 0 | 2 | 6.48 | Genic (distinct CNV-subregions); OR > 6 |
| 1 | 94922323 | 94925649 | 3326 | gain | 2048 | | N | 1 | 6 | 13.04 | Non-genic; OR > 10 |
| 1 | 94922323 | 94925649 | 3326 | gain | 2223 | | N | 1 | 6 | 13.04 | Non-genic; OR > 10 |
| 1 | 94922323 | 94925649 | 3326 | gain | 2448 | | N | 1 | 6 | 13.04 | Non-genic; OR > 10 |
| 1 | 94922323 | 94925649 | 3326 | gain | 2513 | | N | 1 | 6 | 13.04 | Non-genic; OR > 10 |
| 1 | 94922323 | 94925649 | 3326 | gain | 2536 | | N | 1 | 6 | 13.04 | Non-genic; OR > 10 |
| 1 | 94922323 | 94925649 | 3326 | loss | 2590 | | N | 1 | 6 | 13. | Non-genic; OR > 10 |

Figure 9B (Continued)

| Figure 9B | | | | | | | | | | |
|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 1 | 100819146 | 100820835 | 1689 | loss | 2046 | | N | 1 | 8 | 17.446 | Non-genic; OR > 10 |
| 1 | 100819146 | 100820835 | 1689 | loss | 2218 | | N | 1 | 8 | 17.446 | Non-genic; OR > 10 |
| 1 | 100819146 | 100820835 | 1689 | loss | 2360 | | N | 1 | 8 | 17.446 | Non-genic; OR > 10 |
| 1 | 100819146 | 100820835 | 1689 | loss | 2365 | | N | 1 | 8 | 17.446 | Non-genic; OR > 10 |
| 1 | 100819146 | 100820835 | 1689 | loss | 2558 | | N | 1 | 8 | 17.446 | Non-genic; OR > 10 |
| 1 | 100819146 | 100820835 | 1689 | loss | 2604 | | N | 1 | 8 | 17.446 | Non-genic; OR > 10 |
| 1 | 100819146 | 100820835 | 1689 | loss | 2611 | | N | 1 | 8 | 17.446 | Non-genic; OR > 10 |
| 1 | 100819146 | 100820835 | 1689 | loss | 2612 | | N | 1 | 8 | 17.446 | Non-genic; OR > 10 |
| 1 | 109520130 | 109523136 | 3006 | gain | 2359 | KIAA1324 | N | 1 | 7 | 15.225 | Genic; OR > 6 |
| 1 | 109520130 | 109523136 | 3006 | gain | 2368 | KIAA1324 | N | 1 | 7 | 15.225 | Genic; OR > 6 |
| 1 | 109520130 | 109523136 | 3006 | gain | 2386 | KIAA1324 | N | 1 | 7 | 15. | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 1 | 109520130 | 109523136 | 3006 | gain | 2444 | KIAA1324 | N | 1 | 7 | 15.225 | Genic; OR > 6 |
| 1 | 109520130 | 109523136 | 3006 | gain | 2604 | KIAA1324 | N | 1 | 7 | 15.225 | Genic; OR > 6 |
| 1 | 109520130 | 109523136 | 3006 | gain | 2605 | KIAA1324 | N | 1 | 7 | 15.225 | Genic; OR > 6 |
| 1 | 109520130 | 109523136 | 3006 | gain | 2628 | KIAA1324 | N | 1 | 7 | 15.225 | Genic; OR > 6 |
| 1 | 111732268 | 111734021 | 1753 | loss | 2221 | PGCP1 | Y | 8 | 9 | 6.48 | Genic (distinct CNV-subregions); OR > 6 |
| 1 | 111732268 | 111734021 | 1753 | loss | 2245 | PGCP1 | Y | 8 | 9 | 6.48 | Genic (distinct CNV-subregions); OR > 6 |
| 1 | 111732268 | 111734021 | 1753 | loss | 2256 | PGCP1 | Y | 8 | 9 | 6.48 | Genic (distinct CNV-subregions); OR > 6 |
| 1 | 111732268 | 111734021 | 1753 | loss | 2284 | PGCP1 | Y | 8 | 9 | 6.48 | Genic (distinct CNV-subregions); OR > 6 |
| 1 | 111732268 | 111734021 | 1753 | loss | 2292 | PGCP1 | Y | 8 | 9 | 6.48 | Genic (distinct CNV-subregions); OR > 6 |
| 1 | 111732268 | 111734021 | 1753 | loss | 2360 | PGCP1 | Y | 8 | 9 | 6.48 | Genic (distinct CNV-subregions); OR > 6 |
| 1 | 111732268 | 111734021 | 1753 | loss | 2362 | PGCP1 | Y | 8 | 9 | 6.48 | Genic (distinct CNV- |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | | | | | | | | | | 8 | subregions); OR > 6 |
| 1 | 111732268 | 111734021 | 1753 | loss | 2515 | PGCP1 | Y | 8 | 9 | 6.48 | Genic (distinct CNV-subregions); OR > 6 |
| 1 | 111732268 | 111734021 | 1753 | loss | 2544 | PGCP1 | Y | 8 | 9 | 6.48 | Genic (distinct CNV-subregions); OR > 6 |
| 1 | 169843029 | 169877679 | 34650 | loss | 2402 | MYOC | Y | 0 | 2 | 6.48 | Genic (distinct CNV-subregions); OR > 6 |
| 1 | 169843029 | 169877679 | 34650 | loss | 2403 | MYOC | Y | 0 | 2 | 6.48 | Genic (distinct CNV-subregions); OR > 6 |
| 1 | 169880120 | 169881278 | 1158 | loss | 2637 | MYOC | N | 1 | 1 | 6.48 | Genic (distinct CNV-subregions); OR > 6 |
| 1 | 181900399 | 181907383 | 6984 | loss | 2193 | RGL1 | N | 0 | 2 | 6.48 | Genic (distinct CNV-subregions); OR > 6 |
| 1 | 181900399 | 181907383 | 6984 | loss | 2359 | RGL1 | N | 0 | 2 | 6.48 | Genic (distinct CNV-subregions); OR > 6 |
| 1 | 182098193 | 182583365 | 485172 | gain | 2404 | RGL1,GLT25D2,TSEN15 | Y | 0 | 1 | 6.48 | Genic (distinct CNV-subregions); OR > 6 |
| 1 | 235341008 | 235345656 | 4648 | loss | 2365 | RYR2 | N | 1 | 2 | 6.48 | Genic (distinct CNV-subregions); OR > 6 |
| 1 | 235341008 | 235345656 | 4648 | loss | 2632 | RYR2 | N | 1 | 2 | 6.48 | Genic (distinct CNV-subregions); OR > 6 |
| 1 | 235489497 | 235490959 | 1462 | loss | 2184 | RYR2 | N | 0 | 1 | 6.4 | Genic (distinct CNV- |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 8 | subregions); OR > 6 |
| 1 | 246769019 | 246794551 | 25532 | gain | 2204 | OR2T29 | Y | 1 | 3 | 6.448 | Genic; OR > 6 |
| 1 | 246769019 | 246794551 | 25532 | gain | 2433 | OR2T29 | Y | 1 | 3 | 6.448 | Genic; OR > 6 |
| 1 | 246769019 | 246794551 | 25532 | gain | 2443 | OR2T29 | Y | 1 | 3 | 6.448 | Genic; OR > 6 |
| 2 | 9773325 | 9776315 | 2990 | loss | 2176 | | N | 0 | 5 | 10.884 | Non-genic; OR > 10 |
| 2 | 9773325 | 9776315 | 2990 | loss | 2188 | | N | 0 | 5 | 10.884 | Non-genic; OR > 10 |
| 2 | 9773325 | 9776315 | 2990 | loss | 2214 | | N | 0 | 5 | 10.884 | Non-genic; OR > 10 |
| 2 | 9773325 | 9776315 | 2990 | loss | 2474 | | N | 0 | 5 | 10.884 | Non-genic; OR > 10 |
| 2 | 9773325 | 9776315 | 2990 | loss | 2500 | | N | 0 | 5 | 10.884 | Non-genic; OR > 10 |
| 2 | 46430798 | 46434943 | 4145 | gain | 2268 | EPAS1 | N | 3 | 20 | 14.991 | Genic; OR > 6 |
| 2 | 46430798 | 46434943 | 4145 | gain | 2283 | EPAS1 | N | 3 | 20 | 14.991 | Genic; OR > 6 |
| 2 | 46430798 | 46434943 | 4145 | gain | 2290 | EPAS1 | N | 3 | 20 | 14.991 | Genic; OR > 6 |
| 2 | 46430798 | 46434943 | 4145 | gain | 2297 | EPAS1 | N | 3 | 20 | 1 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | 98 | 43 | | n | | | | | | 14.91 | |
| 2 | 46430798 | 46434943 | 4145 | gain | 2298 | EPAS1 | N | 3 | 20 | 14.91 | Genic; OR > 6 |
| 2 | 46430798 | 46434943 | 4145 | gain | 2312 | EPAS1 | N | 3 | 20 | 14.91 | Genic; OR > 6 |
| 2 | 46430798 | 46434943 | 4145 | gain | 2314 | EPAS1 | N | 3 | 20 | 14.91 | Genic; OR > 6 |
| 2 | 46430798 | 46434943 | 4145 | gain | 2359 | EPAS1 | N | 3 | 20 | 14.91 | Genic; OR > 6 |
| 2 | 46430798 | 46434943 | 4145 | gain | 2365 | EPAS1 | N | 3 | 20 | 14.91 | Genic; OR > 6 |
| 2 | 46430798 | 46434943 | 4145 | gain | 2367 | EPAS1 | N | 3 | 20 | 14.91 | Genic; OR > 6 |
| 2 | 46430798 | 46434943 | 4145 | gain | 2382 | EPAS1 | N | 3 | 20 | 14.91 | Genic; OR > 6 |
| 2 | 46430798 | 46434943 | 4145 | gain | 2391 | EPAS1 | N | 3 | 20 | 14.91 | Genic; OR > 6 |
| 2 | 46430798 | 46434943 | 4145 | gain | 2445 | EPAS1 | N | 3 | 20 | 14.91 | Genic; OR > 6 |
| 2 | 46430798 | 46434943 | 4145 | gain | 2542 | EPAS1 | N | 3 | 20 | 14.91 | Genic; OR > 6 |
| 2 | 46430798 | 46434943 | 4145 | gain | 2569 | EPAS1 | N | 3 | 20 | 1 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | 98 | 43 | | n | | | | | | 4.91 | |
| 2 | 46430798 | 46434943 | 4145 | gain | 2579 | EPAS1 | N | 3 | 20 | 14.91 | Genic; OR > 6 |
| 2 | 46430798 | 46434943 | 4145 | gain | 2580 | EPAS1 | N | 3 | 20 | 14.91 | Genic; OR > 6 |
| 2 | 46430798 | 46434943 | 4145 | gain | 2584 | EPAS1 | N | 3 | 20 | 14.91 | Genic; OR > 6 |
| 2 | 46430798 | 46434943 | 4145 | gain | 2595 | EPAS1 | N | 3 | 20 | 14.91 | Genic; OR > 6 |
| 2 | 46430798 | 46434943 | 4145 | gain | 2627 | EPAS1 | N | 3 | 20 | 14.91 | Genic; OR > 6 |
| 2 | 50636634 | 50639069 | 2435 | loss | 2208 | NRXN1 | N | 0 | 4 | 8.66 | Genic; OR > 6 |
| 2 | 50636634 | 50639069 | 2435 | loss | 2365 | NRXN1 | N | 0 | 4 | 8.66 | Genic; OR > 6 |
| 2 | 50636634 | 50639069 | 2435 | loss | 2453 | NRXN1 | N | 0 | 4 | 8.66 | Genic; OR > 6 |
| 2 | 50636634 | 50639069 | 2435 | loss | 2620 | NRXN1 | N | 0 | 4 | 8.66 | Genic; OR > 6 |
| 2 | 50639070 | 50642429 | 3359 | loss | 2204 | NRXN1 | N | 1 | 8 | 17.46 | Genic; OR > 6 |
| 2 | 50639070 | 50642429 | 3359 | loss | 2208 | NRXN1 | N | 1 | 8 | 17.46 | Genic; OR > 6 |
| 2 | 506390 | 506424 | 3359 | loss | 2225 | NRXN1 | N | 1 | 8 | 1 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | 70 | 29 | | | | | | | | 7.46 | |
| 2 | 50639070 | 50642429 | 3359 | loss | 2228 | NRXN1 | N | 1 | 8 | 17.46 | Genic; OR > 6 |
| 2 | 50639070 | 50642429 | 3359 | loss | 2365 | NRXN1 | N | 1 | 8 | 17.46 | Genic; OR > 6 |
| 2 | 50639070 | 50642429 | 3359 | loss | 2453 | NRXN1 | N | 1 | 8 | 17.46 | Genic; OR > 6 |
| 2 | 50639070 | 50642429 | 3359 | loss | 2482 | NRXN1 | N | 1 | 8 | 17.46 | Genic; OR > 6 |
| 2 | 50639070 | 50642429 | 3359 | loss | 2620 | NRXN1 | N | 1 | 8 | 17.46 | Genic; OR > 6 |
| 2 | 54869538 | 54913661 | 44123 | loss | 2370 | EML6 | Y | 0 | 1 | 8.66 | Genic (distinct CNV-subregions); OR > 6 |
| 2 | 54958291 | 54961012 | 2721 | loss | 2192 | EML6 | Y | 1 | 2 | 8.66 | Genic (distinct CNV-subregions); OR > 6 |
| 2 | 54958291 | 54961012 | 2721 | gain | 2565 | EML6 | Y | 1 | 2 | 8.66 | Genic (distinct CNV-subregions); OR > 6 |
| 2 | 55017498 | 55028174 | 10676 | gain | 2350 | EML6 | N | 0 | 1 | 8.66 | Genic (distinct CNV-subregions); OR > 6 |
| 2 | 87131062 | 87136600 | 5538 | gain | 2190 | LOC285074 | Y | 2 | 6 | 6.551 | Genic; OR > 6 |
| 2 | 87131062 | 87136600 | 5538 | loss | 2242 | LOC285074 | Y | 2 | 6 | 6.5 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 1 | |
| 2 | 87131062 | 87136600 | 5538 | loss | 2246 | LOC285074 | Y | 2 | 6 | 6.651 | Genic; OR > 6 |
| 2 | 87131062 | 87136600 | 5538 | gain | 2282 | LOC285074 | Y | 2 | 6 | 6.651 | Genic; OR > 6 |
| 2 | 87131062 | 87136600 | 5538 | gain | 2378 | LOC285074 | Y | 2 | 6 | 6.651 | Genic; OR > 6 |
| 2 | 87131062 | 87136600 | 5538 | loss | 2440 | LOC285074 | Y | 2 | 6 | 6.651 | Genic; OR > 6 |
| 2 | 87926462 | 88008343 | 81881 | gain | 2378 | RGPD1 | N | 0 | 3 | 6.448 | Genic; OR > 6 |
| 2 | 87926462 | 88008343 | 81881 | loss | 2440 | RGPD1 | N | 0 | 3 | 6.448 | Genic; OR > 6 |
| 2 | 87926462 | 88008343 | 81881 | gain | 2591 | RGPD1 | N | 0 | 3 | 6.448 | Genic; OR > 6 |
| 2 | 109296265 | 109297575 | 1310 | gain | 2049 | SH3RF3,MIR4266 | Y | 0 | 3 | 6.448 | Genic; OR > 6 |
| 2 | 109296265 | 109297575 | 1310 | gain | 2487 | SH3RF3,MIR4266 | Y | 0 | 3 | 6.448 | Genic; OR > 6 |
| 2 | 109296265 | 109297575 | 1310 | gain | 2506 | SH3RF3,MIR4266 | Y | 0 | 3 | 6.448 | Genic; OR > 6 |
| 2 | 144135530 | 144141642 | 6112 | gain | 2169 | ARHGAP15 | N | 1 | 3 | 6.448 | Genic; OR > 6 |
| 2 | 144135530 | 144141642 | 6112 | gain | 2548 | ARHGAP15 | N | 1 | 3 | 6.448 | Genic; OR > 6 |
| 2 | 144135530 | 144141642 | 6112 | gain | 2639 | ARHGAP15 | N | 1 | 3 | 6.448 | Genic; OR > 6 |
| 2 | 159999256 | 160001131 | 1875 | loss | 2058 | BAZ2B | N | 1 | 5 | 10.8 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | | | | | | | | | | 4 | |
| 2 | 159999256 | 160001131 | 1875 | loss | 2219 | BAZ2B | N | 1 | 5 | 10.884 | Genic; OR > 6 |
| 2 | 159999256 | 160001131 | 1875 | loss | 2497 | BAZ2B | N | 1 | 5 | 10.884 | Genic; OR > 6 |
| 2 | 159999256 | 160001131 | 1875 | loss | 2615 | BAZ2B | N | 1 | 5 | 10.884 | Genic; OR > 6 |
| 2 | 159999256 | 160001131 | 1875 | loss | 2628 | BAZ2B | N | 1 | 5 | 10.884 | Genic; OR > 6 |
| 2 | 205501455 | 205502769 | 1314 | loss | 2280 | PARD3B | N | 0 | 7 | 15.225 | Genic; OR > 6 |
| 2 | 205501455 | 205502769 | 1314 | loss | 2341 | PARD3B | N | 0 | 7 | 15.225 | Genic; OR > 6 |
| 2 | 205501455 | 205502769 | 1314 | loss | 2365 | PARD3B | N | 0 | 7 | 15.225 | Genic; OR > 6 |
| 2 | 205501455 | 205502769 | 1314 | loss | 2377 | PARD3B | N | 0 | 7 | 15.225 | Genic; OR > 6 |
| 2 | 205501455 | 205502769 | 1314 | loss | 2393 | PARD3B | N | 0 | 7 | 15.225 | Genic; OR > 6 |
| 2 | 205501455 | 205502769 | 1314 | loss | 2429 | PARD3B | N | 0 | 7 | 15.225 | Genic; OR > 6 |
| 2 | 205501455 | 205502769 | 1314 | loss | 2566 | PARD3B | N | 0 | 7 | 15.2 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 5 | |
| 2 | 208339551 | 208341819 | 2268 | gain | 2269 | FZD5 | Y | 0 | 2 | 6.48 | Genic (distinct CNV-subregions); OR > 6 |
| 2 | 208339551 | 208341819 | 2268 | gain | 2319 | FZD5 | Y | 0 | 2 | 6.48 | Genic (distinct CNV-subregions); OR > 6 |
| 2 | 208341819 | 208343999 | 2180 | gain | 2316 | FZD5 | Y | 0 | 1 | 6.48 | Genic (distinct CNV-subregions); OR > 6 |
| 2 | 231867046 | 231873096 | 6050 | loss | 2350 | ARMC9 | Y | 0 | 1 | 6.48 | Genic (distinct CNV-subregions); OR > 6 |
| 2 | 231907943 | 231912318 | 4375 | loss | 2454 | ARMC9 | N | 0 | 2 | 6.48 | Genic (distinct CNV-subregions); OR > 6 |
| 2 | 231907943 | 231912318 | 4375 | loss | 2484 | ARMC9 | N | 0 | 2 | 6.48 | Genic (distinct CNV-subregions); OR > 6 |
| 2 | 236964034 | 236981253 | 17219 | loss | 2182 | IQCA1 | Y | 0 | 1 | 6.48 | Genic (distinct CNV-subregions); OR > 6 |
| 2 | 236985613 | 236990568 | 4955 | loss | 2299 | IQCA1 | N | 0 | 2 | 6.48 | Genic (distinct CNV-subregions); OR > 6 |
| 2 | 236985613 | 236990568 | 4955 | gain | 2603 | IQCA1 | N | 0 | 2 | 6.48 | Genic (distinct CNV-subregions); OR > 6 |
| 2 | 236990569 | 236993935 | 3366 | gain | 2603 | IQCA1 | Y | 0 | 1 | 6.48 | Genic (distinct CNV-subregions); OR > 6 |
| 3 | 2003576 | 2006650 | 3074 | gain | 2295 | | N | 0 | 5 | 10.8 | Non-genic; OR > 10 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 3 | 2003576 | 2006650 | 3074 | gain | 2355 | | N | 0 | 5 | 10.884 | Non-genic; OR > 10 |
| 3 | 2003576 | 2006650 | 3074 | gain | 2360 | | N | 0 | 5 | 10.884 | Non-genic; OR > 10 |
| 3 | 2003576 | 2006650 | 3074 | gain | 2386 | | N | 0 | 5 | 10.884 | Non-genic; OR > 10 |
| 3 | 2003576 | 2006650 | 3074 | gain | 2594 | | N | 0 | 5 | 10.884 | Non-genic; OR > 10 |
| 3 | 47967619 | 47975473 | 7854 | gain | 2563 | MAP4 | N | 1 | 3 | 6.448 | Genic; OR > 6 |
| 3 | 47967619 | 47975473 | 7854 | gain | 2603 | MAP4 | N | 1 | 3 | 6.448 | Genic; OR > 6 |
| 3 | 47967619 | 47975473 | 7854 | gain | 2617 | MAP4 | N | 1 | 3 | 6.448 | Genic; OR > 6 |
| 3 | 47975474 | 47976958 | 1484 | gain | 2563 | MAP4 | N | 0 | 3 | 6.448 | Genic; OR > 6 |
| 3 | 47975474 | 47976958 | 1484 | gain | 2603 | MAP4 | N | 0 | 3 | 6.448 | Genic; OR > 6 |
| 3 | 47975474 | 47976958 | 1484 | gain | 2617 | MAP4 | N | 0 | 3 | 6.448 | Genic; OR > 6 |
| 3 | 56583582 | 56594585 | 11003 | loss | 2051 | CCDC66 | N | 1 | 3 | 6.448 | Genic; OR > 6 |
| 3 | 56583582 | 56594585 | 11003 | gain | 2191 | CCDC66 | N | 1 | 3 | 6.448 | Genic; OR > 6 |
| 3 | 56583582 | 56594585 | 11003 | loss | 2389 | CCDC66 | N | 1 | 3 | 6.448 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 3 | 162734077 | 162742289 | 8212 | loss | 2336 | | N | 1 | 6 | 13.004 | Non-genic; OR > 10 |
| 3 | 162734077 | 162742289 | 8212 | loss | 2352 | | N | 1 | 6 | 13.004 | Non-genic; OR > 10 |
| 3 | 162734077 | 162742289 | 8212 | loss | 2358 | | N | 1 | 6 | 13.004 | Non-genic; OR > 10 |
| 3 | 162734077 | 162742289 | 8212 | loss | 2488 | | N | 1 | 6 | 13.004 | Non-genic; OR > 10 |
| 3 | 162734077 | 162742289 | 8212 | loss | 2614 | | N | 1 | 6 | 13.004 | Non-genic; OR > 10 |
| 3 | 162734077 | 162742289 | 8212 | loss | 2642 | | N | 1 | 6 | 13.004 | Non-genic; OR > 10 |
| 3 | 169807923 | 169824114 | 16191 | gain | 2616 | EGFEM1P | N | 0 | 1 | 6.48 | Genic (distinct CNV-subregions); OR > 6 |
| 3 | 169911847 | 169915257 | 3410 | loss | 2469 | EGFEM1P | N | 0 | 1 | 6.48 | Genic (distinct CNV-subregions); OR > 6 |
| 3 | 169954218 | 170016745 | 62527 | loss | 2251 | EGFEM1P | Y | 0 | 1 | 6.48 | Genic (distinct CNV-subregions); OR > 6 |
| 3 | 172536723 | 172538075 | 1352 | gain | 2054 | TNIK | N | 1 | 9 | 19.669 | Genic; OR > 6 |
| 3 | 172536723 | 172538075 | 1352 | gain | 2279 | TNIK | N | 1 | 9 | 19.669 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 3 | 172536723 | 172538075 | 1352 | gain | 2283 | TNIK | N | 1 | 9 | 19.669 | Genic; OR > 6 |
| 3 | 172536723 | 172538075 | 1352 | gain | 2421 | TNIK | N | 1 | 9 | 19.669 | Genic; OR > 6 |
| 3 | 172536723 | 172538075 | 1352 | gain | 2594 | TNIK | N | 1 | 9 | 19.669 | Genic; OR > 6 |
| 3 | 172536723 | 172538075 | 1352 | gain | 2601 | TNIK | N | 1 | 9 | 19.669 | Genic; OR > 6 |
| 3 | 172536723 | 172538075 | 1352 | gain | 2610 | TNIK | N | 1 | 9 | 19.669 | Genic; OR > 6 |
| 3 | 172536723 | 172538075 | 1352 | gain | 2614 | TNIK | N | 1 | 9 | 19.669 | Genic; OR > 6 |
| 3 | 172536723 | 172538075 | 1352 | gain | 2645 | TNIK | N | 1 | 9 | 19.669 | Genic; OR > 6 |
| 3 | 172538076 | 172539488 | 1412 | gain | 2054 | TNIK | N | 1 | 8 | 17.446 | Genic; OR > 6 |
| 3 | 172538076 | 172539488 | 1412 | gain | 2283 | TNIK | N | 1 | 8 | 17.446 | Genic; OR > 6 |
| 3 | 172538076 | 172539488 | 1412 | gain | 2421 | TNIK | N | 1 | 8 | 17.446 | Genic; OR > 6 |
| 3 | 172538076 | 172539488 | 1412 | gain | 2594 | TNIK | N | 1 | 8 | 17.446 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 3 | 172538076 | 172539488 | 1412 | gain | 2601 | TNIK | N | 1 | 8 | 17.446 | Genic; OR > 6 |
| 3 | 172538076 | 172539488 | 1412 | gain | 2610 | TNIK | N | 1 | 8 | 17.446 | Genic; OR > 6 |
| 3 | 172538076 | 172539488 | 1412 | gain | 2614 | TNIK | N | 1 | 8 | 17.446 | Genic; OR > 6 |
| 3 | 172538076 | 172539488 | 1412 | gain | 2645 | TNIK | N | 1 | 8 | 17.446 | Genic; OR > 6 |
| 4 | 9563785 | 9565052 | 1267 | loss | 2048 | SLC2A9 | N | 5 | 18 | 8.000 | Genic; OR > 6 |
| 4 | 9563785 | 9565052 | 1267 | loss | 2050 | SLC2A9 | N | 5 | 18 | 8.000 | Genic; OR > 6 |
| 4 | 9563785 | 9565052 | 1267 | loss | 2051 | SLC2A9 | N | 5 | 18 | 8.000 | Genic; OR > 6 |
| 4 | 9563785 | 9565052 | 1267 | loss | 2172 | SLC2A9 | N | 5 | 18 | 8.000 | Genic; OR > 6 |
| 4 | 9563785 | 9565052 | 1267 | loss | 2257 | SLC2A9 | N | 5 | 18 | 8.000 | Genic; OR > 6 |
| 4 | 9563785 | 9565052 | 1267 | loss | 2288 | SLC2A9 | N | 5 | 18 | 8.000 | Genic; OR > 6 |
| 4 | 9563785 | 9565052 | 1267 | loss | 2332 | SLC2A9 | N | 5 | 18 | 8.000 | Genic; OR > 6 |
| 4 | 9563785 | 9565052 | 1267 | loss | 2365 | SLC2A9 | N | 5 | 18 | 8.000 | Genic; OR > 6 |
| 4 | 9563785 | 9565052 | 1267 | loss | 2405 | SLC2A9 | N | 5 | 18 | 8.000 | Genic; OR > 6 |
| 4 | 9563785 | 9565052 | 1267 | loss | 2406 | SLC2A9 | N | 5 | 18 | 8. | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | 5 | 2 | | | | | | | | 00 | |
| 4 | 9563785 | 9565052 | 1267 | loss | 2419 | SLC2A9 | N | 5 | 18 | 8.00 | Genic; OR > 6 |
| 4 | 9563785 | 9565052 | 1267 | loss | 2428 | SLC2A9 | N | 5 | 18 | 8.00 | Genic; OR > 6 |
| 4 | 9563785 | 9565052 | 1267 | loss | 2435 | SLC2A9 | N | 5 | 18 | 8.00 | Genic; OR > 6 |
| 4 | 9563785 | 9565052 | 1267 | loss | 2501 | SLC2A9 | N | 5 | 18 | 8.00 | Genic; OR > 6 |
| 4 | 9563785 | 9565052 | 1267 | loss | 2519 | SLC2A9 | N | 5 | 18 | 8.00 | Genic; OR > 6 |
| 4 | 9563785 | 9565052 | 1267 | loss | 2568 | SLC2A9 | N | 5 | 18 | 8.00 | Genic; OR > 6 |
| 4 | 9563785 | 9565052 | 1267 | loss | 2596 | SLC2A9 | N | 5 | 18 | 8.00 | Genic; OR > 6 |
| 4 | 9563785 | 9565052 | 1267 | loss | 2615 | SLC2A9 | N | 5 | 18 | 8.00 | Genic; OR > 6 |
| 4 | 73143133 | 73145178 | 2045 | gain | 2451 | NPFFR2 | N | 0 | 4 | 8.666 | Genic; OR > 6 |
| 4 | 73143133 | 73145178 | 2045 | gain | 2475 | NPFFR2 | N | 0 | 4 | 8.666 | Genic; OR > 6 |
| 4 | 73143133 | 73145178 | 2045 | gain | 2534 | NPFFR2 | N | 0 | 4 | 8.666 | Genic; OR > 6 |
| 4 | 73143133 | 73145178 | 2045 | gain | 2536 | NPFFR2 | N | 0 | 4 | 8.666 | Genic; OR > 6 |
| 4 | 106681766 | 106712855 | 31089 | loss | 2428 | ARHGEF38 | Y | 0 | 2 | 6.448 | Genic (distinct CNV-subregions); OR > 6 |
| 4 | 106681766 | 106712855 | 31089 | loss | 2457 | ARHGEF38 | Y | 0 | 2 | 6.4 | Genic (distinct CNV- |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 8 | subregions); OR > 6 |
| 4 | 106733769 | 106778760 | 44991 | loss | 2603 | ARHGEF38 | Y | 0 | 1 | 6.48 | Genic (distinct CNV-subregions); OR > 6 |
| 4 | 129993002 | 129997476 | 4474 | gain | 2454 | PHF17 | Y | 1 | 3 | 6.48 | Genic; OR > 6 |
| 4 | 129993002 | 129997476 | 4474 | gain | 2578 | PHF17 | Y | 1 | 3 | 6.48 | Genic; OR > 6 |
| 4 | 129993002 | 129997476 | 4474 | gain | 2590 | PHF17 | Y | 1 | 3 | 6.48 | Genic; OR > 6 |
| 5 | 53256559 | 53257616 | 1057 | loss | 2626 | ARL15 | N | 0 | 1 | 8.66 | Genic (distinct CNV-subregions); OR > 6 |
| 5 | 53351698 | 53355998 | 4300 | loss | 2191 | ARL15 | N | 0 | 2 | 8.66 | Genic (distinct CNV-subregions); OR > 6 |
| 5 | 53351698 | 53355998 | 4300 | loss | 2489 | ARL15 | N | 0 | 2 | 8.66 | Genic (distinct CNV-subregions); OR > 6 |
| 5 | 53358703 | 53416621 | 57918 | gain | 2534 | ARL15 | N | 0 | 1 | 8.66 | Genic (distinct CNV-subregions); OR > 6 |
| 5 | 53416622 | 53433006 | 16384 | gain | 2534 | ARL15 | N | 1 | 1 | 8.66 | Genic (distinct CNV-subregions); OR > 6 |
| 5 | 53433007 | 53851975 | 418968 | gain | 2534 | ARL15,HSPB3,SNX18 | Y | 0 | 1 | 6.48 | Genic (distinct CNV-subregions); OR > 6 |
| 5 | 78410921 | 78425666 | 14745 | gain | 2377 | BHMT2 | Y | 1 | 3 | 6.48 | Genic; OR > 6 |
| 5 | 78410921 | 78425666 | 14745 | gain | 2523 | BHMT2 | Y | 1 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 5 | 78410921 | 78425666 | 14745 | gain | 2529 | BHMT2 | Y | 1 | 3 | 6.648 | Genic; OR > 6 |
| 5 | 109099285 | 109100436 | 1151 | gain | 2409 | MAN2A1,MIR548Z,MIR548C | N | 1 | 3 | 6.648 | Genic; OR > 6 |
| 5 | 109099285 | 109100436 | 1151 | gain | 2433 | MAN2A1,MIR548Z,MIR548C | N | 1 | 3 | 6.648 | Genic; OR > 6 |
| 5 | 109099285 | 109100436 | 1151 | gain | 2603 | MAN2A1,MIR548Z,MIR548C | N | 1 | 3 | 6.648 | Genic; OR > 6 |
| 5 | 115491539 | 115512186 | 20647 | loss | 2350 | COMMD10 | Y | 0 | 2 | 8.66 | Genic (distinct CNV-subregions); OR > 6 |
| 5 | 115491539 | 115512186 | 20647 | loss | 2456 | COMMD10 | Y | 0 | 2 | 8.66 | Genic (distinct CNV-subregions); OR > 6 |
| 5 | 115560106 | 115591371 | 31265 | loss | 2642 | COMMD10 | N | 1 | 1 | 8.66 | Genic (distinct CNV-subregions); OR > 6 |
| 5 | 115591372 | 115604790 | 13418 | loss | 2473 | COMMD10 | N | 1 | 2 | 8.66 | Genic (distinct CNV-subregions); OR > 6 |
| 5 | 115591372 | 115604790 | 13418 | loss | 2642 | COMMD10 | N | 1 | 2 | 8.66 | Genic (distinct CNV-subregions); OR > 6 |
| 5 | 115604791 | 115607418 | 2627 | loss | 2642 | COMMD10 | N | 1 | 1 | 8.66 | Genic (distinct CNV-subregions); OR > 6 |
| 5 | 115607419 | 115614772 | 7353 | loss | 2350 | COMMD10 | N | 1 | 2 | 8.66 | Genic (distinct CNV-subregions); OR > 6 |
| 5 | 115607419 | 115614772 | 7353 | loss | 2642 | COMMD10 | N | 1 | 2 | 8.66 | Genic (distinct CNV-subregions); |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | | | | | | | | | | | OR > 6 |
| 5 | 115614773 | 115636905 | 22132 | loss | 2642 | COMMD10 | N | 1 | 1 | 8.66 | Genic (distinct CNV-subregions); OR > 6 |
| 5 | 125923359 | 125924811 | 1452 | gain | 2280 | ALDH7A1 | Y | 1 | 6 | 13.04 | Genic; OR > 6 |
| 5 | 125923359 | 125924811 | 1452 | gain | 2360 | ALDH7A1 | Y | 1 | 6 | 13.04 | Genic; OR > 6 |
| 5 | 125923359 | 125924811 | 1452 | gain | 2361 | ALDH7A1 | Y | 1 | 6 | 13.04 | Genic; OR > 6 |
| 5 | 125923359 | 125924811 | 1452 | gain | 2366 | ALDH7A1 | Y | 1 | 6 | 13.04 | Genic; OR > 6 |
| 5 | 125923359 | 125924811 | 1452 | gain | 2395 | ALDH7A1 | Y | 1 | 6 | 13.04 | Genic; OR > 6 |
| 5 | 125923359 | 125924811 | 1452 | gain | 2418 | ALDH7A1 | Y | 1 | 6 | 13.04 | Genic; OR > 6 |
| 5 | 137482548 | 137488409 | 5861 | gain | 2228 | NME5 | N | 1 | 3 | 6.448 | Genic; OR > 6 |
| 5 | 137482548 | 137488409 | 5861 | gain | 2519 | NME5 | N | 1 | 3 | 6.448 | Genic; OR > 6 |
| 5 | 137482548 | 137488409 | 5861 | gain | 2604 | NME5 | N | 1 | 3 | 6.448 | Genic; OR > 6 |
| 5 | 167051094 | 167054549 | 3455 | gain | 2265 | ODZ2 | N | 0 | 3 | 6.448 | Genic; OR > 6 |
| 5 | 167051094 | 167054549 | 3455 | gain | 2348 | ODZ2 | N | 0 | 3 | 6.448 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 5 | 167051094 | 167054549 | 3455 | gain | 2620 | ODZ2 | N | 0 | 3 | 6.448 | Genic; OR > 6 |
| 6 | 2077106 | 2093566 | 16460 | loss | 2519 | GMDS | N | 0 | 3 | 6.448 | Genic; OR > 6 |
| 6 | 2077106 | 2093566 | 16460 | loss | 2520 | GMDS | N | 0 | 3 | 6.448 | Genic; OR > 6 |
| 6 | 2077106 | 2093566 | 16460 | loss | 2636 | GMDS | N | 0 | 3 | 6.448 | Genic; OR > 6 |
| 6 | 2678569 | 2680370 | 1801 | loss | 2448 | MYLK4 | N | 0 | 3 | 6.448 | Genic; OR > 6 |
| 6 | 2678569 | 2680370 | 1801 | loss | 2475 | MYLK4 | N | 0 | 3 | 6.448 | Genic; OR > 6 |
| 6 | 2678569 | 2680370 | 1801 | loss | 2637 | MYLK4 | N | 0 | 3 | 6.448 | Genic; OR > 6 |
| 6 | 20640854 | 20646496 | 5642 | gain | 2364 | CDKAL1 | Y | 0 | 3 | 6.448 | Genic; OR > 6 |
| 6 | 20640854 | 20646496 | 5642 | gain | 2566 | CDKAL1 | Y | 0 | 3 | 6.448 | Genic; OR > 6 |
| 6 | 20640854 | 20646496 | 5642 | gain | 2622 | CDKAL1 | Y | 0 | 3 | 6.448 | Genic; OR > 6 |
| 6 | 32973734 | 32978015 | 4281 | loss | 2430 | LOC100294145 | Y | 0 | 4 | 8.666 | Genic; OR > 6 |
| 6 | 32973734 | 32978015 | 4281 | loss | 2563 | LOC100294145 | Y | 0 | 4 | 8.666 | Genic; OR > 6 |
| 6 | 32973734 | 32978015 | 4281 | loss | 2621 | LOC100294145 | Y | 0 | 4 | 8.666 | Genic; OR > 6 |
| 6 | 32973734 | 32978015 | 4281 | loss | 2629 | LOC100294145 | Y | 0 | 4 | 8.666 | Genic; OR > 6 |
| 6 | 33140842 | 33143800 | 2958 | loss | 2475 | HLA-DPA1 | Y | 0 | 4 | 8.6 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | | | | | | | | | | 6 | |
| 6 | 33140842 | 33143800 | 2958 | loss | 2528 | HLA-DPA1 | Y | 0 | 4 | 8.666 | Genic; OR > 6 |
| 6 | 33140842 | 33143800 | 2958 | loss | 2534 | HLA-DPA1 | Y | 0 | 4 | 8.666 | Genic; OR > 6 |
| 6 | 33140842 | 33143800 | 2958 | loss | 2637 | HLA-DPA1 | Y | 0 | 4 | 8.666 | Genic; OR > 6 |
| 6 | 33161933 | 33164011 | 2078 | gain | 2379 | HLA-DPB1 | Y | 0 | 3 | 6.448 | Genic; OR > 6 |
| 6 | 33161933 | 33164011 | 2078 | loss | 2475 | HLA-DPB1 | Y | 0 | 3 | 6.448 | Genic; OR > 6 |
| 6 | 33161933 | 33164011 | 2078 | loss | 2594 | HLA-DPB1 | Y | 0 | 3 | 6.448 | Genic; OR > 6 |
| 6 | 65886117 | 65921700 | 35583 | loss | 2292 | EYS | N | 1 | 4 | 8.666 | Genic; OR > 6 |
| 6 | 65886117 | 65921700 | 35583 | loss | 2402 | EYS | N | 1 | 4 | 8.666 | Genic; OR > 6 |
| 6 | 65886117 | 65921700 | 35583 | loss | 2403 | EYS | N | 1 | 4 | 8.666 | Genic; OR > 6 |
| 6 | 65886117 | 65921700 | 35583 | loss | 2416 | EYS | N | 1 | 4 | 8.666 | Genic; OR > 6 |
| 6 | 65921701 | 65927763 | 6062 | loss | 2292 | EYS | N | 1 | 5 | 10.884 | Genic; OR > 6 |
| 6 | 65921701 | 65927763 | 6062 | loss | 2350 | EYS | N | 1 | 5 | 10.884 | Genic; OR > 6 |
| 6 | 65921701 | 65927763 | 6062 | loss | 2402 | EYS | N | 1 | 5 | 10.884 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 6 | 65921701 | 65927763 | 6062 | loss | 2403 | EYS | N | 1 | 5 | 10.884 | Genic; OR > 6 |
| 6 | 65921701 | 65927763 | 6062 | loss | 2416 | EYS | N | 1 | 5 | 10.884 | Genic; OR > 6 |
| 6 | 65927764 | 65951879 | 24115 | loss | 2292 | EYS | N | 0 | 5 | 10.884 | Genic; OR > 6 |
| 6 | 65927764 | 65951879 | 24115 | loss | 2350 | EYS | N | 0 | 5 | 10.884 | Genic; OR > 6 |
| 6 | 65927764 | 65951879 | 24115 | loss | 2402 | EYS | N | 0 | 5 | 10.884 | Genic; OR > 6 |
| 6 | 65927764 | 65951879 | 24115 | loss | 2403 | EYS | N | 0 | 5 | 10.884 | Genic; OR > 6 |
| 6 | 65927764 | 65951879 | 24115 | loss | 2416 | EYS | N | 0 | 5 | 10.884 | Genic; OR > 6 |
| 6 | 65951880 | 65968154 | 16274 | loss | 2292 | EYS | N | 0 | 4 | 8.666 | Genic; OR > 6 |
| 6 | 65951880 | 65968154 | 16274 | loss | 2402 | EYS | N | 0 | 4 | 8.666 | Genic; OR > 6 |
| 6 | 65951880 | 65968154 | 16274 | loss | 2403 | EYS | N | 0 | 4 | 8.666 | Genic; OR > 6 |
| 6 | 65951880 | 65968154 | 16274 | loss | 2416 | EYS | N | 0 | 4 | 8.666 | Genic; OR > 6 |
| 6 | 73419032 | 73421405 | 2373 | loss | 2475 | KCNQ5 | N | 0 | 1 | 6.648 | Genic (distinct CNV-subregions); OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 6 | 73558441 | 73560954 | 2513 | loss | 2611 | KCNQ5 | N | 0 | 1 | 6.48 | Genic (distinct CNV-subregions); OR > 6 |
| 6 | 73751296 | 73763854 | 12558 | gain | 2169 | KCNQ5 | N | 0 | 1 | 6.48 | Genic (distinct CNV-subregions); OR > 6 |
| 6 | 81099147 | 81102939 | 3792 | gain | 2175 | BCKDHB | N | 1 | 5 | 10.84 | Genic; OR > 6 |
| 6 | 81099147 | 81102939 | 3792 | loss | 2342 | BCKDHB | N | 1 | 5 | 10.84 | Genic; OR > 6 |
| 6 | 81099147 | 81102939 | 3792 | loss | 2403 | BCKDHB | N | 1 | 5 | 10.84 | Genic; OR > 6 |
| 6 | 81099147 | 81102939 | 3792 | loss | 2438 | BCKDHB | N | 1 | 5 | 10.84 | Genic; OR > 6 |
| 6 | 81099147 | 81102939 | 3792 | loss | 2507 | BCKDHB | N | 1 | 5 | 10.84 | Genic; OR > 6 |
| 6 | 84286088 | 84287655 | 1567 | loss | 2325 | PRSS35 | N | 1 | 3 | 6.48 | Genic; OR > 6 |
| 6 | 84286088 | 84287655 | 1567 | loss | 2367 | PRSS35 | N | 1 | 3 | 6.48 | Genic; OR > 6 |
| 6 | 84286088 | 84287655 | 1567 | loss | 2449 | PRSS35 | N | 1 | 3 | 6.48 | Genic; OR > 6 |
| 6 | 96137816 | 96139590 | 1774 | gain | 2247 | MANEA | N | 4 | 13 | 7.115 | Genic; OR > 6 |
| 6 | 96137816 | 96139590 | 1774 | gain | 2285 | MANEA | N | 4 | 13 | 7.115 | Genic; OR > 6 |
| 6 | 96137816 | 96139590 | 1774 | gain | 2366 | MANEA | N | 4 | 13 | 7. | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | 16 | 90 | | n | | | | | | 15 | |
| 6 | 96137816 | 96139590 | 1774 | gain | 2371 | MANEA | N | 4 | 13 | 7.115 | Genic; OR > 6 |
| 6 | 96137816 | 96139590 | 1774 | gain | 2391 | MANEA | N | 4 | 13 | 7.115 | Genic; OR > 6 |
| 6 | 96137816 | 96139590 | 1774 | gain | 2429 | MANEA | N | 4 | 13 | 7.115 | Genic; OR > 6 |
| 6 | 96137816 | 96139590 | 1774 | gain | 2472 | MANEA | N | 4 | 13 | 7.115 | Genic; OR > 6 |
| 6 | 96137816 | 96139590 | 1774 | gain | 2496 | MANEA | N | 4 | 13 | 7.115 | Genic; OR > 6 |
| 6 | 96137816 | 96139590 | 1774 | gain | 2566 | MANEA | N | 4 | 13 | 7.115 | Genic; OR > 6 |
| 6 | 96137816 | 96139590 | 1774 | gain | 2596 | MANEA | N | 4 | 13 | 7.115 | Genic; OR > 6 |
| 6 | 96137816 | 96139590 | 1774 | gain | 2610 | MANEA | N | 4 | 13 | 7.115 | Genic; OR > 6 |
| 6 | 96137816 | 96139590 | 1774 | gain | 2614 | MANEA | N | 4 | 13 | 7.115 | Genic; OR > 6 |
| 6 | 96137816 | 96139590 | 1774 | gain | 2616 | MANEA | N | 4 | 13 | 7.115 | Genic; OR > 6 |
| 6 | 102076000 | 102077559 | 1559 | loss | 2048 | GRIK2 | N | 1 | 3 | 6.448 | Genic; OR > 6 |
| 6 | 102076000 | 102077559 | 1559 | loss | 2051 | GRIK2 | N | 1 | 3 | 6.448 | Genic; OR > 6 |
| 6 | 102076000 | 102077559 | 1559 | loss | 2333 | GRIK2 | N | 1 | 3 | 6.448 | Genic; OR > 6 |
| 6 | 107108807 | 107111183 | 2376 | gain | 2181 | AIM1 | Y | 1 | 12 | 26.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 2 | |
| 6 | 107108807 | 107111183 | 2376 | gain | 2240 | AIM1 | Y | 1 | 12 | 26.442 | Genic; OR > 6 |
| 6 | 107108807 | 107111183 | 2376 | gain | 2286 | AIM1 | Y | 1 | 12 | 26.442 | Genic; OR > 6 |
| 6 | 107108807 | 107111183 | 2376 | gain | 2305 | AIM1 | Y | 1 | 12 | 26.442 | Genic; OR > 6 |
| 6 | 107108807 | 107111183 | 2376 | gain | 2336 | AIM1 | Y | 1 | 12 | 26.442 | Genic; OR > 6 |
| 6 | 107108807 | 107111183 | 2376 | gain | 2342 | AIM1 | Y | 1 | 12 | 26.442 | Genic; OR > 6 |
| 6 | 107108807 | 107111183 | 2376 | gain | 2410 | AIM1 | Y | 1 | 12 | 26.442 | Genic; OR > 6 |
| 6 | 107108807 | 107111183 | 2376 | gain | 2413 | AIM1 | Y | 1 | 12 | 26.442 | Genic; OR > 6 |
| 6 | 107108807 | 107111183 | 2376 | gain | 2513 | AIM1 | Y | 1 | 12 | 26.442 | Genic; OR > 6 |
| 6 | 107108807 | 107111183 | 2376 | gain | 2563 | AIM1 | Y | 1 | 12 | 26.442 | Genic; OR > 6 |
| 6 | 107108807 | 107111183 | 2376 | gain | 2565 | AIM1 | Y | 1 | 12 | 26.442 | Genic; OR > 6 |
| 6 | 107108807 | 107111183 | 2376 | gain | 2643 | AIM1 | Y | 1 | 12 | 26.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 6 | 120674750 | 120685941 | 11191 | loss | 2286 | | N | 0 | 5 | 10.884 | Non-genic; OR > 10 |
| 6 | 120674750 | 120685941 | 11191 | loss | 2445 | | N | 0 | 5 | 10.884 | Non-genic; OR > 10 |
| 6 | 120674750 | 120685941 | 11191 | loss | 2461 | | N | 0 | 5 | 10.884 | Non-genic; OR > 10 |
| 6 | 120674750 | 120685941 | 11191 | loss | 2559 | | N | 0 | 5 | 10.884 | Non-genic; OR > 10 |
| 6 | 120674750 | 120685941 | 11191 | loss | 2571 | | N | 0 | 5 | 10.884 | Non-genic; OR > 10 |
| 6 | 159244580 | 159254015 | 9435 | loss | 2290 | C6orf99 | Y | 1 | 3 | 6.448 | Genic; OR > 6 |
| 6 | 159244580 | 159254015 | 9435 | loss | 2612 | C6orf99 | Y | 1 | 3 | 6.448 | Genic; OR > 6 |
| 6 | 159244580 | 159254015 | 9435 | loss | 2622 | C6orf99 | Y | 1 | 3 | 6.448 | Genic; OR > 6 |
| 6 | 162473616 | 162502076 | 28460 | loss | 2237 | PARK2 | N | 1 | 3 | 6.448 | Genic; OR > 6 |
| 6 | 162473616 | 162502076 | 28460 | loss | 2355 | PARK2 | N | 1 | 3 | 6.448 | Genic; OR > 6 |
| 6 | 162473616 | 162502076 | 28460 | loss | 2610 | PARK2 | N | 1 | 3 | 6.448 | Genic; OR > 6 |
| 6 | 162505820 | 162525883 | 20063 | loss | 2237 | PARK2 | N | 0 | 3 | 6.448 | Genic; OR > 6 |
| 6 | 162505820 | 162525883 | 20063 | loss | 2355 | PARK2 | N | 0 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 6 | 162505820 | 162525883 | 20063 | loss | 2610 | PARK2 | N | 0 | 3 | 6.448 | Genic; OR > 6 |
| 6 | 162525884 | 162529564 | 3680 | loss | 2237 | PARK2 | N | 1 | 3 | 6.448 | Genic; OR > 6 |
| 6 | 162525884 | 162529564 | 3680 | loss | 2355 | PARK2 | N | 1 | 3 | 6.448 | Genic; OR > 6 |
| 6 | 162525884 | 162529564 | 3680 | loss | 2610 | PARK2 | N | 1 | 3 | 6.448 | Genic; OR > 6 |
| 6 | 162531341 | 162554333 | 22992 | loss | 2237 | PARK2 | Y | 1 | 3 | 6.448 | Genic; OR > 6 |
| 6 | 162531341 | 162554333 | 22992 | loss | 2355 | PARK2 | Y | 1 | 3 | 6.448 | Genic; OR > 6 |
| 6 | 162531341 | 162554333 | 22992 | loss | 2610 | PARK2 | Y | 1 | 3 | 6.448 | Genic; OR > 6 |
| 6 | 162554334 | 162574080 | 19746 | loss | 2237 | PARK2 | N | 0 | 3 | 6.448 | Genic; OR > 6 |
| 6 | 162554334 | 162574080 | 19746 | loss | 2355 | PARK2 | N | 0 | 3 | 6.448 | Genic; OR > 6 |
| 6 | 162554334 | 162574080 | 19746 | loss | 2610 | PARK2 | N | 0 | 3 | 6.448 | Genic; OR > 6 |
| 6 | 162574081 | 162579967 | 5886 | loss | 2237 | PARK2 | N | 0 | 4 | 8.666 | Genic; OR > 6 |
| 6 | 162574081 | 162579967 | 5886 | loss | 2355 | PARK2 | N | 0 | 4 | 8.666 | Genic; OR > 6 |
| 6 | 162574081 | 162579967 | 5886 | loss | 2514 | PARK2 | N | 0 | 4 | 8.666 | Genic; OR > 6 |
| 6 | 162574081 | 162579967 | 5886 | loss | 2610 | PARK2 | N | 0 | 4 | 8.666 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 6 | 162579968 | 162587577 | 7609 | loss | 2237 | PARK2 | N | 1 | 4 | 8.66 | Genic; OR > 6 |
| 6 | 162579968 | 162587577 | 7609 | loss | 2355 | PARK2 | N | 1 | 4 | 8.66 | Genic; OR > 6 |
| 6 | 162579968 | 162587577 | 7609 | loss | 2514 | PARK2 | N | 1 | 4 | 8.66 | Genic; OR > 6 |
| 6 | 162579968 | 162587577 | 7609 | loss | 2610 | PARK2 | N | 1 | 4 | 8.66 | Genic; OR > 6 |
| 6 | 167120986 | 167121008 | 22 | loss | 2047 | RPS6KA2 | N | 3 | 9 | 6.55 | Genic; OR > 6 |
| 6 | 167120986 | 167121008 | 22 | loss | 2050 | RPS6KA2 | N | 3 | 9 | 6.55 | Genic; OR > 6 |
| 6 | 167120986 | 167121008 | 22 | gain | 2261 | RPS6KA2 | N | 3 | 9 | 6.55 | Genic; OR > 6 |
| 6 | 167120986 | 167121008 | 22 | gain | 2339 | RPS6KA2 | N | 3 | 9 | 6.55 | Genic; OR > 6 |
| 6 | 167120986 | 167121008 | 22 | gain | 2359 | RPS6KA2 | N | 3 | 9 | 6.55 | Genic; OR > 6 |
| 6 | 167120986 | 167121008 | 22 | gain | 2384 | RPS6KA2 | N | 3 | 9 | 6.55 | Genic; OR > 6 |
| 6 | 167120986 | 167121008 | 22 | loss | 2474 | RPS6KA2 | N | 3 | 9 | 6.55 | Genic; OR > 6 |
| 6 | 167120986 | 167121008 | 22 | loss | 2510 | RPS6KA2 | N | 3 | 9 | 6.55 | Genic; OR > 6 |
| 6 | 167120986 | 167121008 | 22 | gain | 2625 | RPS6KA2 | N | 3 | 9 | 6.55 | Genic; OR > 6 |
| 7 | 3324678 | 3341849 | 17171 | loss | 2535 | SDK1 | N | 1 | 3 | 6.48 | Genic; OR > 6 |
| 7 | 3324678 | 3341849 | 17171 | loss | 2573 | SDK1 | N | 1 | 3 | 6.4 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 7 | 3324678 | 3341849 | 17171 | gain | 2597 | SDK1 | N | 1 | 3 | 6.448 | Genic; OR > 6 |
| 7 | 3341850 | 3350288 | 8438 | loss | 2535 | SDK1 | N | 0 | 3 | 6.448 | Genic; OR > 6 |
| 7 | 3341850 | 3350288 | 8438 | loss | 2573 | SDK1 | N | 0 | 3 | 6.448 | Genic; OR > 6 |
| 7 | 3341850 | 3350288 | 8438 | gain | 2597 | SDK1 | N | 0 | 3 | 6.448 | Genic; OR > 6 |
| 7 | 3350289 | 3378114 | 27825 | loss | 2535 | SDK1 | N | 1 | 3 | 6.448 | Genic; OR > 6 |
| 7 | 3350289 | 3378114 | 27825 | loss | 2573 | SDK1 | N | 1 | 3 | 6.448 | Genic; OR > 6 |
| 7 | 3350289 | 3378114 | 27825 | gain | 2597 | SDK1 | N | 1 | 3 | 6.448 | Genic; OR > 6 |
| 7 | 3409718 | 3425767 | 16049 | gain | 2455 | SDK1 | N | 0 | 3 | 6.448 | Genic; OR > 6 |
| 7 | 3409718 | 3425767 | 16049 | loss | 2535 | SDK1 | N | 0 | 3 | 6.448 | Genic; OR > 6 |
| 7 | 3409718 | 3425767 | 16049 | gain | 2597 | SDK1 | N | 0 | 3 | 6.448 | Genic; OR > 6 |
| 7 | 6636136 | 6638418 | 2282 | gain | 2263 | | N | 0 | 9 | 19.669 | Non-genic; OR > 10 |
| 7 | 6636136 | 6638418 | 2282 | gain | 2338 | | N | 0 | 9 | 19.669 | Non-genic; OR > 10 |
| 7 | 6636136 | 6638418 | 2282 | gain | 2346 | | N | 0 | 9 | 19.669 | Non-genic; OR > 10 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 7 | 6636136 | 6638418 | 2282 | gain | 2357 | | N | 0 | 9 | 19.669 | Non-genic; OR > 10 |
| 7 | 6636136 | 6638418 | 2282 | gain | 2427 | | N | 0 | 9 | 19.669 | Non-genic; OR > 10 |
| 7 | 6636136 | 6638418 | 2282 | gain | 2556 | | N | 0 | 9 | 19.669 | Non-genic; OR > 10 |
| 7 | 6636136 | 6638418 | 2282 | gain | 2559 | | N | 0 | 9 | 19.669 | Non-genic; OR > 10 |
| 7 | 6636136 | 6638418 | 2282 | gain | 2590 | | N | 0 | 9 | 19.669 | Non-genic; OR > 10 |
| 7 | 6636136 | 6638418 | 2282 | gain | 2614 | | N | 0 | 9 | 19.669 | Non-genic; OR > 10 |
| 7 | 7363907 | 7365873 | 1966 | loss | 2048 | COL28A1 | Y | 5 | 16 | 7.008 | Genic; OR > 6 |
| 7 | 7363907 | 7365873 | 1966 | loss | 2052 | COL28A1 | Y | 5 | 16 | 7.008 | Genic; OR > 6 |
| 7 | 7363907 | 7365873 | 1966 | loss | 2263 | COL28A1 | Y | 5 | 16 | 7.008 | Genic; OR > 6 |
| 7 | 7363907 | 7365873 | 1966 | loss | 2264 | COL28A1 | Y | 5 | 16 | 7.008 | Genic; OR > 6 |
| 7 | 7363907 | 7365873 | 1966 | loss | 2284 | COL28A1 | Y | 5 | 16 | 7.008 | Genic; OR > 6 |
| 7 | 7363907 | 7365873 | 1966 | loss | 2315 | COL28A1 | Y | 5 | 16 | 7.008 | Genic; OR > 6 |
| 7 | 7363907 | 7365873 | 1966 | loss | 2337 | COL28A1 | Y | 5 | 16 | 7.0 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 7 | 7363907 | 7365873 | 1966 | loss | 2348 | COL28A1 | Y | 5 | 16 | 7.008 | Genic; OR > 6 |
| 7 | 7363907 | 7365873 | 1966 | loss | 2387 | COL28A1 | Y | 5 | 16 | 7.008 | Genic; OR > 6 |
| 7 | 7363907 | 7365873 | 1966 | loss | 2388 | COL28A1 | Y | 5 | 16 | 7.008 | Genic; OR > 6 |
| 7 | 7363907 | 7365873 | 1966 | loss | 2429 | COL28A1 | Y | 5 | 16 | 7.008 | Genic; OR > 6 |
| 7 | 7363907 | 7365873 | 1966 | gain | 2514 | COL28A1 | Y | 5 | 16 | 7.008 | Genic; OR > 6 |
| 7 | 7363907 | 7365873 | 1966 | loss | 2563 | COL28A1 | Y | 5 | 16 | 7.008 | Genic; OR > 6 |
| 7 | 7363907 | 7365873 | 1966 | loss | 2571 | COL28A1 | Y | 5 | 16 | 7.008 | Genic; OR > 6 |
| 7 | 7363907 | 7365873 | 1966 | loss | 2585 | COL28A1 | Y | 5 | 16 | 7.008 | Genic; OR > 6 |
| 7 | 7363907 | 7365873 | 1966 | loss | 2611 | COL28A1 | Y | 5 | 16 | 7.008 | Genic; OR > 6 |
| 7 | 7385459 | 7650531 | 265072 | gain | 2514 | MIOS,LOC729852,COL28A1,RPA3 | Y | 0 | 1 | 6.448 | Genic (distinct CNV-subregions); OR > 6 |
| 7 | 7650532 | 7720374 | 69842 | gain | 2514 | LOC729852,RPA3 | Y | 1 | 1 | 6.448 | Genic (distinct CNV-subregions); OR > 6 |
| 7 | 7720375 | 7815874 | 95499 | gain | 2514 | LOC729852,RPA3 | Y | 0 | 1 | 6.448 | Genic (distinct CNV-subregions); OR > 6 |
| 7 | 7815875 | 7818993 | 3118 | loss | 2345 | LOC729852 | N | 0 | 2 | 6.448 | Genic (distinct CNV-subregions); OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 7 | 7815875 | 7818993 | 3118 | gain | 2514 | LOC729852 | N | 0 | 2 | 6.48 | Genic (distinct CNV-subregions); OR > 6 |
| 7 | 7818994 | 7837304 | 18310 | gain | 2514 | LOC729852 | N | 0 | 1 | 6.48 | Genic (distinct CNV-subregions); OR > 6 |
| 7 | 7837305 | 7894718 | 57413 | loss | 2176 | LOC729852 | Y | 0 | 2 | 6.48 | Genic (distinct CNV-subregions); OR > 6 |
| 7 | 7837305 | 7894718 | 57413 | gain | 2514 | LOC729852 | Y | 0 | 2 | 6.48 | Genic (distinct CNV-subregions); OR > 6 |
| 7 | 27467540 | 27469640 | 2100 | loss | 2359 | | N | 0 | 5 | 10.884 | Non-genic; OR > 10 |
| 7 | 27467540 | 27469640 | 2100 | gain | 2453 | | N | 0 | 5 | 10.884 | Non-genic; OR > 10 |
| 7 | 27467540 | 27469640 | 2100 | gain | 2509 | | N | 0 | 5 | 10.884 | Non-genic; OR > 10 |
| 7 | 27467540 | 27469640 | 2100 | gain | 2527 | | N | 0 | 5 | 10.884 | Non-genic; OR > 10 |
| 7 | 27467540 | 27469640 | 2100 | loss | 2612 | | N | 0 | 5 | 10.884 | Non-genic; OR > 10 |
| 7 | 69299632 | 69313141 | 13509 | loss | 2354 | AUTS2 | N | 0 | 1 | 8.66 | Genic (distinct CNV-subregions); OR > 6 |
| 7 | 69356304 | 69460357 | 104053 | loss | 2358 | AUTS2 | Y | 0 | 1 | 8.66 | Genic (distinct CNV-subregions); OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 7 | 69511801 | 69590195 | 78394 | loss | 2361 | AUTS2 | Y | 0 | 1 | 8.66 | Genic (distinct CNV-subregions); OR > 6 |
| 7 | 69834174 | 69839924 | 5750 | loss | 2621 | AUTS2 | N | 0 | 1 | 8.66 | Genic (distinct CNV-subregions); OR > 6 |
| 7 | 76421844 | 76539953 | 118109 | gain | 2256 | LOC100132832 | Y | 1 | 4 | 8.66 | Genic; OR > 6 |
| 7 | 76421844 | 76539953 | 118109 | gain | 2302 | LOC100132832 | Y | 1 | 4 | 8.66 | Genic; OR > 6 |
| 7 | 76421844 | 76539953 | 118109 | gain | 2373 | LOC100132832 | Y | 1 | 4 | 8.66 | Genic; OR > 6 |
| 7 | 76421844 | 76539953 | 118109 | gain | 2566 | LOC100132832 | Y | 1 | 4 | 8.66 | Genic; OR > 6 |
| 7 | 88424519 | 88433128 | 8609 | loss | 2350 | ZNF804B | N | 1 | 4 | 8.66 | Genic; OR > 6 |
| 7 | 88424519 | 88433128 | 8609 | gain | 2414 | ZNF804B | N | 1 | 4 | 8.66 | Genic; OR > 6 |
| 7 | 88424519 | 88433128 | 8609 | loss | 2496 | ZNF804B | N | 1 | 4 | 8.66 | Genic; OR > 6 |
| 7 | 88424519 | 88433128 | 8609 | loss | 2638 | ZNF804B | N | 1 | 4 | 8.66 | Genic; OR > 6 |
| 7 | 107157268 | 107167915 | 10647 | loss | 2339 | | N | 2 | 10 | 10.995 | Non-genic; OR > 10 |
| 7 | 107157268 | 107167915 | 10647 | loss | 2356 | | N | 2 | 10 | 10.995 | Non-genic; OR > 10 |
| 7 | 107157268 | 107167915 | 10647 | loss | 2376 | | N | 2 | 10 | 10.995 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 7 | 107157268 | 107167915 | 10647 | loss | 2387 | | N | 2 | 10 | 10.995 | Non-genic; OR > 10 |
| 7 | 107157268 | 107167915 | 10647 | loss | 2427 | | N | 2 | 10 | 10.995 | Non-genic; OR > 10 |
| 7 | 107157268 | 107167915 | 10647 | loss | 2434 | | N | 2 | 10 | 10.995 | Non-genic; OR > 10 |
| 7 | 107157268 | 107167915 | 10647 | loss | 2450 | | N | 2 | 10 | 10.995 | Non-genic; OR > 10 |
| 7 | 107157268 | 107167915 | 10647 | loss | 2477 | | N | 2 | 10 | 10.995 | Non-genic; OR > 10 |
| 7 | 107157268 | 107167915 | 10647 | loss | 2509 | | N | 2 | 10 | 10.995 | Non-genic; OR > 10 |
| 7 | 107157268 | 107167915 | 10647 | loss | 2550 | | N | 2 | 10 | 10.995 | Non-genic; OR > 10 |
| 7 | 108521547 | 108526147 | 4600 | loss | 2046 | | N | 1 | 7 | 15.225 | Non-genic; OR > 10 |
| 7 | 108521547 | 108526147 | 4600 | loss | 2424 | | N | 1 | 7 | 15.225 | Non-genic; OR > 10 |
| 7 | 108521547 | 108526147 | 4600 | loss | 2427 | | N | 1 | 7 | 15.225 | Non-genic; OR > 10 |
| 7 | 108521547 | 108526147 | 4600 | loss | 2429 | | N | 1 | 7 | 15.225 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 7 | 108521547 | 108526147 | 4600 | loss | 2439 | | N | 1 | 7 | 15.225 | Non-genic; OR > 10 |
| 7 | 108521547 | 108526147 | 4600 | loss | 2517 | | N | 1 | 7 | 15.225 | Non-genic; OR > 10 |
| 7 | 108521547 | 108526147 | 4600 | loss | 2614 | | N | 1 | 7 | 15.225 | Non-genic; OR > 10 |
| 7 | 112259940 | 112265575 | 5635 | gain | 2271 | C7orf60 | Y | 1 | 3 | 6.448 | Genic; OR > 6 |
| 7 | 112259940 | 112265575 | 5635 | gain | 2328 | C7orf60 | Y | 1 | 3 | 6.448 | Genic; OR > 6 |
| 7 | 112259940 | 112265575 | 5635 | gain | 2512 | C7orf60 | Y | 1 | 3 | 6.448 | Genic; OR > 6 |
| 7 | 127716510 | 127717893 | 1383 | gain | 2193 | | N | 1 | 5 | 10.884 | Non-genic; OR > 10 |
| 7 | 127716510 | 127717893 | 1383 | loss | 2350 | | N | 1 | 5 | 10.884 | Non-genic; OR > 10 |
| 7 | 127716510 | 127717893 | 1383 | loss | 2541 | | N | 1 | 5 | 10.884 | Non-genic; OR > 10 |
| 7 | 127716510 | 127717893 | 1383 | loss | 2559 | | N | 1 | 5 | 10.884 | Non-genic; OR > 10 |
| 7 | 127716510 | 127717893 | 1383 | loss | 2626 | | N | 1 | 5 | 10.884 | Non-genic; OR > 10 |
| 7 | 147441927 | 147443119 | 1192 | loss | 2266 | MIR548T,CNTNAP2 | N | 1 | 7 | 15.2 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 5 | |
| 7 | 147441927 | 147443119 | 1192 | loss | 2269 | MIR548T,CNTNAP2 | N | 1 | 7 | 15.225 | Genic; OR > 6 |
| 7 | 147441927 | 147443119 | 1192 | loss | 2320 | MIR548T,CNTNAP2 | N | 1 | 7 | 15.225 | Genic; OR > 6 |
| 7 | 147441927 | 147443119 | 1192 | loss | 2436 | MIR548T,CNTNAP2 | N | 1 | 7 | 15.225 | Genic; OR > 6 |
| 7 | 147441927 | 147443119 | 1192 | loss | 2443 | MIR548T,CNTNAP2 | N | 1 | 7 | 15.225 | Genic; OR > 6 |
| 7 | 147441927 | 147443119 | 1192 | loss | 2565 | MIR548T,CNTNAP2 | N | 1 | 7 | 15.225 | Genic; OR > 6 |
| 7 | 147441927 | 147443119 | 1192 | loss | 2593 | MIR548T,CNTNAP2 | N | 1 | 7 | 15.225 | Genic; OR > 6 |
| 7 | 149379564 | 149383502 | 3938 | loss | 2048 | | N | 1 | 6 | 13.004 | Non-genic; OR > 10 |
| 7 | 149379564 | 149383502 | 3938 | loss | 2221 | | N | 1 | 6 | 13.004 | Non-genic; OR > 10 |
| 7 | 149379564 | 149383502 | 3938 | loss | 2256 | | N | 1 | 6 | 13.004 | Non-genic; OR > 10 |
| 7 | 149379564 | 149383502 | 3938 | loss | 2257 | | N | 1 | 6 | 13.004 | Non-genic; OR > 10 |
| 7 | 149379564 | 149383502 | 3938 | loss | 2289 | | N | 1 | 6 | 13.0 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 7 | 149379564 | 149383502 | 3938 | loss | 2358 | | N | 1 | 6 | 13.04 | Non-genic; OR > 10 |
| 8 | 3983448 | 3984760 | 1312 | loss | 2212 | CSMD1 | N | 2 | 7 | 7.61 | Genic; OR > 6 |
| 8 | 3983448 | 3984760 | 1312 | loss | 2292 | CSMD1 | N | 2 | 7 | 7.61 | Genic; OR > 6 |
| 8 | 3983448 | 3984760 | 1312 | loss | 2380 | CSMD1 | N | 2 | 7 | 7.61 | Genic; OR > 6 |
| 8 | 3983448 | 3984760 | 1312 | loss | 2411 | CSMD1 | N | 2 | 7 | 7.61 | Genic; OR > 6 |
| 8 | 3983448 | 3984760 | 1312 | loss | 2436 | CSMD1 | N | 2 | 7 | 7.61 | Genic; OR > 6 |
| 8 | 3983448 | 3984760 | 1312 | loss | 2465 | CSMD1 | N | 2 | 7 | 7.61 | Genic; OR > 6 |
| 8 | 3983448 | 3984760 | 1312 | loss | 2498 | CSMD1 | N | 2 | 7 | 7.61 | Genic; OR > 6 |
| 8 | 3986556 | 3987981 | 1425 | loss | 2212 | CSMD1 | N | 5 | 14 | 6.17 | Genic; OR > 6 |
| 8 | 3986556 | 3987981 | 1425 | loss | 2227 | CSMD1 | N | 5 | 14 | 6.17 | Genic; OR > 6 |
| 8 | 3986556 | 3987981 | 1425 | loss | 2237 | CSMD1 | N | 5 | 14 | 6.17 | Genic; OR > 6 |
| 8 | 3986556 | 3987981 | 1425 | loss | 2292 | CSMD1 | N | 5 | 14 | 6.17 | Genic; OR > 6 |
| 8 | 3986556 | 3987981 | 1425 | loss | 2342 | CSMD1 | N | 5 | 14 | 6.17 | Genic; OR > 6 |
| 8 | 3986556 | 3987981 | 1425 | loss | 2380 | CSMD1 | N | 5 | 14 | 6.1 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 8 | 3986556 | 3987981 | 1425 | loss | 2411 | CSMD1 | N | 5 | 14 | 6.17 | Genic; OR > 6 |
| 8 | 3986556 | 3987981 | 1425 | loss | 2423 | CSMD1 | N | 5 | 14 | 6.17 | Genic; OR > 6 |
| 8 | 3986556 | 3987981 | 1425 | loss | 2427 | CSMD1 | N | 5 | 14 | 6.17 | Genic; OR > 6 |
| 8 | 3986556 | 3987981 | 1425 | loss | 2436 | CSMD1 | N | 5 | 14 | 6.17 | Genic; OR > 6 |
| 8 | 3986556 | 3987981 | 1425 | loss | 2465 | CSMD1 | N | 5 | 14 | 6.17 | Genic; OR > 6 |
| 8 | 3986556 | 3987981 | 1425 | gain | 2471 | CSMD1 | N | 5 | 14 | 6.17 | Genic; OR > 6 |
| 8 | 3986556 | 3987981 | 1425 | loss | 2498 | CSMD1 | N | 5 | 14 | 6.17 | Genic; OR > 6 |
| 8 | 3986556 | 3987981 | 1425 | loss | 2562 | CSMD1 | N | 5 | 14 | 6.17 | Genic; OR > 6 |
| 8 | 26696889 | 26698739 | 1850 | loss | 2323 | ADRA1A | N | 2 | 8 | 8.872 | Genic; OR > 6 |
| 8 | 26696889 | 26698739 | 1850 | loss | 2428 | ADRA1A | N | 2 | 8 | 8.872 | Genic; OR > 6 |
| 8 | 26696889 | 26698739 | 1850 | loss | 2469 | ADRA1A | N | 2 | 8 | 8.872 | Genic; OR > 6 |
| 8 | 26696889 | 26698739 | 1850 | loss | 2478 | ADRA1A | N | 2 | 8 | 8.872 | Genic; OR > 6 |
| 8 | 26696889 | 26698739 | 1850 | loss | 2479 | ADRA1A | N | 2 | 8 | 8.872 | Genic; OR > 6 |
| 8 | 26696889 | 26698739 | 1850 | loss | 2634 | ADRA1A | N | 2 | 8 | 8.872 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 8 | 26696889 | 26698739 | 1850 | loss | 2637 | ADRA1A | N | 2 | 8 | 8.72 | Genic; OR > 6 |
| 8 | 26696889 | 26698739 | 1850 | loss | 2645 | ADRA1A | N | 2 | 8 | 8.72 | Genic; OR > 6 |
| 8 | 28544961 | 28550586 | 5625 | loss | 2049 | | N | 0 | 7 | 15.225 | Non-genic; OR > 10 |
| 8 | 28544961 | 28550586 | 5625 | loss | 2213 | | N | 0 | 7 | 15.225 | Non-genic; OR > 10 |
| 8 | 28544961 | 28550586 | 5625 | loss | 2267 | | N | 0 | 7 | 15.225 | Non-genic; OR > 10 |
| 8 | 28544961 | 28550586 | 5625 | loss | 2479 | | N | 0 | 7 | 15.225 | Non-genic; OR > 10 |
| 8 | 28544961 | 28550586 | 5625 | loss | 2505 | | N | 0 | 7 | 15.225 | Non-genic; OR > 10 |
| 8 | 28544961 | 28550586 | 5625 | loss | 2509 | | N | 0 | 7 | 15.225 | Non-genic; OR > 10 |
| 8 | 28544961 | 28550586 | 5625 | loss | 2519 | | N | 0 | 7 | 15.225 | Non-genic; OR > 10 |
| 8 | 51389250 | 51390466 | 1216 | loss | 2187 | SNTG1 | N | 1 | 6 | 13.04 | Genic; OR > 6 |
| 8 | 51389250 | 51390466 | 1216 | loss | 2288 | SNTG1 | N | 1 | 6 | 13.04 | Genic; OR > 6 |
| 8 | 51389250 | 51390466 | 1216 | loss | 2412 | SNTG1 | N | 1 | 6 | 13. | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | | | | | | | | | | 04 | |
| 8 | 51389250 | 51390466 | 1216 | loss | 2452 | SNTG1 | N | 1 | 6 | 13.004 | Genic; OR > 6 |
| 8 | 51389250 | 51390466 | 1216 | loss | 2549 | SNTG1 | N | 1 | 6 | 13.004 | Genic; OR > 6 |
| 8 | 51389250 | 51390466 | 1216 | loss | 2590 | SNTG1 | N | 1 | 6 | 13.004 | Genic; OR > 6 |
| 8 | 75802283 | 75804852 | 2569 | loss | 2048 | FLJ39080 | N | 0 | 28 | 63.889 | Genic; OR > 6 |
| 8 | 75802283 | 75804852 | 2569 | loss | 2248 | FLJ39080 | N | 0 | 28 | 63.889 | Genic; OR > 6 |
| 8 | 75802283 | 75804852 | 2569 | loss | 2261 | FLJ39080 | N | 0 | 28 | 63.889 | Genic; OR > 6 |
| 8 | 75802283 | 75804852 | 2569 | loss | 2264 | FLJ39080 | N | 0 | 28 | 63.889 | Genic; OR > 6 |
| 8 | 75802283 | 75804852 | 2569 | loss | 2288 | FLJ39080 | N | 0 | 28 | 63.889 | Genic; OR > 6 |
| 8 | 75802283 | 75804852 | 2569 | loss | 2292 | FLJ39080 | N | 0 | 28 | 63.889 | Genic; OR > 6 |
| 8 | 75802283 | 75804852 | 2569 | loss | 2296 | FLJ39080 | N | 0 | 28 | 63.889 | Genic; OR > 6 |
| 8 | 75802283 | 75804852 | 2569 | loss | 2340 | FLJ39080 | N | 0 | 28 | 63. | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 89 | |
| 8 | 75802283 | 75804852 | 2569 | loss | 2350 | FLJ39080 | N | 0 | 28 | 63.889 | Genic; OR > 6 |
| 8 | 75802283 | 75804852 | 2569 | loss | 2376 | FLJ39080 | N | 0 | 28 | 63.889 | Genic; OR > 6 |
| 8 | 75802283 | 75804852 | 2569 | loss | 2379 | FLJ39080 | N | 0 | 28 | 63.889 | Genic; OR > 6 |
| 8 | 75802283 | 75804852 | 2569 | loss | 2415 | FLJ39080 | N | 0 | 28 | 63.889 | Genic; OR > 6 |
| 8 | 75802283 | 75804852 | 2569 | loss | 2417 | FLJ39080 | N | 0 | 28 | 63.889 | Genic; OR > 6 |
| 8 | 75802283 | 75804852 | 2569 | loss | 2421 | FLJ39080 | N | 0 | 28 | 63.889 | Genic; OR > 6 |
| 8 | 75802283 | 75804852 | 2569 | loss | 2424 | FLJ39080 | N | 0 | 28 | 63.889 | Genic; OR > 6 |
| 8 | 75802283 | 75804852 | 2569 | loss | 2426 | FLJ39080 | N | 0 | 28 | 63.889 | Genic; OR > 6 |
| 8 | 75802283 | 75804852 | 2569 | loss | 2430 | FLJ39080 | N | 0 | 28 | 63.889 | Genic; OR > 6 |
| 8 | 75802283 | 75804852 | 2569 | loss | 2445 | FLJ39080 | N | 0 | 28 | 63.889 | Genic; OR > 6 |
| 8 | 75802283 | 75804852 | 2569 | loss | 2544 | FLJ39080 | N | 0 | 28 | 63. | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 8 | 75802283 | 75804852 | 2569 | loss | 2548 | FLJ39080 | N | 0 | 28 | 63.889 | Genic; OR > 6 |
| 8 | 75802283 | 75804852 | 2569 | loss | 2555 | FLJ39080 | N | 0 | 28 | 63.889 | Genic; OR > 6 |
| 8 | 75802283 | 75804852 | 2569 | loss | 2561 | FLJ39080 | N | 0 | 28 | 63.889 | Genic; OR > 6 |
| 8 | 75802283 | 75804852 | 2569 | loss | 2572 | FLJ39080 | N | 0 | 28 | 63.889 | Genic; OR > 6 |
| 8 | 75802283 | 75804852 | 2569 | loss | 2589 | FLJ39080 | N | 0 | 28 | 63.889 | Genic; OR > 6 |
| 8 | 75802283 | 75804852 | 2569 | loss | 2595 | FLJ39080 | N | 0 | 28 | 63.889 | Genic; OR > 6 |
| 8 | 75802283 | 75804852 | 2569 | loss | 2602 | FLJ39080 | N | 0 | 28 | 63.889 | Genic; OR > 6 |
| 8 | 75802283 | 75804852 | 2569 | loss | 2611 | FLJ39080 | N | 0 | 28 | 63.889 | Genic; OR > 6 |
| 8 | 75802283 | 75804852 | 2569 | loss | 2633 | FLJ39080 | N | 0 | 28 | 63.889 | Genic; OR > 6 |
| 8 | 92236650 | 92247179 | 10529 | loss | 2234 | LRRC69 | N | 0 | 3 | 6.448 | Genic; OR > 6 |
| 8 | 92236650 | 92247179 | 10529 | loss | 2350 | LRRC69 | N | 0 | 3 | 6.448 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 8 | 92236650 | 92247179 | 10529 | loss | 2637 | LRRC69 | N | 0 | 3 | 6.448 | Genic; OR > 6 |
| 8 | 97917880 | 97934261 | 16381 | loss | 2468 | PGCP | N | 0 | 1 | 6.448 | Genic (distinct CNV-subregions); OR > 6 |
| 8 | 97941620 | 97949919 | 8299 | loss | 2350 | PGCP | N | 0 | 1 | 6.448 | Genic (distinct CNV-subregions); OR > 6 |
| 8 | 97963755 | 97984669 | 20914 | loss | 2634 | PGCP | N | 0 | 1 | 6.448 | Genic (distinct CNV-subregions); OR > 6 |
| 8 | 100286992 | 100295053 | 8061 | gain | 2200 | VPS13B | Y | 0 | 3 | 6.448 | Genic; OR > 6 |
| 8 | 100286992 | 100295053 | 8061 | gain | 2316 | VPS13B | Y | 0 | 3 | 6.448 | Genic; OR > 6 |
| 8 | 100286992 | 100295053 | 8061 | gain | 2540 | VPS13B | Y | 0 | 3 | 6.448 | Genic; OR > 6 |
| 8 | 107368178 | 107369802 | 1624 | loss | 2053 | OXR1 | N | 2 | 6 | 6.651 | Genic; OR > 6 |
| 8 | 107368178 | 107369802 | 1624 | loss | 2325 | OXR1 | N | 2 | 6 | 6.651 | Genic; OR > 6 |
| 8 | 107368178 | 107369802 | 1624 | loss | 2449 | OXR1 | N | 2 | 6 | 6.651 | Genic; OR > 6 |
| 8 | 107368178 | 107369802 | 1624 | loss | 2472 | OXR1 | N | 2 | 6 | 6.651 | Genic; OR > 6 |
| 8 | 107368178 | 107369802 | 1624 | loss | 2475 | OXR1 | N | 2 | 6 | 6.651 | Genic; OR > 6 |
| 8 | 107368178 | 107369802 | 1624 | loss | 2507 | OXR1 | N | 2 | 6 | 6.651 | Genic; OR > 6 |
| 8 | 108453218 | 108454560 | 1342 | loss | 2048 | ANGPT1 | N | 0 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 8 | |
| 8 | 108453218 | 108454560 | 1342 | loss | 2359 | ANGPT1 | N | 0 | 3 | 6.448 | Genic; OR > 6 |
| 8 | 108453218 | 108454560 | 1342 | loss | 2601 | ANGPT1 | N | 0 | 3 | 6.448 | Genic; OR > 6 |
| 8 | 120694397 | 120696229 | 1832 | gain | 2055 | ENPP2 | N | 7 | 22 | 7.03 | Genic; OR > 6 |
| 8 | 120694397 | 120696229 | 1832 | gain | 2266 | ENPP2 | N | 7 | 22 | 7.03 | Genic; OR > 6 |
| 8 | 120694397 | 120696229 | 1832 | gain | 2271 | ENPP2 | N | 7 | 22 | 7.03 | Genic; OR > 6 |
| 8 | 120694397 | 120696229 | 1832 | gain | 2291 | ENPP2 | N | 7 | 22 | 7.03 | Genic; OR > 6 |
| 8 | 120694397 | 120696229 | 1832 | gain | 2312 | ENPP2 | N | 7 | 22 | 7.03 | Genic; OR > 6 |
| 8 | 120694397 | 120696229 | 1832 | gain | 2325 | ENPP2 | N | 7 | 22 | 7.03 | Genic; OR > 6 |
| 8 | 120694397 | 120696229 | 1832 | gain | 2358 | ENPP2 | N | 7 | 22 | 7.03 | Genic; OR > 6 |
| 8 | 120694397 | 120696229 | 1832 | gain | 2379 | ENPP2 | N | 7 | 22 | 7.03 | Genic; OR > 6 |
| 8 | 120694397 | 120696229 | 1832 | gain | 2384 | ENPP2 | N | 7 | 22 | 7.03 | Genic; OR > 6 |
| 8 | 120694397 | 120696229 | 1832 | gain | 2409 | ENPP2 | N | 7 | 22 | 7.03 | Genic; OR > 6 |
| 8 | 120694397 | 120696229 | 1832 | gain | 2425 | ENPP2 | N | 7 | 22 | 7.03 | Genic; OR > 6 |
| 8 | 120694397 | 120696229 | 1832 | gain | 2431 | ENPP2 | N | 7 | 22 | 7.03 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 8 | 120694397 | 120696229 | 1832 | gain | 2438 | ENPP2 | N | 7 | 22 | 7.03 | Genic; OR > 6 |
| 8 | 120694397 | 120696229 | 1832 | gain | 2439 | ENPP2 | N | 7 | 22 | 7.03 | Genic; OR > 6 |
| 8 | 120694397 | 120696229 | 1832 | gain | 2444 | ENPP2 | N | 7 | 22 | 7.03 | Genic; OR > 6 |
| 8 | 120694397 | 120696229 | 1832 | gain | 2546 | ENPP2 | N | 7 | 22 | 7.03 | Genic; OR > 6 |
| 8 | 120694397 | 120696229 | 1832 | gain | 2551 | ENPP2 | N | 7 | 22 | 7.03 | Genic; OR > 6 |
| 8 | 120694397 | 120696229 | 1832 | gain | 2578 | ENPP2 | N | 7 | 22 | 7.03 | Genic; OR > 6 |
| 8 | 120694397 | 120696229 | 1832 | gain | 2588 | ENPP2 | N | 7 | 22 | 7.03 | Genic; OR > 6 |
| 8 | 120694397 | 120696229 | 1832 | gain | 2602 | ENPP2 | N | 7 | 22 | 7.03 | Genic; OR > 6 |
| 8 | 120694397 | 120696229 | 1832 | gain | 2633 | ENPP2 | N | 7 | 22 | 7.03 | Genic; OR > 6 |
| 8 | 120694397 | 120696229 | 1832 | gain | 2643 | ENPP2 | N | 7 | 22 | 7.03 | Genic; OR > 6 |
| 9 | 94660128 | 94662745 | 2617 | loss | 2297 | ZNF484 | N | 0 | 3 | 6.448 | Genic; OR > 6 |
| 9 | 94660128 | 94662745 | 2617 | loss | 2368 | ZNF484 | N | 0 | 3 | 6.448 | Genic; OR > 6 |
| 9 | 94660128 | 94662745 | 2617 | loss | 2548 | ZNF484 | N | 0 | 3 | 6.448 | Genic; OR > 6 |
| 9 | 111606594 | 111609722 | 3128 | gain | 2175 | PALM2-AKAP2,PALM2 | N | 1 | 3 | 6.448 | Genic; OR > 6 |
| 9 | 111606594 | 111609722 | 3128 | gain | 2192 | PALM2-AKAP2,PAL | N | 1 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | M2 | | | | 8 | |
| 9 | 111606594 | 111609722 | 3128 | gain | 2462 | PALM2-AKAP2,PALM2 | N | 1 | 3 | 6.448 | Genic; OR > 6 |
| 9 | 123075181 | 123078271 | 3090 | loss | 2050 | GSN | N | 1 | 4 | 8.666 | Genic; OR > 6 |
| 9 | 123075181 | 123078271 | 3090 | loss | 2414 | GSN | N | 1 | 4 | 8.666 | Genic; OR > 6 |
| 9 | 123075181 | 123078271 | 3090 | loss | 2525 | GSN | N | 1 | 4 | 8.666 | Genic; OR > 6 |
| 9 | 123075181 | 123078271 | 3090 | loss | 2530 | GSN | N | 1 | 4 | 8.666 | Genic; OR > 6 |
| 11 | 1625056 | 1630240 | 5184 | loss | 2281 | MOB2 | N | 1 | 4 | 8.666 | Genic; OR > 6 |
| 11 | 1625056 | 1630240 | 5184 | loss | 2589 | MOB2 | N | 1 | 4 | 8.666 | Genic; OR > 6 |
| 11 | 1625056 | 1630240 | 5184 | loss | 2625 | MOB2 | N | 1 | 4 | 8.666 | Genic; OR > 6 |
| 11 | 1625056 | 1630240 | 5184 | loss | 2629 | MOB2 | N | 1 | 4 | 8.666 | Genic; OR > 6 |
| 11 | 5226853 | 5228202 | 1349 | gain | 2299 | HBG1 | Y | 1 | 4 | 8.666 | Genic; OR > 6 |
| 11 | 5226853 | 5228202 | 1349 | gain | 2459 | HBG1 | Y | 1 | 4 | 8.666 | Genic; OR > 6 |
| 11 | 5226853 | 5228202 | 1349 | gain | 2616 | HBG1 | Y | 1 | 4 | 8.666 | Genic; OR > 6 |
| 11 | 5226853 | 5228202 | 1349 | loss | 2630 | HBG1 | Y | 1 | 4 | 8.666 | Genic; OR > 6 |
| 11 | 21380486 | 21381731 | 1245 | loss | 2302 | NELL1 | N | 1 | 3 | 6.448 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 11 | 21380486 | 21381731 | 1245 | loss | 2424 | NELL1 | N | 1 | 3 | 6.448 | Genic; OR > 6 |
| 11 | 21380486 | 21381731 | 1245 | loss | 2561 | NELL1 | N | 1 | 3 | 6.448 | Genic; OR > 6 |
| 11 | 58572501 | 58603440 | 30939 | gain | 2053 | LOC283194 | Y | 0 | 3 | 6.448 | Genic; OR > 6 |
| 11 | 58572501 | 58603440 | 30939 | loss | 2226 | LOC283194 | Y | 0 | 3 | 6.448 | Genic; OR > 6 |
| 11 | 58572501 | 58603440 | 30939 | gain | 2488 | LOC283194 | Y | 0 | 3 | 6.448 | Genic; OR > 6 |
| 11 | 93129448 | 93138702 | 9254 | loss | 2192 | C11orf54 | Y | 1 | 4 | 8.666 | Genic; OR > 6 |
| 11 | 93129448 | 93138702 | 9254 | loss | 2246 | C11orf54 | Y | 1 | 4 | 8.666 | Genic; OR > 6 |
| 11 | 93129448 | 93138702 | 9254 | loss | 2287 | C11orf54 | Y | 1 | 4 | 8.666 | Genic; OR > 6 |
| 11 | 93129448 | 93138702 | 9254 | loss | 2440 | C11orf54 | Y | 1 | 4 | 8.666 | Genic; OR > 6 |
| 12 | 760146 | 763846 | 3700 | gain | 2254 | WNK1 | N | 1 | 4 | 8.666 | Genic; OR > 6 |
| 12 | 760146 | 763846 | 3700 | gain | 2369 | WNK1 | N | 1 | 4 | 8.666 | Genic; OR > 6 |
| 12 | 760146 | 763846 | 3700 | gain | 2447 | WNK1 | N | 1 | 4 | 8.666 | Genic; OR > 6 |
| 12 | 760146 | 763846 | 3700 | gain | 2614 | WNK1 | N | 1 | 4 | 8.666 | Genic; OR > 6 |
| 12 | 9120874 | 9125246 | 4372 | loss | 2054 | A2M | Y | 2 | 13 | 14.433 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 12 | 9120874 | 9125246 | 4372 | loss | 2251 | A2M | Y | 2 | 13 | 14.333 | Genic; OR > 6 |
| 12 | 9120874 | 9125246 | 4372 | loss | 2261 | A2M | Y | 2 | 13 | 14.333 | Genic; OR > 6 |
| 12 | 9120874 | 9125246 | 4372 | loss | 2264 | A2M | Y | 2 | 13 | 14.333 | Genic; OR > 6 |
| 12 | 9120874 | 9125246 | 4372 | loss | 2280 | A2M | Y | 2 | 13 | 14.333 | Genic; OR > 6 |
| 12 | 9120874 | 9125246 | 4372 | loss | 2288 | A2M | Y | 2 | 13 | 14.333 | Genic; OR > 6 |
| 12 | 9120874 | 9125246 | 4372 | loss | 2372 | A2M | Y | 2 | 13 | 14.333 | Genic; OR > 6 |
| 12 | 9120874 | 9125246 | 4372 | loss | 2378 | A2M | Y | 2 | 13 | 14.333 | Genic; OR > 6 |
| 12 | 9120874 | 9125246 | 4372 | loss | 2405 | A2M | Y | 2 | 13 | 14.333 | Genic; OR > 6 |
| 12 | 9120874 | 9125246 | 4372 | loss | 2408 | A2M | Y | 2 | 13 | 14.333 | Genic; OR > 6 |
| 12 | 9120874 | 9125246 | 4372 | loss | 2552 | A2M | Y | 2 | 13 | 14.333 | Genic; OR > 6 |
| 12 | 9120874 | 9125246 | 4372 | loss | 2561 | A2M | Y | 2 | 13 | 14.333 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 12 | 9120874 | 9125246 | 4372 | loss | 2598 | A2M | Y | 2 | 13 | 14.33 | Genic; OR > 6 |
| 12 | 63383870 | 63385104 | 1234 | loss | 2185 | | N | 1 | 5 | 10.084 | Non-genic; OR > 10 |
| 12 | 63383870 | 63385104 | 1234 | loss | 2219 | | N | 1 | 5 | 10.084 | Non-genic; OR > 10 |
| 12 | 63383870 | 63385104 | 1234 | loss | 2260 | | N | 1 | 5 | 10.084 | Non-genic; OR > 10 |
| 12 | 63383870 | 63385104 | 1234 | loss | 2439 | | N | 1 | 5 | 10.084 | Non-genic; OR > 10 |
| 12 | 63383870 | 63385104 | 1234 | loss | 2591 | | N | 1 | 5 | 10.084 | Non-genic; OR > 10 |
| 12 | 80629297 | 80630527 | 1230 | loss | 2452 | PPFIA2 | N | 1 | 3 | 6.448 | Genic; OR > 6 |
| 12 | 80629297 | 80630527 | 1230 | loss | 2455 | PPFIA2 | N | 1 | 3 | 6.448 | Genic; OR > 6 |
| 12 | 80629297 | 80630527 | 1230 | loss | 2631 | PPFIA2 | N | 1 | 3 | 6.448 | Genic; OR > 6 |
| 12 | 98606972 | 98613364 | 6392 | gain | 2227 | ANKS1B | N | 1 | 3 | 6.448 | Genic; OR > 6 |
| 12 | 98606972 | 98613364 | 6392 | loss | 2326 | ANKS1B | N | 1 | 3 | 6.448 | Genic; OR > 6 |
| 12 | 98606972 | 98613364 | 6392 | loss | 2426 | ANKS1B | N | 1 | 3 | 6.448 | Genic; OR > 6 |
| 13 | 109911515 | 109916950 | 5435 | gain | 2046 | COL4A2 | Y | 1 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 8 | |
| 13 | 109911515 | 109916950 | 5435 | gain | 2055 | COL4A2 | Y | 1 | 3 | 6.448 | Genic; OR > 6 |
| 13 | 109911515 | 109916950 | 5435 | gain | 2622 | COL4A2 | Y | 1 | 3 | 6.448 | Genic; OR > 6 |
| 13 | 112546966 | 112555125 | 8159 | gain | 2333 | ATP11A | Y | 0 | 3 | 6.448 | Genic; OR > 6 |
| 13 | 112546966 | 112555125 | 8159 | gain | 2472 | ATP11A | Y | 0 | 3 | 6.448 | Genic; OR > 6 |
| 13 | 112546966 | 112555125 | 8159 | gain | 2521 | ATP11A | Y | 0 | 3 | 6.448 | Genic; OR > 6 |
| 14 | 31189082 | 31191639 | 2557 | loss | 2295 | NUBPL | N | 2 | 15 | 16.661 | Genic; OR > 6 |
| 14 | 31189082 | 31191639 | 2557 | loss | 2301 | NUBPL | N | 2 | 15 | 16.661 | Genic; OR > 6 |
| 14 | 31189082 | 31191639 | 2557 | loss | 2317 | NUBPL | N | 2 | 15 | 16.661 | Genic; OR > 6 |
| 14 | 31189082 | 31191639 | 2557 | loss | 2342 | NUBPL | N | 2 | 15 | 16.661 | Genic; OR > 6 |
| 14 | 31189082 | 31191639 | 2557 | loss | 2346 | NUBPL | N | 2 | 15 | 16.661 | Genic; OR > 6 |
| 14 | 31189082 | 31191639 | 2557 | loss | 2389 | NUBPL | N | 2 | 15 | 16.661 | Genic; OR > 6 |
| 14 | 31189082 | 31191639 | 2557 | loss | 2392 | NUBPL | N | 2 | 15 | 16.661 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 14 | 31189082 | 31191639 | 2557 | loss | 2418 | NUBPL | N | 2 | 15 | 16.661 | Genic; OR > 6 |
| 14 | 31189082 | 31191639 | 2557 | loss | 2494 | NUBPL | N | 2 | 15 | 16.661 | Genic; OR > 6 |
| 14 | 31189082 | 31191639 | 2557 | loss | 2540 | NUBPL | N | 2 | 15 | 16.661 | Genic; OR > 6 |
| 14 | 31189082 | 31191639 | 2557 | loss | 2563 | NUBPL | N | 2 | 15 | 16.661 | Genic; OR > 6 |
| 14 | 31189082 | 31191639 | 2557 | loss | 2591 | NUBPL | N | 2 | 15 | 16.661 | Genic; OR > 6 |
| 14 | 31189082 | 31191639 | 2557 | loss | 2612 | NUBPL | N | 2 | 15 | 16.661 | Genic; OR > 6 |
| 14 | 31189082 | 31191639 | 2557 | loss | 2622 | NUBPL | N | 2 | 15 | 16.661 | Genic; OR > 6 |
| 14 | 31189082 | 31191639 | 2557 | loss | 2627 | NUBPL | N | 2 | 15 | 16.661 | Genic; OR > 6 |
| 14 | 44043239 | 44045982 | 2743 | loss | 2227 | FSCB | Y | 2 | 6 | 6.651 | Genic; OR > 6 |
| 14 | 44043239 | 44045982 | 2743 | loss | 2273 | FSCB | Y | 2 | 6 | 6.651 | Genic; OR > 6 |
| 14 | 44043239 | 44045982 | 2743 | loss | 2284 | FSCB | Y | 2 | 6 | 6.651 | Genic; OR > 6 |
| 14 | 44043239 | 44045982 | 2743 | loss | 2328 | FSCB | Y | 2 | 6 | 6.651 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 14 | 44043239 | 44045982 | 2743 | loss | 2366 | FSCB | Y | 2 | 6 | 6.51 | Genic; OR > 6 |
| 14 | 44043239 | 44045982 | 2743 | loss | 2577 | FSCB | Y | 2 | 6 | 6.51 | Genic; OR > 6 |
| 14 | 52323151 | 52324282 | 1131 | loss | 2451 | GNPNAT1 | N | 0 | 4 | 8.66 | Genic; OR > 6 |
| 14 | 52323151 | 52324282 | 1131 | loss | 2455 | GNPNAT1 | N | 0 | 4 | 8.66 | Genic; OR > 6 |
| 14 | 52323151 | 52324282 | 1131 | loss | 2534 | GNPNAT1 | N | 0 | 4 | 8.66 | Genic; OR > 6 |
| 14 | 52323151 | 52324282 | 1131 | loss | 2549 | GNPNAT1 | N | 0 | 4 | 8.66 | Genic; OR > 6 |
| 14 | 69914777 | 69918284 | 3507 | loss | 2192 | SYNJ2BP-COX16,SYNJ2BP | N | 0 | 3 | 6.48 | Genic; OR > 6 |
| 14 | 69914777 | 69918284 | 3507 | loss | 2495 | SYNJ2BP-COX16,SYNJ2BP | N | 0 | 3 | 6.48 | Genic; OR > 6 |
| 14 | 69914777 | 69918284 | 3507 | loss | 2499 | SYNJ2BP-COX16,SYNJ2BP | N | 0 | 3 | 6.48 | Genic; OR > 6 |
| 14 | 99328538 | 99330427 | 1889 | gain | 2318 | EML1 | Y | 1 | 5 | 10.84 | Genic; OR > 6 |
| 14 | 99328538 | 99330427 | 1889 | gain | 2363 | EML1 | Y | 1 | 5 | 10.84 | Genic; OR > 6 |
| 14 | 99328538 | 99330427 | 1889 | gain | 2364 | EML1 | Y | 1 | 5 | 10.84 | Genic; OR > 6 |
| 14 | 99328538 | 99330427 | 1889 | loss | 2541 | EML1 | Y | 1 | 5 | 10.84 | Genic; OR > 6 |
| 14 | 99328538 | 99330427 | 1889 | gain | 2550 | EML1 | Y | 1 | 5 | 1 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 4 | 38 | 27 | | n | | | | | | 0.84 | |
| 14 | 105481933 | 105520894 | 38961 | loss | 2246 | ADAM6 | Y | 1 | 4 | 8.66 | Genic; OR > 6 |
| 14 | 105481933 | 105520894 | 38961 | loss | 2440 | ADAM6 | Y | 1 | 4 | 8.66 | Genic; OR > 6 |
| 14 | 105481933 | 105520894 | 38961 | loss | 2515 | ADAM6 | Y | 1 | 4 | 8.66 | Genic; OR > 6 |
| 14 | 105481933 | 105520894 | 38961 | loss | 2615 | ADAM6 | Y | 1 | 4 | 8.66 | Genic; OR > 6 |
| 14 | 105552296 | 105554767 | 2471 | loss | 2246 | | N | 1 | 8 | 17.446 | Non-genic; OR > 10 |
| 14 | 105552296 | 105554767 | 2471 | gain | 2286 | | N | 1 | 8 | 17.446 | Non-genic; OR > 10 |
| 14 | 105552296 | 105554767 | 2471 | gain | 2367 | | N | 1 | 8 | 17.446 | Non-genic; OR > 10 |
| 14 | 105552296 | 105554767 | 2471 | loss | 2440 | | N | 1 | 8 | 17.446 | Non-genic; OR > 10 |
| 14 | 105552296 | 105554767 | 2471 | loss | 2515 | | N | 1 | 8 | 17.446 | Non-genic; OR > 10 |
| 14 | 105552296 | 105554767 | 2471 | gain | 2567 | | N | 1 | 8 | 17.446 | Non-genic; OR > 10 |
| 14 | 105552296 | 105554767 | 2471 | gain | 2583 | | N | 1 | 8 | 17.446 | Non-genic; OR > 10 |
| 1 | 105552 | 105554 | 2471 | loss | 2615 | | N | 1 | 8 | 1 | Non-genic; OR |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 4 | 296 | 767 | | | | | | | | 7.746 | > 10 |
| 14 | 105554768 | 105556724 | 1956 | loss | 2246 | | N | 1 | 6 | 13.004 | Non-genic; OR > 10 |
| 14 | 105554768 | 105556724 | 1956 | gain | 2286 | | N | 1 | 6 | 13.004 | Non-genic; OR > 10 |
| 14 | 105554768 | 105556724 | 1956 | loss | 2440 | | N | 1 | 6 | 13.004 | Non-genic; OR > 10 |
| 14 | 105554768 | 105556724 | 1956 | gain | 2567 | | N | 1 | 6 | 13.004 | Non-genic; OR > 10 |
| 14 | 105554768 | 105556724 | 1956 | gain | 2583 | | N | 1 | 6 | 13.004 | Non-genic; OR > 10 |
| 14 | 105554768 | 105556724 | 1956 | loss | 2615 | | N | 1 | 6 | 13.004 | Non-genic; OR > 10 |
| 15 | 22682129 | 22684804 | 2675 | loss | 2381 | SNRPN | Y | 1 | 3 | 6.448 | Genic; OR > 6 |
| 15 | 22682129 | 22684804 | 2675 | loss | 2389 | SNRPN | Y | 1 | 3 | 6.448 | Genic; OR > 6 |
| 15 | 22682129 | 22684804 | 2675 | loss | 2561 | SNRPN | Y | 1 | 3 | 6.448 | Genic; OR > 6 |
| 15 | 40028045 | 40029547 | 1502 | gain | 2235 | EHD4 | N | 1 | 4 | 8.666 | Genic; OR > 6 |
| 15 | 40028045 | 40029547 | 1502 | loss | 2402 | EHD4 | N | 1 | 4 | 8.666 | Genic; OR > 6 |
| 15 | 40028045 | 40029547 | 1502 | loss | 2403 | EHD4 | N | 1 | 4 | 8.6 | Genic; OR > 6 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| | | | | | | | | | | 6 | |
| 15 | 40028045 | 40029547 | 1502 | loss | 2573 | EHD4 | N | 1 | 4 | 8.666 | Genic; OR > 6 |
| 15 | 48674235 | 48675832 | 1597 | loss | 2046 | TRPM7 | Y | 1 | 3 | 6.448 | Genic; OR > 6 |
| 15 | 48674235 | 48675832 | 1597 | loss | 2473 | TRPM7 | Y | 1 | 3 | 6.448 | Genic; OR > 6 |
| 15 | 48674235 | 48675832 | 1597 | loss | 2626 | TRPM7 | Y | 1 | 3 | 6.448 | Genic; OR > 6 |
| 15 | 57438505 | 57444905 | 6400 | loss | 2048 | MYO1E | N | 0 | 3 | 6.448 | Genic; OR > 6 |
| 15 | 57438505 | 57444905 | 6400 | loss | 2283 | MYO1E | N | 0 | 3 | 6.448 | Genic; OR > 6 |
| 15 | 57438505 | 57444905 | 6400 | loss | 2620 | MYO1E | N | 0 | 3 | 6.448 | Genic; OR > 6 |
| 15 | 81984070 | 81997262 | 13192 | loss | 2502 | SH3GL3 | N | 0 | 1 | 8.666 | Genic (distinct CNV-subregions); OR > 6 |
| 15 | 81997263 | 81999540 | 2277 | loss | 2502 | SH3GL3 | N | 0 | 2 | 8.666 | Genic (distinct CNV-subregions); OR > 6 |
| 15 | 81997263 | 81999540 | 2277 | loss | 2533 | SH3GL3 | N | 0 | 2 | 8.666 | Genic (distinct CNV-subregions); OR > 6 |
| 15 | 81999540 | 82008936 | 9396 | gain | 2435 | SH3GL3 | N | 0 | 1 | 8.666 | Genic (distinct CNV-subregions); OR > 6 |
| 15 | 82050059 | 82051184 | 1125 | loss | 2238 | SH3GL3 | N | 0 | 1 | 8.666 | Genic (distinct CNV-subregions); OR > 6 |
| 15 | 84564856 | 84571354 | 6498 | loss | 2214 | AGBL1 | Y | 1 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 15 | 84564856 | 84571354 | 6498 | loss | 2273 | AGBL1 | Y | 1 | 3 | 6.448 | Genic; OR > 6 |
| 15 | 84564856 | 84571354 | 6498 | loss | 2488 | AGBL1 | Y | 1 | 3 | 6.448 | Genic; OR > 6 |
| 16 | 3644964 | 3659399 | 14435 | loss | 2499 | DNASE1,TRAP1 | Y | 1 | 1 | 6.448 | Genic (distinct CNV-subregions); OR > 6 |
| 16 | 3697516 | 3702559 | 5043 | loss | 2203 | TRAP1 | N | 0 | 2 | 6.448 | Genic (distinct CNV-subregions); OR > 6 |
| 16 | 3697516 | 3702559 | 5043 | loss | 2547 | TRAP1 | N | 0 | 2 | 6.448 | Genic (distinct CNV-subregions); OR > 6 |
| 16 | 4616587 | 4616982 | 395 | gain | 2049 | MGRN1 | N | 1 | 9 | 19.669 | Genic; OR > 6 |
| 16 | 4616587 | 4616982 | 395 | gain | 2176 | MGRN1 | N | 1 | 9 | 19.669 | Genic; OR > 6 |
| 16 | 4616587 | 4616982 | 395 | gain | 2192 | MGRN1 | N | 1 | 9 | 19.669 | Genic; OR > 6 |
| 16 | 4616587 | 4616982 | 395 | gain | 2222 | MGRN1 | N | 1 | 9 | 19.669 | Genic; OR > 6 |
| 16 | 4616587 | 4616982 | 395 | gain | 2462 | MGRN1 | N | 1 | 9 | 19.669 | Genic; OR > 6 |
| 16 | 4616587 | 4616982 | 395 | gain | 2470 | MGRN1 | N | 1 | 9 | 19.669 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 16 | 4616587 | 4616982 | 395 | gain | 2484 | MGRN1 | N | 1 | 9 | 19.669 | Genic; OR > 6 |
| 16 | 4616587 | 4616982 | 395 | gain | 2490 | MGRN1 | N | 1 | 9 | 19.669 | Genic; OR > 6 |
| 16 | 4616587 | 4616982 | 395 | gain | 2497 | MGRN1 | N | 1 | 9 | 19.669 | Genic; OR > 6 |
| 16 | 16199683 | 16634863 | 435180 | gain | 2344 | NOMO3,MIR3179-2,MIR3179-3,MIR3179-1,MIR3180-2,MIR3180-3,MIR3180-1,PKD1P1,ABCC6 | Y | 0 | 3 | 6.48 | Genic; OR > 6 |
| 16 | 16199683 | 16634863 | 435180 | gain | 2377 | NOMO3,MIR3179-2,MIR3179-3,MIR3179-1,MIR3180-2,MIR3180-3,MIR3180-1,PKD1P1,ABCC6 | Y | 0 | 3 | 6.48 | Genic; OR > 6 |
| 16 | 16199683 | 16634863 | 435180 | gain | 2579 | NOMO3,MIR3179-2,MIR3179-3,MIR3179-1,MIR3180-2,MIR3180-3,MIR3180-1,PKD1P1,ABCC6 | Y | 0 | 3 | 6.48 | Genic; OR > 6 |
| 16 | 17334130 | 17341824 | 7694 | loss | 2447 | XYLT1 | N | 0 | 3 | 6.48 | Genic; OR > 6 |
| 16 | 17334130 | 17341824 | 7694 | loss | 2547 | XYLT1 | N | 0 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 8 | |
| 16 | 17334130 | 17341824 | 7694 | loss | 2600 | XYLT1 | N | 0 | 3 | 6.448 | Genic; OR > 6 |
| 16 | 20378166 | 20384652 | 6486 | loss | 2187 | ACSM2A | Y | 0 | 3 | 6.448 | Genic; OR > 6 |
| 16 | 20378166 | 20384652 | 6486 | loss | 2320 | ACSM2A | Y | 0 | 3 | 6.448 | Genic; OR > 6 |
| 16 | 20378166 | 20384652 | 6486 | gain | 2503 | ACSM2A | Y | 0 | 3 | 6.448 | Genic; OR > 6 |
| 16 | 20384653 | 20396651 | 11998 | loss | 2187 | ACSM2A | Y | 1 | 3 | 6.448 | Genic; OR > 6 |
| 16 | 20384653 | 20396651 | 11998 | loss | 2320 | ACSM2A | Y | 1 | 3 | 6.448 | Genic; OR > 6 |
| 16 | 20384653 | 20396651 | 11998 | gain | 2503 | ACSM2A | Y | 1 | 3 | 6.448 | Genic; OR > 6 |
| 16 | 24114284 | 24119097 | 4813 | gain | 2354 | PRKCB | N | 1 | 3 | 6.448 | Genic; OR > 6 |
| 16 | 24114284 | 24119097 | 4813 | gain | 2462 | PRKCB | N | 1 | 3 | 6.448 | Genic; OR > 6 |
| 16 | 24114284 | 24119097 | 4813 | loss | 2574 | PRKCB | N | 1 | 3 | 6.448 | Genic; OR > 6 |
| 16 | 48086361 | 48090194 | 3833 | loss | 2279 | ZNF423 | N | 0 | 3 | 6.448 | Genic; OR > 6 |
| 16 | 48086361 | 48090194 | 3833 | loss | 2441 | ZNF423 | N | 0 | 3 | 6.448 | Genic; OR > 6 |
| 16 | 48086361 | 48090194 | 3833 | loss | 2572 | ZNF423 | N | 0 | 3 | 6.448 | Genic; OR > 6 |
| 16 | 48776925 | 48780789 | 3864 | gain | 2487 | PAPD5 | N | 1 | 4 | 8.666 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 16 | 48776925 | 48780789 | 3864 | gain | 2515 | PAPD5 | N | 1 | 4 | 8.666 | Genic; OR > 6 |
| 16 | 48776925 | 48780789 | 3864 | gain | 2603 | PAPD5 | N | 1 | 4 | 8.666 | Genic; OR > 6 |
| 16 | 48776925 | 48780789 | 3864 | gain | 2625 | PAPD5 | N | 1 | 4 | 8.666 | Genic; OR > 6 |
| 16 | 48780790 | 48785482 | 4692 | gain | 2487 | PAPD5 | N | 0 | 4 | 8.666 | Genic; OR > 6 |
| 16 | 48780790 | 48785482 | 4692 | gain | 2515 | PAPD5 | N | 0 | 4 | 8.666 | Genic; OR > 6 |
| 16 | 48780790 | 48785482 | 4692 | gain | 2603 | PAPD5 | N | 0 | 4 | 8.666 | Genic; OR > 6 |
| 16 | 48780790 | 48785482 | 4692 | gain | 2625 | PAPD5 | N | 0 | 4 | 8.666 | Genic; OR > 6 |
| 17 | 1418207 | 1433148 | 14941 | gain | 2432 | SLC43A2 | Y | 0 | 2 | 6.448 | Genic (distinct CNV-subregions); OR > 6 |
| 17 | 1418207 | 1433148 | 14941 | gain | 2563 | SLC43A2 | Y | 0 | 2 | 6.448 | Genic (distinct CNV-subregions); OR > 6 |
| 17 | 1450981 | 1453281 | 2300 | loss | 2610 | SLC43A2 | N | 0 | 1 | 6.448 | Genic (distinct CNV-subregions); OR > 6 |
| 17 | 19924055 | 19935009 | 10954 | loss | 2227 | SPECC1 | Y | 0 | 3 | 6.448 | Genic; OR > 6 |
| 17 | 19924055 | 19935009 | 10954 | loss | 2461 | SPECC1 | Y | 0 | 3 | 6.448 | Genic; OR > 6 |
| 17 | 19924055 | 19935009 | 10954 | loss | 2511 | SPECC1 | Y | 0 | 3 | 6.448 | Genic; OR > 6 |
| 17 | 26546113 | 26546197 | 84 | loss | 2365 | NF1 | N | 1 | 3 | 6.4 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 17 | 26546113 | 26546197 | 84 | loss | 2371 | NF1 | N | 1 | 3 | 6.448 | Genic; OR > 6 |
| 17 | 26546113 | 26546197 | 84 | loss | 2610 | NF1 | N | 1 | 3 | 6.448 | Genic; OR > 6 |
| 17 | 47426055 | 47427190 | 1135 | loss | 2450 | CA10 | N | 0 | 1 | 6.448 | Genic (distinct CNV-subregions); OR > 6 |
| 17 | 47472752 | 47480485 | 7733 | loss | 2180 | CA10 | N | 0 | 2 | 6.448 | Genic (distinct CNV-subregions); OR > 6 |
| 17 | 47472752 | 47480485 | 7733 | loss | 2455 | CA10 | N | 0 | 2 | 6.448 | Genic (distinct CNV-subregions); OR > 6 |
| 18 | 62362980 | 62365683 | 2703 | loss | 2260 | CDH19 | Y | 1 | 3 | 6.448 | Genic; OR > 6 |
| 18 | 62362980 | 62365683 | 2703 | loss | 2286 | CDH19 | Y | 1 | 3 | 6.448 | Genic; OR > 6 |
| 18 | 62362980 | 62365683 | 2703 | gain | 2541 | CDH19 | Y | 1 | 3 | 6.448 | Genic; OR > 6 |
| 19 | 6969173 | 7017173 | 48000 | gain | 2285 | MBD3L2,MBD3L3,MBD3L4,MBD3L5 | Y | 1 | 4 | 8.666 | Genic; OR > 6 |
| 19 | 6969173 | 7017173 | 48000 | gain | 2503 | MBD3L2,MBD3L3,MBD3L4,MBD3L5 | Y | 1 | 4 | 8.666 | Genic; OR > 6 |
| 19 | 6969173 | 7017173 | 48000 | gain | 2567 | MBD3L2,MBD3L3,MBD3L4,MBD3L5 | Y | 1 | 4 | 8.666 | Genic; OR > 6 |
| 19 | 6969173 | 7017173 | 48000 | gain | 2640 | MBD3L2,MBD3L3,MBD3L4,MBD3L5 | Y | 1 | 4 | 8.666 | Genic; OR > 6 |
| 19 | 14908620 | 14910693 | 2073 | loss | 2052 | | N | 8 | 39 | 11.333 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 19 | 14908620 | 14910693 | 2073 | gain | 2178 | | N | 8 | 39 | 11.333 | Non-genic; OR > 10 |
| 19 | 14908620 | 14910693 | 2073 | gain | 2200 | | N | 8 | 39 | 11.333 | Non-genic; OR > 10 |
| 19 | 14908620 | 14910693 | 2073 | gain | 2232 | | N | 8 | 39 | 11.333 | Non-genic; OR > 10 |
| 19 | 14908620 | 14910693 | 2073 | loss | 2268 | | N | 8 | 39 | 11.333 | Non-genic; OR > 10 |
| 19 | 14908620 | 14910693 | 2073 | loss | 2273 | | N | 8 | 39 | 11.333 | Non-genic; OR > 10 |
| 19 | 14908620 | 14910693 | 2073 | loss | 2275 | | N | 8 | 39 | 11.333 | Non-genic; OR > 10 |
| 19 | 14908620 | 14910693 | 2073 | loss | 2278 | | N | 8 | 39 | 11.333 | Non-genic; OR > 10 |
| 19 | 14908620 | 14910693 | 2073 | loss | 2301 | | N | 8 | 39 | 11.333 | Non-genic; OR > 10 |
| 19 | 14908620 | 14910693 | 2073 | loss | 2305 | | N | 8 | 39 | 11.333 | Non-genic; OR > 10 |
| 19 | 14908620 | 14910693 | 2073 | loss | 2355 | | N | 8 | 39 | 11.333 | Non-genic; OR > 10 |
| 19 | 14908620 | 14910693 | 2073 | loss | 2364 | | N | 8 | 39 | 11.333 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 19 | 14908620 | 14910693 | 2073 | loss | 2373 | | N | 8 | 39 | 11.333 | Non-genic; OR > 10 |
| 19 | 14908620 | 14910693 | 2073 | loss | 2375 | | N | 8 | 39 | 11.333 | Non-genic; OR > 10 |
| 19 | 14908620 | 14910693 | 2073 | loss | 2378 | | N | 8 | 39 | 11.333 | Non-genic; OR > 10 |
| 19 | 14908620 | 14910693 | 2073 | loss | 2383 | | N | 8 | 39 | 11.333 | Non-genic; OR > 10 |
| 19 | 14908620 | 14910693 | 2073 | loss | 2384 | | N | 8 | 39 | 11.333 | Non-genic; OR > 10 |
| 19 | 14908620 | 14910693 | 2073 | loss | 2395 | | N | 8 | 39 | 11.333 | Non-genic; OR > 10 |
| 19 | 14908620 | 14910693 | 2073 | loss | 2397 | | N | 8 | 39 | 11.333 | Non-genic; OR > 10 |
| 19 | 14908620 | 14910693 | 2073 | loss | 2404 | | N | 8 | 39 | 11.333 | Non-genic; OR > 10 |
| 19 | 14908620 | 14910693 | 2073 | loss | 2415 | | N | 8 | 39 | 11.333 | Non-genic; OR > 10 |
| 19 | 14908620 | 14910693 | 2073 | loss | 2419 | | N | 8 | 39 | 11.333 | Non-genic; OR > 10 |
| 19 | 14908620 | 14910693 | 2073 | loss | 2420 | | N | 8 | 39 | 11.333 | Non-genic; OR > 10 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 19 | 14908620 | 14910693 | 2073 | loss | 2427 | | N | 8 | 39 | 11.333 | Non-genic; OR > 10 |
| 19 | 14908620 | 14910693 | 2073 | loss | 2437 | | N | 8 | 39 | 11.333 | Non-genic; OR > 10 |
| 19 | 14908620 | 14910693 | 2073 | gain | 2466 | | N | 8 | 39 | 11.333 | Non-genic; OR > 10 |
| 19 | 14908620 | 14910693 | 2073 | gain | 2486 | | N | 8 | 39 | 11.333 | Non-genic; OR > 10 |
| 19 | 14908620 | 14910693 | 2073 | loss | 2541 | | N | 8 | 39 | 11.333 | Non-genic; OR > 10 |
| 19 | 14908620 | 14910693 | 2073 | loss | 2543 | | N | 8 | 39 | 11.333 | Non-genic; OR > 10 |
| 19 | 14908620 | 14910693 | 2073 | loss | 2548 | | N | 8 | 39 | 11.333 | Non-genic; OR > 10 |
| 19 | 14908620 | 14910693 | 2073 | loss | 2557 | | N | 8 | 39 | 11.333 | Non-genic; OR > 10 |
| 19 | 14908620 | 14910693 | 2073 | loss | 2580 | | N | 8 | 39 | 11.333 | Non-genic; OR > 10 |
| 19 | 14908620 | 14910693 | 2073 | loss | 2584 | | N | 8 | 39 | 11.333 | Non-genic; OR > 10 |
| 19 | 14908620 | 14910693 | 2073 | loss | 2601 | | N | 8 | 39 | 11.333 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 19 | 14908620 | 14910693 | 2073 | loss | 2608 | | N | 8 | 39 | 11.333 | Non-genic; OR > 10 |
| 19 | 14908620 | 14910693 | 2073 | loss | 2612 | | N | 8 | 39 | 11.333 | Non-genic; OR > 10 |
| 19 | 14908620 | 14910693 | 2073 | loss | 2629 | | N | 8 | 39 | 11.333 | Non-genic; OR > 10 |
| 19 | 14908620 | 14910693 | 2073 | loss | 2642 | | N | 8 | 39 | 11.333 | Non-genic; OR > 10 |
| 19 | 14908620 | 14910693 | 2073 | loss | 2643 | | N | 8 | 39 | 11.333 | Non-genic; OR > 10 |
| 19 | 22939751 | 22945553 | 5802 | loss | 2051 | | N | 1 | 10 | 21.992 | Non-genic; OR > 10 |
| 19 | 22939751 | 22945553 | 5802 | loss | 2269 | | N | 1 | 10 | 21.992 | Non-genic; OR > 10 |
| 19 | 22939751 | 22945553 | 5802 | loss | 2270 | | N | 1 | 10 | 21.992 | Non-genic; OR > 10 |
| 19 | 22939751 | 22945553 | 5802 | loss | 2294 | | N | 1 | 10 | 21.992 | Non-genic; OR > 10 |
| 19 | 22939751 | 22945553 | 5802 | loss | 2339 | | N | 1 | 10 | 21.992 | Non-genic; OR > 10 |
| 19 | 22939751 | 22945553 | 5802 | loss | 2440 | | N | 1 | 10 | 21.992 | Non-genic; OR > 10 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 19 | 22939751 | 22945553 | 5802 | loss | 2568 | | N | 1 | 10 | 21.992 | Non-genic; OR > 10 |
| 19 | 22939751 | 22945553 | 5802 | loss | 2589 | | N | 1 | 10 | 21.992 | Non-genic; OR > 10 |
| 19 | 22939751 | 22945553 | 5802 | loss | 2597 | | N | 1 | 10 | 21.992 | Non-genic; OR > 10 |
| 19 | 22939751 | 22945553 | 5802 | loss | 2599 | | N | 1 | 10 | 21.992 | Non-genic; OR > 10 |
| 19 | 39394208 | 39395957 | 1749 | loss | 2054 | LSM14A | N | 1 | 4 | 8.666 | Genic; OR > 6 |
| 19 | 39394208 | 39395957 | 1749 | loss | 2401 | LSM14A | N | 1 | 4 | 8.666 | Genic; OR > 6 |
| 19 | 39394208 | 39395957 | 1749 | loss | 2425 | LSM14A | N | 1 | 4 | 8.666 | Genic; OR > 6 |
| 19 | 39394208 | 39395957 | 1749 | loss | 2428 | LSM14A | N | 1 | 4 | 8.666 | Genic; OR > 6 |
| 19 | 41532063 | 41533404 | 1341 | gain | 2449 | ZFP14 | N | 1 | 4 | 8.666 | Genic; OR > 6 |
| 19 | 41532063 | 41533404 | 1341 | gain | 2494 | ZFP14 | N | 1 | 4 | 8.666 | Genic; OR > 6 |
| 19 | 41532063 | 41533404 | 1341 | gain | 2528 | ZFP14 | N | 1 | 4 | 8.666 | Genic; OR > 6 |
| 19 | 41532063 | 41533404 | 1341 | loss | 2559 | ZFP14 | N | 1 | 4 | 8.666 | Genic; OR > 6 |
| 19 | 46032427 | 46046858 | 14431 | gain | 2052 | CYP2A6 | Y | 1 | 3 | 6.448 | Genic; OR > 6 |
| 19 | 46032427 | 46046858 | 14431 | gain | 2374 | CYP2A6 | Y | 1 | 3 | 6. | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 9 | 27 | 58 | | n | | | | | | 48 | |
| 19 | 46032427 | 46046858 | 14431 | gain | 2413 | CYP2A6 | Y | 1 | 3 | 6.648 | Genic; OR > 6 |
| 19 | 53443125 | 53445054 | 1929 | gain | 2213 | CARD8 | Y | 1 | 4 | 8.666 | Genic; OR > 6 |
| 19 | 53443125 | 53445054 | 1929 | loss | 2294 | CARD8 | Y | 1 | 4 | 8.666 | Genic; OR > 6 |
| 19 | 53443125 | 53445054 | 1929 | gain | 2464 | CARD8 | Y | 1 | 4 | 8.666 | Genic; OR > 6 |
| 19 | 53443125 | 53445054 | 1929 | gain | 2524 | CARD8 | Y | 1 | 4 | 8.666 | Genic; OR > 6 |
| 19 | 56292782 | 56294669 | 1887 | loss | 2207 | CTU1 | Y | 0 | 3 | 6.648 | Genic; OR > 6 |
| 19 | 56292782 | 56294669 | 1887 | loss | 2391 | CTU1 | Y | 0 | 3 | 6.448 | Genic; OR > 6 |
| 19 | 56292782 | 56294669 | 1887 | loss | 2439 | CTU1 | Y | 0 | 3 | 6.448 | Genic; OR > 6 |
| 20 | 14569192 | 14574538 | 5346 | loss | 2241 | MACROD2 | N | 0 | 3 | 6.448 | Genic; OR > 6 |
| 20 | 14569192 | 14574538 | 5346 | loss | 2484 | MACROD2 | N | 0 | 3 | 6.448 | Genic; OR > 6 |
| 20 | 14569192 | 14574538 | 5346 | loss | 2491 | MACROD2 | N | 0 | 3 | 6.448 | Genic; OR > 6 |
| 20 | 17283788 | 17285773 | 1985 | loss | 2440 | PCSK2 | N | 0 | 3 | 6.448 | Genic; OR > 6 |
| 20 | 17283788 | 17285773 | 1985 | loss | 2541 | PCSK2 | N | 0 | 3 | 6.448 | Genic; OR > 6 |
| 20 | 17283788 | 17285773 | 1985 | loss | 2544 | PCSK2 | N | 0 | 3 | 6.448 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 20 | 19974238 | 19979617 | 5379 | gain | 2190 | CRNKL1 | Y | 1 | 3 | 6.448 | Genic; OR > 6 |
| 20 | 19974238 | 19979617 | 5379 | gain | 2474 | CRNKL1 | Y | 1 | 3 | 6.448 | Genic; OR > 6 |
| 20 | 19974238 | 19979617 | 5379 | gain | 2489 | CRNKL1 | Y | 1 | 3 | 6.448 | Genic; OR > 6 |
| 20 | 19979618 | 19981548 | 1930 | gain | 2190 | C20orf26,CRNKL1 | Y | 1 | 4 | 8.666 | Genic; OR > 6 |
| 20 | 19979618 | 19981548 | 1930 | gain | 2474 | C20orf26,CRNKL1 | Y | 1 | 4 | 8.666 | Genic; OR > 6 |
| 20 | 19979618 | 19981548 | 1930 | gain | 2489 | C20orf26,CRNKL1 | Y | 1 | 4 | 8.666 | Genic; OR > 6 |
| 20 | 19979618 | 19981548 | 1930 | loss | 2597 | C20orf26,CRNKL1 | Y | 1 | 4 | 8.666 | Genic; OR > 6 |
| 20 | 19981549 | 19982732 | 1183 | gain | 2190 | C20orf26,CRNKL1 | N | 0 | 3 | 6.448 | Genic; OR > 6 |
| 20 | 19981549 | 19982732 | 1183 | gain | 2474 | C20orf26,CRNKL1 | N | 0 | 3 | 6.448 | Genic; OR > 6 |
| 20 | 19981549 | 19982732 | 1183 | gain | 2489 | C20orf26,CRNKL1 | N | 0 | 3 | 6.448 | Genic; OR > 6 |
| 20 | 47586063 | 47612159 | 26096 | loss | 2434 | PTGIS | Y | 1 | 3 | 6.448 | Genic; OR > 6 |
| 20 | 47586063 | 47612159 | 26096 | loss | 2484 | PTGIS | Y | 1 | 3 | 6.448 | Genic; OR > 6 |
| 20 | 47586063 | 47612159 | 26096 | loss | 2630 | PTGIS | Y | 1 | 3 | 6.448 | Genic; OR > 6 |
| 21 | 39695337 | 39697029 | 1692 | gain | 2312 | | N | 1 | 7 | 15.225 | Non-genic; OR > 10 |

| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
|---|---|---|---|---|---|---|---|---|---|---|---|
| 21 | 39695337 | 39697029 | 1692 | gain | 2372 | | N | 1 | 7 | 15.225 | Non-genic; OR > 10 |
| 21 | 39695337 | 39697029 | 1692 | gain | 2507 | | N | 1 | 7 | 15.225 | Non-genic; OR > 10 |
| 21 | 39695337 | 39697029 | 1692 | gain | 2519 | | N | 1 | 7 | 15.225 | Non-genic; OR > 10 |
| 21 | 39695337 | 39697029 | 1692 | gain | 2530 | | N | 1 | 7 | 15.225 | Non-genic; OR > 10 |
| 21 | 39695337 | 39697029 | 1692 | gain | 2596 | | N | 1 | 7 | 15.225 | Non-genic; OR > 10 |
| 21 | 39695337 | 39697029 | 1692 | gain | 2604 | | N | 1 | 7 | 15.225 | Non-genic; OR > 10 |
| 21 | 41140283 | 41141370 | 1087 | gain | 2055 | DSCAM | Y | 2 | 7 | 7.661 | Genic; OR > 6 |
| 21 | 41140283 | 41141370 | 1087 | gain | 2226 | DSCAM | Y | 2 | 7 | 7.661 | Genic; OR > 6 |
| 21 | 41140283 | 41141370 | 1087 | gain | 2270 | DSCAM | Y | 2 | 7 | 7.661 | Genic; OR > 6 |
| 21 | 41140283 | 41141370 | 1087 | gain | 2363 | DSCAM | Y | 2 | 7 | 7.661 | Genic; OR > 6 |
| 21 | 41140283 | 41141370 | 1087 | gain | 2504 | DSCAM | Y | 2 | 7 | 7.661 | Genic; OR > 6 |
| 21 | 41140283 | 41141370 | 1087 | gain | 2597 | DSCAM | Y | 2 | 7 | 7.661 | Genic; OR > 6 |
| 21 | 41140283 | 41141370 | 1087 | gain | 2643 | DSCAM | Y | 2 | 7 | 7.6 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 22 | 28477025 | 28481680 | 4655 | gain | 2263 | ZMAT5 | Y | 1 | 3 | 6.448 | Genic; OR > 6 |
| 22 | 28477025 | 28481680 | 4655 | gain | 2427 | ZMAT5 | Y | 1 | 3 | 6.448 | Genic; OR > 6 |
| 22 | 28477025 | 28481680 | 4655 | gain | 2590 | ZMAT5 | Y | 1 | 3 | 6.448 | Genic; OR > 6 |
| 23 | 70692387 | 70693450 | 1063 | loss | 2544 | OGT | Y | 1 | 3 | 6.448 | Genic; OR > 6 |
| 23 | 70692387 | 70693450 | 1063 | loss | 2628 | OGT | Y | 1 | 3 | 6.448 | Genic; OR > 6 |
| 23 | 70692387 | 70693450 | 1063 | loss | 2633 | OGT | Y | 1 | 3 | 6.448 | Genic; OR > 6 |
| 23 | 98627062 | 98628953 | 1891 | gain | 2207 | LOC442459 | N | 0 | 1 | 6.448 | Genic (distinct CNV-subregions); OR > 6 |
| 23 | 98753421 | 98853902 | 100481 | loss | 2350 | LOC442459 | Y | 0 | 1 | 6.448 | Genic (distinct CNV-subregions); OR > 6 |
| 23 | 98953337 | 98979358 | 26021 | loss | 2536 | LOC442459 | Y | 0 | 1 | 6.448 | Genic (distinct CNV-subregions); OR > 6 |
| 23 | 134801361 | 134839685 | 38324 | loss | 2334 | SAGE1 | Y | 0 | 3 | 6.448 | Genic; OR > 6 |
| 23 | 134801361 | 134839685 | 38324 | loss | 2502 | SAGE1 | Y | 0 | 3 | 6.448 | Genic; OR > 6 |
| 23 | 134801361 | 134839685 | 38324 | loss | 2588 | SAGE1 | Y | 0 | 3 | 6.448 | Genic; OR > 6 |
| 23 | 149901706 | 149902701 | 995 | gain | 2047 | HMGB3 | Y | 0 | 5 | 10.884 | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| 23 | 149901706 | 149902701 | 995 | gain | 2411 | HMGB3 | Y | 0 | 5 | 10.884 | Genic; OR > 6 |
| 23 | 149901706 | 149902701 | 995 | gain | 2458 | HMGB3 | Y | 0 | 5 | 10.884 | Genic; OR > 6 |
| 23 | 149901706 | 149902701 | 995 | gain | 2551 | HMGB3 | Y | 0 | 5 | 10.884 | Genic; OR > 6 |
| 23 | 149901706 | 149902701 | 995 | gain | 2597 | HMGB3 | Y | 0 | 5 | 10.884 | Genic; OR > 6 |
| 23 | 149902702 | 149904265 | 1563 | gain | 2047 | HMGB3 | N | 2 | 6 | 6.51 | Genic; OR > 6 |
| 23 | 149902702 | 149904265 | 1563 | gain | 2048 | HMGB3 | N | 2 | 6 | 6.51 | Genic; OR > 6 |
| 23 | 149902702 | 149904265 | 1563 | gain | 2411 | HMGB3 | N | 2 | 6 | 6.51 | Genic; OR > 6 |
| 23 | 149902702 | 149904265 | 1563 | gain | 2458 | HMGB3 | N | 2 | 6 | 6.51 | Genic; OR > 6 |
| 23 | 149902702 | 149904265 | 1563 | gain | 2551 | HMGB3 | N | 2 | 6 | 6.51 | Genic; OR > 6 |
| 23 | 149902702 | 149904265 | 1563 | gain | 2597 | HMGB3 | N | 2 | 6 | 6.51 | Genic; OR > 6 |
| 23 | 154456892 | 154456908 | 16 | loss | 2198 | TMLHE | N | 1 | 5 | 10.884 | Genic; OR > 6 |
| 23 | 154456892 | 154456908 | 16 | loss | 2203 | TMLHE | N | 1 | 5 | 10.884 | Genic; OR > 6 |
| 23 | 154456892 | 154456908 | 16 | loss | 2462 | TMLHE | N | 1 | 5 | 10. | Genic; OR > 6 |

Figure 9B (Continued)

| Figure 9B | | | | | | | | | | | |
|---|---|---|---|---|---|---|---|---|---|---|---|
| Chr | CNV Subregion Start | CNV Subregion Stop | CNV Subregion Size | CNV Type | PD Case ID(s) | RefSeq Gene Symbol(s) | Exon overlap | NVE cases | PD cases | OR | Category |
| | | | | | | | | | | 84 | |
| 23 | 154456892 | 154456908 | 16 | loss | 2491 | TMLHE | N | 1 | 5 | 10.84 | Genic; OR > 6 |
| 23 | 154456892 | 154456908 | 16 | loss | 2526 | TMLHE | N | 1 | 5 | 10.84 | Genic; OR > 6 |

Figure 9B (Continued)

| Figure 9C | | | | | | |
|---|---|---|---|---|---|---|
| Chr | Start | Stop | Size (bp) | PD Case ID | Gene Names | Exon overlap |
| 1 | 1707874 | 1914525 | 206651 | 1020 | KIAA1751,TMEM52,GNB1,CALML6 | Y |
| 1 | 6779563 | 6786218 | 6655 | 973 | CAMTA1 | N |
| 1 | 6786219 | 6789223 | 3004 | 962;973 | CAMTA1 | N |
| 1 | 6789224 | 6790460 | 1236 | 962 | CAMTA1 | N |
| 1 | 7056961 | 7059582 | 2621 | 1037 | CAMTA1 | N |
| 1 | 18377963 | 18381122 | 3159 | 965 | IGSF21 | N |
| 1 | 18554390 | 18556733 | 2343 | 966 | IGSF21 | N |
| 1 | 68435695 | 68436445 | 750 | 961;971;992;997;998;999;1011;1013;1020 | WLS,GNG12-AS1 | N |
| 1 | 68436446 | 68439703 | 3257 | 1020 | WLS,GNG12-AS1 | N |
| 1 | 74271266 | 74334696 | 63430 | 2544 | LRRIQ3 | Y |
| 1 | 74359462 | 74372201 | 12739 | 2222 | LRRIQ3 | N |
| 1 | 74361348 | 74372201 | 10853 | 968;1010;1029 | LRRIQ3 | N |
| 1 | 74421868 | 74434506 | 12638 | 2539 | LRRIQ3 | Y |
| 1 | 74421868 | 74434506 | 12638 | 2610 | LRRIQ3 | Y |
| 1 | 85964576 | 85967615 | 3039 | 948;984;991;993;994;998;1005;1009;1010;1011;1013;1014;1015;1020 | COL24A1 | Y |
| 1 | 103839772 | 103899770 | 59998 | 998 | AMY2B,RNPC3 | Y |
| 1 | 103899771 | 103901453 | 1682 | 998;1003 | AMY2B | N |
| 1 | 103901454 | 103904722 | 3268 | 998;1003;1027 | AMY2B | N |
| 1 | 108538663 | 108543860 | 5197 | 959;1029 | SLC25A24 | N |
| 1 | 113847479 | 113848985 | 1506 | 1016;1036 | MAGI3 | N |
| 1 | 153095163 | 153108159 | 12996 | 950 | KCNN3 | Y |
| 1 | 194977713 | 194978217 | 504 | 1001;1028 | CFH | Y |
| 1 | 194978218 | 195009357 | 31139 | 961;990;996;1001;1028 | CFH | Y |
| 1 | 195559094 | 195562465 | 3371 | 958;972;1002 | CRB1 | N |
| 1 | 196963584 | 196986393 | 22809 | 1034 | PTPRC | Y |
| 1 | 204497847 | 204637883 | 140036 | 988;990 | CTSE,SRGAP2 | Y |
| 1 | 211022043 | 211027746 | 5703 | 1001;1036 | NSL1 | Y |
| 1 | 211441787 | 211453715 | 11928 | 1027 | RPS6KC1 | N |
| 1 | 211453716 | 211460007 | 6291 | 958;1027 | RPS6KC1 | N |
| 1 | 211460008 | 211462117 | 2109 | 1027 | RPS6KC1 | N |

Figure 9C (Continued)

| Figure 9C | | | | | | |
|---|---|---|---|---|---|---|
| Chr | Start | Stop | Size (bp) | PD Case ID | Gene Names | Exon overlap |
| 1 | 233606018 | 233781576 | 175558 | 1018 | GNG4,TBCE,B3GALNT2 | Y |
| 1 | 239259578 | 239489157 | 229579 | 948 | MIR3123,RGS7 | Y |
| 1 | 243943023 | 244875851 | 932828 | 986 | TFB2M,CNST,LOC255654,SMYD3 | Y |
| 2 | 3708749 | 3713663 | 4914 | 995;1001;1018;1019 | ALLC | N |
| 2 | 44398520 | 44488199 | 89679 | 978 | CAMKMT,PREPL,SLC3A1 | Y |
| 2 | 54308895 | 54317908 | 9013 | 983 | ACYP2 | N |
| 2 | 54317909 | 54320610 | 2701 | 962 | ACYP2 | N |
| 2 | 54317909 | 54320610 | 2701 | 962;983 | ACYP2 | N |
| 2 | 54320611 | 54356768 | 36157 | 983 | TSPYL6,ACYP2 | Y |
| 2 | 112750646 | 112761949 | 11303 | 996;1022 | ZC3H6 | N |
| 2 | 112752277 | 112761949 | 9672 | 2327 | ZC3H6 | N |
| 2 | 112752277 | 112761949 | 9672 | 2342 | ZC3H6 | N |
| 2 | 112752277 | 112761949 | 9672 | 2360 | ZC3H6 | N |
| 2 | 112752277 | 112761949 | 9672 | 2426 | ZC3H6 | N |
| 2 | 112752277 | 112761949 | 9672 | 2515 | ZC3H6 | N |
| 2 | 112752277 | 112761949 | 9672 | 2587 | ZC3H6 | N |
| 2 | 143350188 | 143354905 | 4717 | 1037 | KYNU | Y |
| 2 | 153167113 | 153168325 | 1212 | 962;977 | FMNL2 | N |
| 2 | 154593217 | 154605620 | 12403 | 950 | GALNT13 | N |
| 2 | 154915705 | 154919651 | 3946 | 1022 | GALNT13 | N |
| 2 | 154953643 | 154955528 | 1885 | 1037 | GALNT13 | N |
| 2 | 169872912 | 169890340 | 17428 | 1037 | LRP2 | Y |
| 2 | 170842044 | 170843170 | 1126 | 955;1002 | MYO3B | N |
| 2 | 171074964 | 171076390 | 1426 | 1007 | MYO3B | N |
| 2 | 171186115 | 171193427 | 7312 | 959 | MYO3B | N |
| 2 | 171193428 | 171203861 | 10433 | 959;1037 | MYO3B | N |
| 2 | 171203862 | 171205175 | 1313 | 1037 | MYO3B | N |
| 2 | 198356013 | 198386999 | 30986 | 1036 | BOLL,PLCL1 | Y |
| 2 | 198497294 | 198505239 | 7945 | 2190 | PLCL1 | N |
| 2 | 198497294 | 198505239 | 7945 | 2298 | PLCL1 | N |
| 2 | 198497294 | 198505239 | 7945 | 2575 | PLCL1 | N |
| 2 | 210019796 | 210021952 | 2156 | 969 | MAP2 | N |
| 2 | 210089280 | 210092780 | 3500 | 990 | MAP2 | N |
| 2 | 214581782 | 214582920 | 1138 | 993 | SPAG16 | N |

Figure 9C (Continued)

| Figure 9C | | | | | | |
|---|---|---|---|---|---|---|
| Chr | Start | Stop | Size (bp) | PD Case ID | Gene Names | Exon overlap |
| 2 | 214584322 | 214586936 | 2614 | 993 | SPAG16 | Y |
| 2 | 214805561 | 214807910 | 2349 | 1018 | SPAG16 | N |
| 2 | 214886207 | 214887681 | 1474 | 999 | SPAG16 | N |
| 2 | 238217378 | 238219153 | 1775 | 1010 | LRRFIP1 | N |
| 2 | 238223193 | 238224411 | 1218 | 952;966;976;978;1002;1010;1014;1034 | LRRFIP1 | N |
| 3 | 11693583 | 11695234 | 1651 | 974 | VGLL4 | N |
| 3 | 11705809 | 11869809 | 164000 | 989 | TAMM41,VGLL4 | Y |
| 3 | 30711659 | 30768467 | 56808 | 2613 | GADL1 | Y |
| 3 | 30739769 | 30743172 | 3403 | 1017;1025 | GADL1 | Y |
| 3 | 30743173 | 30748426 | 5253 | 978;1017;1025 | GADL1 | Y |
| 3 | 30748427 | 30751038 | 2611 | 1017 | GADL1 | N |
| 3 | 30768468 | 30770607 | 2139 | 2577 | GADL1 | N |
| 3 | 30768468 | 30770607 | 2139 | 2613 | GADL1 | N |
| 3 | 30770608 | 30807514 | 36906 | 2613 | GADL1 | Y |
| 3 | 30845814 | 30896445 | 50631 | 2603 | GADL1 | Y |
| 3 | 55514618 | 55517737 | 3119 | 969;999;1005 | ERC2 | Y |
| 3 | 57391544 | 57403468 | 11924 | 986 | DNAH12 | Y |
| 3 | 60640025 | 60872007 | 231982 | 967 | FHIT | Y |
| 3 | 60774433 | 60817887 | 43454 | 967 | FHIT | Y |
| 3 | 89522996 | 89616359 | 93363 | 960 | EPHA3 | Y |
| 3 | 115911311 | 115919955 | 8644 | 1034;1036 | ZBTB20 | Y |
| 3 | 122247183 | 122251797 | 4614 | 990;1033 | STXBP5L | N |
| 3 | 122473098 | 122479931 | 6833 | 1004 | STXBP5L | N |
| 3 | 172847008 | 172850471 | 3463 | 994 | PLD1 | N |
| 3 | 173003698 | 173005242 | 1544 | 991;1015;1022 | PLD1 | N |
| 3 | 173006874 | 173009667 | 2793 | 991 | PLD1 | N |
| 3 | 174698474 | 174701950 | 3476 | 952;975;978;1020;1022;1034 | NLGN1 | N |
| 3 | 174701951 | 174704469 | 2518 | 975;978;1020;1022;1034 | NLGN1 | N |
| 3 | 174704470 | 174706670 | 2200 | 1020;1034 | NLGN1 | N |
| 3 | 174706671 | 174708603 | 1932 | 1034 | NLGN1 | N |
| 3 | 189753649 | 189936236 | 182587 | 971 | LPP | Y |
| 3 | 193372894 | 193374127 | 1233 | 1016 | FGF12 | N |
| 3 | 193472185 | 193478807 | 6622 | 2053 | FGF12 | N |
| 3 | 193472185 | 193478807 | 6622 | 2418 | FGF12 | N |

Figure 9C (Continued)

| Figure 9C | | | | | | |
|---|---|---|---|---|---|---|
| Chr | Start | Stop | Size (bp) | PD Case ID | Gene Names | Exon overlap |
| 3 | 193472185 | 193478807 | 6622 | 2427 | FGF12 | N |
| 3 | 193472185 | 193478807 | 6622 | 2450 | FGF12 | N |
| 3 | 193678496 | 193680012 | 1516 | 1029 | FGF12 | N |
| 3 | 193785530 | 193787654 | 2124 | 1030 | FGF12 | N |
| 3 | 193794412 | 193797190 | 2778 | 947;959 | FGF12 | N |
| 3 | 198036999 | 198041361 | 4362 | 948;950;951;1020;1034 | PAK2 | Y |
| 3 | 198042682 | 198125625 | 82943 | 948;950;951;1020;1034 | SENP5,PAK2 | Y |
| 3 | 198119175 | 198124199 | 5024 | 2322 | SENP5 | N |
| 3 | 198119175 | 198124199 | 5024 | 2345 | SENP5 | N |
| 3 | 198119175 | 198124199 | 5024 | 2366 | SENP5 | N |
| 3 | 198119175 | 198124199 | 5024 | 2427 | SENP5 | N |
| 3 | 198177030 | 198187875 | 10845 | 967;975 | PIGZ | Y |
| 3 | 199030475 | 199032254 | 1779 | 967 | LRCH3 | Y |
| 3 | 199033913 | 199038162 | 4249 | 948;967;1007;1011;1031 | LRCH3 | Y |
| 3 | 199081462 | 199187361 | 105899 | 948;952;967;970;974;1007;1011;1031;1034 | LMLN,IQCG,RPL35A,LRCH3 | Y |
| 3 | 199187362 | 199188547 | 1185 | 948;952;967;970;974;1007;1011;1031 | LMLN | Y |
| 4 | 2483395 | 2529866 | 46471 | 969 | RNF4 | Y |
| 4 | 37191879 | 37278974 | 87095 | 1011 | C4orf19,RELL1 | Y |
| 4 | 47314693 | 47323346 | 8653 | 1033 | CORIN | Y |
| 4 | 47361851 | 47362999 | 1148 | 978 | CORIN | Y |
| 4 | 57739809 | 57742530 | 2721 | 976;986;1029 | LOC255130 | N |
| 4 | 57742531 | 57745126 | 2595 | 951;976;986;1019;1029 | LOC255130 | N |
| 4 | 73518013 | 73522044 | 4031 | 971 | ADAMTS3 | N |
| 4 | 73557728 | 73567966 | 10238 | 1002 | ADAMTS3 | N |
| 4 | 103310758 | 103960183 | 649425 | 965 | SLC39A8,NFKB1,UBE2D3,MANBA | Y |
| 4 | 103960184 | 103968003 | 7819 | 965;989 | UBE2D3 | Y |
| 4 | 104002633 | 104753531 | 750898 | 965 | CISD2,TACR3,CENPE,UBE2D3,SLC9B1,SLC9B2,BDH2 | Y |
| 5 | 33493254 | 33494402 | 1148 | 992;1013 | TARS | Y |
| 5 | 44280749 | 44389035 | 108286 | 966 | FGF10 | Y |

Figure 9C (Continued)

| Figure 9C | | | | | | |
|---|---|---|---|---|---|---|
| Chr | Start | Stop | Size (bp) | PD Case ID | Gene Names | Exon overlap |
| 5 | 77724204 | 77725392 | 1188 | 948;950;955;957;958;970;978;988;995;1000;1002;1028 | SCAMP1 | N |
| 5 | 90112791 | 90112816 | 25 | 969 | GPR98 | N |
| 5 | 90254811 | 90261232 | 6421 | 1015;1020 | GPR98 | N |
| 5 | 106844020 | 106849671 | 5651 | 1015 | EFNA5 | N |
| 5 | 106868586 | 106875551 | 6965 | 992 | EFNA5 | N |
| 5 | 126784243 | 126786973 | 2730 | 1013 | MEGF10 | Y |
| 5 | 126786974 | 126788155 | 1181 | 986;1012;1013 | MEGF10 | N |
| 5 | 127434789 | 127436376 | 1587 | 2315 | FLJ33630 | N |
| 5 | 127434789 | 127436376 | 1587 | 2350 | FLJ33630 | N |
| 5 | 127434789 | 127436376 | 1587 | 2563 | FLJ33630 | N |
| 5 | 127438119 | 127439603 | 1484 | 990;1029 | FLJ33630 | N |
| 5 | 127439604 | 127443917 | 4313 | 1029 | FLJ33630 | N |
| 5 | 134286886 | 134289928 | 3042 | 961;975;993;1030 | PCBD2 | N |
| 5 | 138783067 | 138788669 | 5602 | 1005 | DNAJC18 | Y |
| 5 | 140216525 | 140219465 | 2940 | 1004;1024;1034 | PCDHA2,PCDHA3,PCDHA1,PCDHA6,PCDHA7,PCDHA4,PCDHA5,PCDHA8,PCDHA9,PCDHA10 | Y |
| 5 | 145597802 | 145602068 | 4266 | 980 | RBM27 | N |
| 5 | 145627474 | 145628667 | 1193 | 950;1004 | RBM27 | Y |
| 5 | 145628668 | 145645004 | 16336 | 950 | RBM27 | Y |
| 5 | 150082708 | 150087911 | 5203 | 964 | DCTN4 | Y |
| 5 | 150084557 | 150086690 | 2133 | 971 | DCTN4 | N |
| 5 | 150084557 | 150086690 | 2133 | 964;971 | DCTN4 | N |
| 5 | 171229766 | 171231310 | 1544 | 967 | FBXW11 | Y |
| 5 | 171335918 | 171339127 | 3209 | 971 | FBXW11 | N |
| 5 | 172485049 | 172499213 | 14164 | 958 | CREBRF | Y |
| 5 | 179430821 | 179431937 | 1116 | 947;953;955;957;958;959;960;971;977;982;997;1001;1003;1006;1031;1033 | RNF130 | Y |
| 6 | 18532373 | 18534548 | 2175 | 2372 | RNF144B | N |
| 6 | 18532373 | 18534548 | 2175 | 2620 | RNF144B | N |
| 6 | 18532373 | 18534548 | 2175 | 2629 | RNF144B | N |

Figure 9C (Continued)

| Figure 9C | | | | | | |
|---|---|---|---|---|---|---|
| Chr | Start | Stop | Size (bp) | PD Case ID | Gene Names | Exon overlap |
| 6 | 18574467 | 18576632 | 2165 | 1024 | RNF144B | Y |
| 6 | 38910371 | 38921613 | 11242 | 957 | DNAH8 | Y |
| 6 | 43253688 | 43256242 | 2554 | 1001 | SRF | Y |
| 6 | 72916886 | 72917266 | 380 | 1029 | RIMS1 | N |
| 6 | 72931543 | 72931789 | 246 | 996 | RIMS1 | N |
| 6 | 87558407 | 87787539 | 229132 | 980 | HTR1E | Y |
| 6 | 125405845 | 125410165 | 4320 | 1001 | RNF217 | Y |
| 6 | 133004187 | 133008146 | 3959 | 1017 | TAAR1 | Y |
| 6 | 134624093 | 134631700 | 7607 | 953;957;963;981;984;1003;1005 | SGK1 | Y |
| 6 | 135696211 | 135794161 | 97950 | 1024 | AHI1,MIR548H4 | Y |
| 6 | 135797170 | 135954136 | 156966 | 1024 | LINC00271,AHI1,MIR548H4 | Y |
| 6 | 144006076 | 144011154 | 5078 | 989;990 | PHACTR2 | N |
| 6 | 149859127 | 149870155 | 11028 | 1010 | PPIL4 | Y |
| 6 | 151310683 | 151312867 | 2184 | 992 | MTHFD1L | Y |
| 6 | 151314466 | 151317012 | 2546 | 2342 | MTHFD1L | N |
| 6 | 151314466 | 151317012 | 2546 | 2583 | MTHFD1L | N |
| 6 | 151314466 | 151317012 | 2546 | 2631 | MTHFD1L | N |
| 6 | 151314466 | 151318805 | 4339 | 992;1013 | MTHFD1L | Y |
| 6 | 160246670 | 160248266 | 1596 | 986;1031 | MAS1 | Y |
| 7 | 14179928 | 14185615 | 5687 | 989 | DGKB | Y |
| 7 | 14727426 | 14731583 | 4157 | 977 | DGKB | N |
| 7 | 18161134 | 18275401 | 114267 | 971 | HDAC9 | Y |
| 7 | 23802428 | 23809218 | 6790 | 993;1004;1009;1013;1022;1036 | STK31 | N |
| 7 | 23809219 | 23809398 | 179 | 993;1004;1013;1022 | STK31 | N |
| 7 | 23809399 | 23811096 | 1697 | 1013 | STK31 | N |
| 7 | 43804939 | 43807655 | 2716 | 1016 | BLVRA | Y |
| 7 | 43809288 | 43810836 | 1548 | 1004 | BLVRA | Y |
| 7 | 55855108 | 55873303 | 18195 | 957 | 14-Sep | Y |
| 7 | 55878374 | 55890585 | 12211 | 1003 | 14-Sep | Y |
| 7 | 70311792 | 70316530 | 4738 | 1019 | WBSCR17 | N |
| 7 | 70661573 | 70662760 | 1187 | 978 | WBSCR17 | N |
| 7 | 81791206 | 81792311 | 1105 | 1019 | CACNA2D1 | N |
| 7 | 81792312 | 81794051 | 1739 | 952;989;1002;1009;1016;1019; | CACNA2D1 | N |

Figure 9C (Continued)

| Figure 9C | | | | | | |
|---|---|---|---|---|---|---|
| Chr | Start | Stop | Size (bp) | PD Case ID | Gene Names | Exon overlap |
| | | | | 1022;1026;1036;1037 | | |
| 7 | 97767682 | 97771031 | 3349 | 986 | BAIAP2L1 | N |
| 7 | 97805256 | 97807057 | 1801 | 983;989 | BAIAP2L1 | N |
| 7 | 100622624 | 100660738 | 38114 | 964 | PLOD3,ZNHIT1,MOGAT3 | Y |
| 7 | 101300618 | 101307173 | 6555 | 1024;1026 | CUX1 | N |
| 7 | 133903992 | 133913921 | 9929 | 983 | AKR1B15 | Y |
| 7 | 133906667 | 133910372 | 3705 | 1032 | AKR1B15 | Y |
| 7 | 133906667 | 133910372 | 3705 | 983;1032 | AKR1B15 | Y |
| 7 | 141440185 | 141442231 | 2046 | 999;1030 | MGAM | Y |
| 7 | 146842506 | 146844392 | 1886 | 2306 | CNTNAP2 | N |
| 7 | 146842506 | 146844392 | 1886 | 2408 | CNTNAP2 | N |
| 7 | 146842506 | 146844392 | 1886 | 2608 | CNTNAP2 | N |
| 7 | 147441927 | 147443119 | 1192 | 2266 | MIR548T,CNTNAP2 | N |
| 7 | 147441927 | 147443119 | 1192 | 2269 | MIR548T,CNTNAP2 | N |
| 7 | 147441927 | 147443119 | 1192 | 2320 | MIR548T,CNTNAP2 | N |
| 7 | 147441927 | 147443119 | 1192 | 2436 | MIR548T,CNTNAP2 | N |
| 7 | 147441927 | 147443119 | 1192 | 2443 | MIR548T,CNTNAP2 | N |
| 7 | 147441927 | 147443119 | 1192 | 2565 | MIR548T,CNTNAP2 | N |
| 7 | 147441927 | 147443119 | 1192 | 2593 | MIR548T,CNTNAP2 | N |
| 7 | 147708383 | 147710037 | 1654 | 994;1017;1018 | CNTNAP2 | N |
| 7 | 151728812 | 151730249 | 1437 | 950;958;967;995;1002;1019 | MLL3 | N |
| 7 | 153645525 | 153647352 | 1827 | 2050 | DPP6 | N |
| 7 | 153645525 | 153647352 | 1827 | 2461 | DPP6 | N |
| 7 | 153645525 | 153647352 | 1827 | 2521 | DPP6 | N |
| 7 | 153901057 | 154002117 | 101060 | 957 | DPP6 | N |
| 7 | 154028650 | 154032130 | 3480 | 969;993;1031 | DPP6 | N |
| 7 | 156485711 | 156490484 | 4773 | 1014;1016 | MNX1 | Y |
| 7 | 156490485 | 156495904 | 5419 | 1014 | MNX1 | Y |
| 8 | 1491491 | 1496879 | 5388 | 998 | DLGAP2 | N |
| 8 | 1496880 | 1499520 | 2640 | 998;1012 | DLGAP2 | N |
| 8 | 1499521 | 1500993 | 1472 | 998 | DLGAP2 | N |
| 8 | 17860007 | 17880477 | 20470 | 976 | PCM1 | Y |
| 8 | 18894239 | 18896031 | 1792 | 949;985;1016 | PSD3 | N |
| 8 | 31639124 | 31642682 | 3558 | 1029 | NRG1 | N |

Figure 9C (Continued)

| Figure 9C | | | | | | |
|---|---|---|---|---|---|---|
| Chr | Start | Stop | Size (bp) | PD Case ID | Gene Names | Exon overlap |
| 8 | 31811829 | 31814233 | 2404 | 1034 | NRG1 | N |
| 8 | 31814234 | 31815721 | 1487 | 1017;1034 | NRG1 | N |
| 8 | 32551972 | 32553445 | 1473 | 1029 | NRG1 | N |
| 8 | 37754788 | 37755937 | 1149 | 946;1007 | PROSC | Y |
| 8 | 41199070 | 41267922 | 68852 | 996 | SFRP1 | Y |
| 8 | 42308627 | 42312018 | 3391 | 989 | IKBKB | Y |
| 8 | 56318028 | 56321660 | 3632 | 992 | XKR4 | N |
| 8 | 56363588 | 56368489 | 4901 | 1028 | XKR4 | N |
| 8 | 63429132 | 63440428 | 11296 | 1003 | NKAIN3 | N |
| 8 | 63686220 | 63692725 | 6505 | 992;999 | NKAIN3 | N |
| 8 | 74526051 | 74527806 | 1755 | 1032 | STAU2 | N |
| 8 | 74753948 | 74761544 | 7596 | 992 | STAU2 | N |
| 8 | 74761545 | 74778653 | 17108 | 1012 | STAU2 | Y |
| 8 | 85403103 | 85404716 | 1613 | 954 | RALYL | N |
| 8 | 85418745 | 85420036 | 1291 | 1037 | RALYL | N |
| 8 | 85420037 | 85422156 | 2119 | 1024;1037 | RALYL | Y |
| 8 | 85422157 | 85423937 | 1780 | 957;992;997;1000;1003;1024;1028;1030;1037 | RALYL | N |
| 8 | 85839690 | 85842807 | 3117 | 949 | RALYL | N |
| 8 | 88382155 | 88388307 | 6152 | 964;971;975;990 | CNBD1 | N |
| 8 | 94041443 | 94043276 | 1833 | 1025 | TRIQK | N |
| 8 | 94043277 | 94045697 | 2420 | 1018;1025 | TRIQK | N |
| 8 | 94045698 | 94059962 | 14264 | 1025 | TRIQK | Y |
| 8 | 99038720 | 99039951 | 1231 | 1004 | MATN2 | N |
| 8 | 99039952 | 99041695 | 1743 | 968;975;993;1004 | MATN2 | N |
| 8 | 142422281 | 142510717 | 88436 | 1036 | LOC731779,GPR20,PTP4A3 | Y |
| 8 | 144845724 | 144863110 | 17386 | 1008;1024 | BREA2,ZNF707,CCDC166 | Y |
| 8 | 144970607 | 144970777 | 170 | 946;949;961;968;974;975;1034 | PUF60 | Y |
| 9 | 8344218 | 8345409 | 1191 | 993 | PTPRD | N |
| 9 | 9055746 | 9057345 | 1599 | 1016 | PTPRD | N |
| 9 | 9675661 | 9679084 | 3423 | 1036 | PTPRD | N |
| 9 | 10164640 | 10167989 | 3349 | 950 | PTPRD | N |
| 9 | 10395198 | 10398529 | 3331 | 1012 | PTPRD | N |

Figure 9C (Continued)

| Figure 9C | | | | | | |
|---|---|---|---|---|---|---|
| Chr | Start | Stop | Size (bp) | PD Case ID | Gene Names | Exon overlap |
| 9 | 27323197 | 27324577 | 1380 | 975 | MOB3B | N |
| 9 | 27365836 | 27367745 | 1909 | 989 | MOB3B | N |
| 9 | 39062211 | 39091348 | 29137 | 966;967;975;980;982;992;994 | CNTNAP3 | Y |
| 9 | 39091349 | 39130210 | 38861 | 966;967;970;975;980;982;992;994 | CNTNAP3 | Y |
| 9 | 98831789 | 98831814 | 25 | 999;1018 | CTSL2 | Y |
| 9 | 140136862 | 140145631 | 8769 | 981 | CACNA1B | Y |
| 10 | 5965889 | 5979771 | 13882 | 992 | ANKRD16,FBXO18 | Y |
| 10 | 5979772 | 5984216 | 4444 | 992;1030 | FBXO18 | N |
| 10 | 5984217 | 5985729 | 1512 | 1030;1037 | FBXO18 | Y |
| 10 | 5984217 | 5995714 | 11497 | 992;1030;1037 | FBXO18 | Y |
| 10 | 5985730 | 5988631 | 2901 | 1000;1030;1037 | FBXO18 | Y |
| 10 | 5988632 | 5995714 | 7082 | 1030;1037 | FBXO18 | Y |
| 10 | 60139394 | 60189880 | 50486 | 992 | FAM133CP,BICC1 | Y |
| 10 | 60191123 | 60201113 | 9990 | 992 | BICC1 | N |
| 10 | 76129083 | 76135755 | 6672 | 955;959;964;988;1007 | ADK | N |
| 10 | 78775816 | 79199560 | 423744 | 946 | KCNMA1 | Y |
| 10 | 79201984 | 79543704 | 341720 | 946 | LOC100128292,RPS24,DLG5,POLR3A | Y |
| 10 | 84165642 | 84171045 | 5403 | 988 | NRG3 | N |
| 10 | 84188750 | 84190301 | 1551 | 977 | NRG3 | N |
| 10 | 88905200 | 89245881 | 340681 | 969;999 | LOC439994,FAM22D,FAM22A,LOC728190,LOC728218,FAM35A | Y |
| 10 | 95534054 | 95536083 | 2029 | 952;961;968 | LGI1 | N |
| 10 | 117226301 | 117232646 | 6345 | 1004;1010 | ATRNL1 | N |
| 10 | 117338366 | 117339297 | 931 | 2294 | ATRNL1 | N |
| 10 | 117338366 | 117339297 | 931 | 2332 | ATRNL1 | N |
| 10 | 117338366 | 117339297 | 931 | 2337 | ATRNL1 | N |
| 10 | 117338366 | 117339297 | 931 | 2404 | ATRNL1 | N |
| 10 | 117338366 | 117339297 | 931 | 2405 | ATRNL1 | N |
| 10 | 117338366 | 117339297 | 931 | 2447 | ATRNL1 | N |
| 10 | 117338366 | 117339297 | 931 | 2481 | ATRNL1 | N |
| 10 | 117338366 | 117339297 | 931 | 2610 | ATRNL1 | N |
| 10 | 117338366 | 117339297 | 931 | 2614 | ATRNL1 | N |

Figure 9C (Continued)

| Figure 9C | | | | | | |
|---|---|---|---|---|---|---|
| Chr | Start | Stop | Size (bp) | PD Case ID | Gene Names | Exon overlap |
| 10 | 117338366 | 117339297 | 931 | 2628 | ATRNL1 | N |
| 10 | 122623381 | 122626509 | 3128 | 966 | WDR11,MIR5694 | Y |
| 10 | 122633344 | 122640560 | 7216 | 950 | WDR11,MIR5694 | Y |
| 11 | 13984290 | 13989127 | 4837 | 995;996 | SPON1 | N |
| 11 | 47040725 | 47045421 | 4696 | 1035 | C11orf49 | N |
| 11 | 47098212 | 47098992 | 780 | 1017 | C11orf49 | N |
| 11 | 84499641 | 84610167 | 110526 | 1026 | DLG2 | Y |
| 11 | 84972646 | 84980750 | 8104 | 1003 | DLG2 | N |
| 11 | 88258151 | 88268464 | 10313 | 949 | GRM5 | N |
| 11 | 88303735 | 88305485 | 1750 | 1003 | GRM5 | N |
| 12 | 5411179 | 5414622 | 3443 | 1019;1026 | NTF3 | Y |
| 12 | 5414623 | 5417862 | 3239 | 1019 | NTF3 | N |
| 12 | 6315047 | 6317276 | 2229 | 1003;1005 | TNFRSF1A | N |
| 12 | 10493985 | 10534393 | 40408 | 947;979 | KLRC1 | Y |
| 12 | 15557675 | 15559369 | 1694 | 990;991;1011 | PTPRO | N |
| 12 | 15559370 | 15560873 | 1503 | 990;1011 | PTPRO | Y |
| 12 | 31098259 | 31132715 | 34456 | 966;977;992;1011;1031 | DDX11-AS1,DDX11 | Y |
| 12 | 31132716 | 31132761 | 45 | 966;975;977;990;992;1004;1011;1031 | DDX11 | N |
| 12 | 38904346 | 38909561 | 5215 | 972 | LRRK2 | Y |
| 12 | 42159304 | 42167699 | 8395 | 946;951 | ADAMTS20 | N |
| 12 | 42909733 | 42912201 | 2468 | 979 | TMEM117 | N |
| 12 | 42912202 | 42913523 | 1321 | 1014 | TMEM117 | N |
| 12 | 55879318 | 55880397 | 1079 | 1030 | LRP1 | Y |
| 12 | 55880398 | 55902123 | 21725 | 997;1030 | LRP1,NXPH4 | Y |
| 12 | 55903149 | 55922237 | 19088 | 961;967;984 | NDUFA4L2,SHMT2,NXPH4 | Y |
| 12 | 63107981 | 63136048 | 28067 | 1027 | XPOT,TBK1 | Y |
| 12 | 63346598 | 63347718 | 1120 | 978;987 | RASSF3 | N |
| 12 | 63347719 | 63349229 | 1510 | 987 | RASSF3 | N |
| 12 | 77815879 | 77835641 | 19762 | 1002;1015 | SYT1 | N |
| 12 | 85113258 | 85119077 | 5819 | 2261 | MGAT4C | N |
| 12 | 85113258 | 85119077 | 5819 | 2338 | MGAT4C | N |
| 12 | 85113258 | 85119077 | 5819 | 2425 | MGAT4C | N |
| 12 | 85411806 | 85413202 | 1396 | 1027 | MGAT4C | N |
| 12 | 85681656 | 85687967 | 6311 | 948;971;989 | MGAT4C | N |

Figure 9C (Continued)

| Figure 9C | | | | | | |
|---|---|---|---|---|---|---|
| Chr | Start | Stop | Size (bp) | PD Case ID | Gene Names | Exon overlap |
| 12 | 85719690 | 85724956 | 5266 | 979 | MGAT4C | N |
| 12 | 105966884 | 105967651 | 767 | 950;964 | CRY1 | N |
| 12 | 122838898 | 122840411 | 1513 | 975 | DNAH10 | Y |
| 12 | 130944468 | 130946248 | 1780 | 995;998;1005;1009;1031;1033;1035 | ULK1 | Y |
| 13 | 24166764 | 24216914 | 50150 | 1002 | ATP12A | Y |
| 13 | 51954511 | 51973943 | 19432 | 1009;1014 | TPTE2P3 | Y |
| 13 | 102137609 | 102139657 | 2048 | 997 | METTL21C | N |
| 13 | 102139658 | 102142982 | 3324 | 997;1004 | METTL21C | Y |
| 13 | 112811735 | 112813401 | 1666 | 965;971;972;973;978;992 | F7 | Y |
| 13 | 113600542 | 113602677 | 2135 | 1020;1023 | FAM70B | N |
| 13 | 113791151 | 113792974 | 1823 | 951;972;973;979;980;989;991 | RASA3 | Y |
| 13 | 113792975 | 113794669 | 1694 | 979;989;991 | RASA3 | Y |
| 14 | 60544757 | 60551980 | 7223 | 991;1034 | SLC38A6 | N |
| 14 | 60551981 | 60553070 | 1089 | 951;954;991;1014;1019;1034 | SLC38A6 | Y |
| 14 | 71779767 | 71780825 | 1058 | 998;1016;1019 | RGS6 | N |
| 14 | 72600732 | 72603806 | 3074 | 1007;1025 | RBM25 | N |
| 14 | 78086003 | 78087442 | 1439 | 971 | NRXN3 | N |
| 14 | 78227579 | 78229427 | 1848 | 1002 | NRXN3 | N |
| 14 | 79127635 | 79128659 | 1024 | 971;986 | NRXN3 | N |
| 14 | 79128660 | 79134722 | 6062 | 971 | NRXN3 | N |
| 14 | 79174722 | 79176036 | 1314 | 1035 | NRXN3 | N |
| 14 | 102401445 | 102406605 | 5160 | 997 | TRAF3 | Y |
| 14 | 102406606 | 102409996 | 3390 | 969;997 | TRAF3 | Y |
| 14 | 102409997 | 102414214 | 4217 | 997 | TRAF3 | Y |
| 14 | 104688404 | 104688435 | 31 | 970;980;995;999;1013;1035 | JAG2 | Y |
| 15 | 59220825 | 59221540 | 715 | 996;998 | RORA | N |
| 15 | 59220825 | 59234113 | 13288 | 996 | RORA | N |
| 15 | 59221541 | 59234113 | 12572 | 996 | RORA | N |
| 15 | 72197969 | 72283889 | 85920 | 1012 | STRA6,ISLR,ISLR2,LOC283731 | Y |
| 15 | 87999026 | 88000020 | 994 | 954;994 | KIF7 | Y |
| 15 | 99236636 | 99239178 | 2542 | 1014;1029 | ALDH1A3 | Y |
| 15 | 99634434 | 99635701 | 1267 | 960;969;971;98 | VIMP | Y |

Figure 9C (Continued)

| Figure 9C | | | | | | |
|---|---|---|---|---|---|---|
| Chr | Start | Stop | Size (bp) | PD Case ID | Gene Names | Exon overlap |
| | | | | 4;992;993;994;997;998;1000;1003;1004;1017;1025;1028;1029;1035 | | |
| 16 | 6627719 | 6632582 | 4863 | 1014 | RBFOX1 | N |
| 16 | 6810852 | 6833768 | 22916 | 982 | RBFOX1 | N |
| 16 | 6836617 | 6884976 | 48359 | 982 | RBFOX1 | N |
| 16 | 6886815 | 6896330 | 9515 | 982 | RBFOX1 | N |
| 16 | 9962571 | 9965023 | 2452 | 1032 | GRIN2A | N |
| 16 | 9965024 | 9968344 | 3320 | 1001;1032 | GRIN2A | N |
| 16 | 9979934 | 9981275 | 1341 | 1032 | GRIN2A | N |
| 16 | 31186841 | 31256185 | 69344 | 1020 | ITGAM | Y |
| 16 | 70561211 | 70562690 | 1479 | 948;1033 | PKD1L3 | Y |
| 16 | 71619180 | 71648770 | 29590 | 1011 | ZFHX3 | Y |
| 16 | 81590448 | 81592665 | 2217 | 994 | CDH13 | N |
| 16 | 81590448 | 81599011 | 8563 | 994 | CDH13 | N |
| 16 | 81592666 | 81599011 | 6345 | 993;994 | CDH13 | N |
| 16 | 81752862 | 81755529 | 2667 | 1025;1030 | CDH13 | N |
| 16 | 84330410 | 84332684 | 2274 | 1034 | C16orf74,MIR1910 | Y |
| 16 | 84332684 | 84335524 | 2840 | 999 | C16orf74,MIR1910 | Y |
| 17 | 6399283 | 6401166 | 1883 | 978;992;1013;1017 | PITPNM3 | Y |
| 17 | 9267206 | 9269293 | 2087 | 1027 | STX8 | N |
| 17 | 9269293 | 9272211 | 2918 | 982 | STX8 | N |
| 17 | 16480516 | 16483386 | 2870 | 975;991;1004 | ZNF624 | N |
| 17 | 16483387 | 16489447 | 6060 | 975 | ZNF624 | N |
| 17 | 41501967 | 41518221 | 16254 | 1024 | KANSL1 | Y |
| 17 | 41501967 | 41519701 | 17734 | 1024 | KANSL1 | Y |
| 17 | 41519702 | 41521543 | 1841 | 1024;1028 | KANSL1 | N |
| 17 | 62868652 | 62869965 | 1313 | 1009 | PITPNC1 | N |
| 17 | 62874349 | 62877923 | 3574 | 1007 | PITPNC1 | N |
| 18 | 169042 | 184227 | 15185 | 957 | USP14 | Y |
| 18 | 16833161 | 16851074 | 17913 | 965 | ROCK1 | Y |
| 18 | 31204187 | 31206272 | 2085 | 947;953;958;959;973 | ZNF396 | N |
| 18 | 42831086 | 42836022 | 4936 | 947;953;971;988;1006 | KATNAL2 | Y |
| 18 | 48127523 | 48131320 | 3797 | 999 | DCC | N |

Figure 9C (Continued)

| Figure 9C | | | | | | |
|---|---|---|---|---|---|---|
| Chr | Start | Stop | Size (bp) | PD Case ID | Gene Names | Exon overlap |
| 18 | 48539033 | 48541815 | 2782 | 1013 | DCC | N |
| 18 | 48616189 | 48620934 | 4745 | 2054 | DCC | N |
| 18 | 48616189 | 48620934 | 4745 | 2265 | DCC | N |
| 18 | 48616189 | 48620934 | 4745 | 2412 | DCC | N |
| 18 | 48616189 | 48620934 | 4745 | 2428 | DCC | N |
| 18 | 48616189 | 48620934 | 4745 | 2615 | DCC | N |
| 18 | 65911512 | 65915539 | 4027 | 955;964;1017 | RTTN | N |
| 18 | 65915540 | 65916735 | 1195 | 955;964 | RTTN | N |
| 18 | 65916736 | 65923901 | 7165 | 955;964;1028 | RTTN | N |
| 18 | 65923902 | 65938721 | 14819 | 1028 | RTTN | Y |
| 19 | 794979 | 798817 | 3838 | 961;998 | PRTN3 | Y |
| 19 | 798818 | 801351 | 2533 | 998 | PRTN3 | Y |
| 19 | 3355220 | 3356334 | 1114 | 949;951;954;970;978;995;1005;1022;1034 | NFIC | N |
| 19 | 9134840 | 9138935 | 4095 | 994;1008;1024 | ZNF317 | Y |
| 19 | 15640597 | 15664289 | 23692 | 1001 | CYP4F12 | Y |
| 19 | 15664290 | 15667581 | 3291 | 950;1001 | CYP4F12 | N |
| 19 | 15667582 | 15677382 | 9800 | 1001 | CYP4F12 | Y |
| 19 | 42386895 | 42388238 | 1343 | 986;1012;1017;1026 | ZNF585B | N |
| 19 | 42537228 | 42537766 | 538 | 990;991;1014;1022 | HKR1 | N |
| 19 | 42537767 | 42544684 | 6917 | 1014 | HKR1 | N |
| 19 | 54252049 | 54268744 | 16695 | 992 | KCNA7,NTF4 | Y |
| 19 | 54388780 | 54397344 | 8564 | 993 | TRPM4 | Y |
| 19 | 60132603 | 60136910 | 4307 | 1025 | NLRP7 | Y |
| 19 | 61081628 | 61083208 | 1580 | 962;963;964;1003;1013;1037 | NLRP4 | Y |
| 20 | 2873876 | 2877782 | 3906 | 962 | PTPRA | Y |
| 20 | 19979618 | 19981548 | 1930 | 2190 | C20orf26,CRNKL1 | Y |
| 20 | 19979618 | 19981548 | 1930 | 2474 | C20orf26,CRNKL1 | Y |
| 20 | 19979618 | 19981548 | 1930 | 2489 | C20orf26,CRNKL1 | Y |
| 20 | 19979618 | 19981548 | 1930 | 2597 | C20orf26,CRNKL1 | Y |
| 20 | 19981549 | 19982732 | 1183 | 2190 | C20orf26,CRNKL1 | N |
| 20 | 19981549 | 19982732 | 1183 | 2474 | C20orf26,CRNKL1 | N |
| 20 | 19981549 | 19982732 | 1183 | 2489 | C20orf26,CRNKL1 | N |
| 20 | 20043913 | 20061717 | 17804 | 947;960;964 | C20orf26 | N |

Figure 9C (Continued)

| Figure 9C | | | | | | |
|---|---|---|---|---|---|---|
| Chr | Start | Stop | Size (bp) | PD Case ID | Gene Names | Exon overlap |
| 20 | 20061718 | 20061778 | 60 | 947;960 | C20orf26 | N |
| 20 | 51045995 | 51053052 | 7057 | 952 | TSHZ2 | N |
| 20 | 51053053 | 51054248 | 1195 | 952;961;975;980 | TSHZ2 | N |
| 20 | 51054249 | 51058635 | 4386 | 952;980 | TSHZ2 | N |
| 21 | 38473714 | 38675904 | 202190 | 1015 | ERG,DSCR10,KCNJ15 | Y |
| 22 | 20904937 | 21037378 | 132441 | 947;963 | LOC96610,VPREB1 | Y |
| 22 | 22725306 | 22735036 | 9730 | 955;959;960;964 | GSTTP2 | Y |
| 22 | 42895171 | 42896487 | 1316 | 992;993;1013 | PARVB | Y |
| 22 | 45468407 | 45474188 | 5781 | 966 | CERK | Y |
| X | 29367686 | 29369448 | 1762 | 958;1023 | IL1RAPL1 | N |
| X | 29595687 | 29597689 | 2002 | 1035 | IL1RAPL1 | Y |
| X | 39852030 | 39853092 | 1062 | 970;1016;1031 | BCOR | N |
| X | 104510036 | 104512681 | 2645 | 979;1003;1023 | IL1RAPL2 | N |
| X | 150893705 | 150894325 | 620 | 981;1016 | GABRE | Y |
| X | 152978747 | 152981151 | 2404 | 979;999;1022;1023 | MECP2 | N |

Figure 9C (Continued)

| Figure 9D | | | | | | | | | | | | | |
|---|---|---|---|---|---|---|---|---|---|---|---|---|---|
| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_-cases | PD_-cases | FET | OR | Category | PV |
| 319 | 1 | 8283325 | 8285554 | 2229 | loss | 2427 | | N | 0 | 4 | 0.01007351 | 19.48 | stats_biology | |
| 320 | 1 | 8283325 | 8285554 | 2229 | loss | 2465 | | N | 0 | 4 | 0.01007351 | 19.48 | stats_biology | |
| 321 | 1 | 8283325 | 8285554 | 2229 | loss | 2541 | | N | 0 | 4 | 0.01007351 | 19.48 | stats_biology | |
| 322 | 1 | 8283325 | 8285554 | 2229 | loss | 2616 | | N | 0 | 4 | 0.01007351 | 19.48 | stats_biology | |
| 323 | 1 | 41120407 | 41153389 | 32982 | gain | 71 | | N | 15 | 0 | 0.00462131 | 0.07 | stats_biology | YES |
| 324 | 1 | 41120407 | 41153389 | 32982 | gain | 98 | | N | 15 | 0 | 0.00462131 | 0.07 | stats_biology | YES |
| 325 | 1 | 41120407 | 41153389 | 32982 | gain | 172 | | N | 15 | 0 | 0.00462131 | 0.07 | stats_biology | YES |
| 326 | 1 | 41120407 | 41153389 | 32982 | gain | 218 | | N | 15 | 0 | 0.00462131 | 0.07 | stats_biology | YES |
| 327 | 1 | 41120407 | 41153389 | 32982 | gain | 384 | | N | 15 | 0 | 0.00462131 | 0.07 | stats_biology | YES |
| 328 | 1 | 41120407 | 41153389 | 32982 | gain | 429 | | N | 15 | 0 | 0.00462131 | 0.07 | stats_biology | YES |
| 329 | 1 | 41120407 | 41153389 | 32982 | gain | 467 | | N | 15 | 0 | 0.00462131 | 0.07 | stats_biology | YES |
| 330 | 1 | 41120407 | 41153389 | 32982 | gain | 507 | | N | 15 | 0 | 0.00462131 | 0.07 | stats_biology | YES |
| 331 | 1 | 41120407 | 41153389 | 32982 | gain | 535 | | N | 15 | 0 | 0.00462131 | 0.07 | stats_biology | YES |
| 332 | 1 | 41120407 | 41153389 | 32982 | gain | 592 | | N | 15 | 0 | 0.00462131 | 0.07 | stats_biology | YES |
| 333 | 1 | 41120407 | 41153389 | 32982 | gain | 669 | | N | 15 | 0 | 0.00462131 | 0.07 | stats_biology | YES |
| 334 | 1 | 41120407 | 41153389 | 32982 | gain | 674 | | N | 15 | 0 | 0.00462131 | 0.07 | stats_biology | YES |
| 335 | 1 | 41120407 | 41153389 | 32982 | gain | 783 | | N | 15 | 0 | 0.00462131 | 0.07 | stats_biology | YES |
| 336 | 1 | 41120407 | 41153389 | 32982 | gain | 919 | | N | 15 | 0 | 0.00462131 | 0.07 | stats_biology | YES |
| 337 | 1 | 41120407 | 41153389 | 32982 | gain | 1194 | | N | 15 | 0 | 0.00462131 | 0.07 | stats_biology | YES |
| 338 | 1 | 113270233 | 113323600 | 53367 | gain | 2616 | SLC16A1 | Y | 0 | 1 | 0.10124937 | 6.45 | biology | |
| 339 | 1 | 151459627 | 151463425 | 3798 | loss | 7 | | N | 7 | 0 | 0.06166361 | 0.14 | biology | YES |
| 340 | 1 | 151459627 | 151463425 | 3798 | loss | 73 | | N | 7 | 0 | 0.06166361 | 0.14 | biology | YES |
| 341 | 1 | 151459627 | 151463425 | 3798 | loss | 136 | | N | 7 | 0 | 0.06166361 | 0.14 | biology | YES |

Figure 9D (Continued)

| Figure 9D | | | | | | | | | | | | | |
|---|---|---|---|---|---|---|---|---|---|---|---|---|---|
| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_-cases | PD_-cases | FET | OR | Category | PV |
| 342 | 1 | 151459627 | 151463425 | 3798 | loss | 201 | | N | 7 | 0 | 0.06166361 | 0.14 | biology | YES |
| 343 | 1 | 151459627 | 151463425 | 3798 | loss | 393 | | N | 7 | 0 | 0.06166361 | 0.14 | biology | YES |
| 344 | 1 | 151459627 | 151463425 | 3798 | loss | 513 | | N | 7 | 0 | 0.06166361 | 0.14 | biology | YES |
| 345 | 1 | 151459627 | 151463425 | 3798 | loss | 731 | | N | 7 | 0 | 0.06166361 | 0.14 | biology | YES |
| 346 | 1 | 153955167 | 153992044 | 36877 | loss | 2206 | DAP3,GON4L,MSTO2P | Y | 0 | 1 | 0.10124937 | 6.45 | biology | |
| 347 | 2 | 18050278 | 18056693 | 6415 | gain | 2191 | | N | 0 | 4 | 0.01007351 | 19.48 | stats_biology | |
| 348 | 2 | 18050278 | 18056693 | 6415 | gain | 2260 | | N | 0 | 4 | 0.01007351 | 19.48 | stats_biology | |
| 349 | 2 | 18050278 | 18056693 | 6415 | gain | 2491 | | N | 0 | 4 | 0.01007351 | 19.48 | stats_biology | |
| 350 | 2 | 18050278 | 18056693 | 6415 | loss | 2593 | | N | 0 | 4 | 0.01007351 | 19.48 | stats_biology | |
| 351 | 2 | 24455322 | 24462631 | 7309 | loss | 2 | | N | 50 | 9 | 0.00419744 | 0.37 | stats_biology | YES |
| 352 | 2 | 24455322 | 24462631 | 7309 | loss | 29 | | N | 50 | 9 | 0.00419744 | 0.37 | stats_biology | YES |
| 353 | 2 | 24455322 | 24462631 | 7309 | loss | 83 | | N | 50 | 9 | 0.00419744 | 0.37 | stats_biology | YES |
| 354 | 2 | 24455322 | 24462631 | 7309 | loss | 95 | | N | 50 | 9 | 0.00419744 | 0.37 | stats_biology | YES |
| 355 | 2 | 24455322 | 24462631 | 7309 | loss | 98 | | N | 50 | 9 | 0.00419744 | 0.37 | stats_biology | YES |
| 356 | 2 | 24455322 | 24462631 | 7309 | loss | 140 | | N | 50 | 9 | 0.00419744 | 0.37 | stats_biology | YES |
| 357 | 2 | 24455322 | 24462631 | 7309 | loss | 219 | | N | 50 | 9 | 0.00419744 | 0.37 | stats_biology | YES |
| 358 | 2 | 24455322 | 24462631 | 7309 | loss | 291 | | N | 50 | 9 | 0.00419744 | 0.37 | stats_biology | YES |
| 359 | 2 | 24455322 | 24462631 | 7309 | loss | 355 | | N | 50 | 9 | 0.00419744 | 0.37 | stats_biology | YES |
| 360 | 2 | 24455322 | 24462631 | 7309 | loss | 425 | | N | 50 | 9 | 0.00419744 | 0.37 | stats_biology | YES |
| 361 | 2 | 24455322 | 24462631 | 7309 | loss | 535 | | N | 50 | 9 | 0.00419744 | 0.37 | stats_biology | YES |
| 362 | 2 | 24455322 | 24462631 | 7309 | loss | 537 | | N | 50 | 9 | 0.00419744 | 0.37 | stats_biology | YES |
| 363 | 2 | 24455322 | 24462631 | 7309 | loss | 538 | | N | 50 | 9 | 0.00419744 | 0.37 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 364 | 2 | 24455322 | 24462631 | 7309 | loss | 543 | | N | 50 | 9 | 0.00419744 | 0.37 | stats_biology | YES |
| 365 | 2 | 24455322 | 24462631 | 7309 | loss | 564 | | N | 50 | 9 | 0.00419744 | 0.37 | stats_biology | YES |
| 366 | 2 | 24455322 | 24462631 | 7309 | loss | 581 | | N | 50 | 9 | 0.00419744 | 0.37 | stats_biology | YES |
| 367 | 2 | 24455322 | 24462631 | 7309 | loss | 583 | | N | 50 | 9 | 0.00419744 | 0.37 | stats_biology | YES |
| 368 | 2 | 24455322 | 24462631 | 7309 | loss | 592 | | N | 50 | 9 | 0.00419744 | 0.37 | stats_biology | YES |
| 369 | 2 | 24455322 | 24462631 | 7309 | loss | 601 | | N | 50 | 9 | 0.00419744 | 0.37 | stats_biology | YES |
| 370 | 2 | 24455322 | 24462631 | 7309 | loss | 607 | | N | 50 | 9 | 0.00419744 | 0.37 | stats_biology | YES |
| 371 | 2 | 24455322 | 24462631 | 7309 | loss | 632 | | N | 50 | 9 | 0.00419744 | 0.37 | stats_biology | YES |
| 372 | 2 | 24455322 | 24462631 | 7309 | loss | 641 | | N | 50 | 9 | 0.00419744 | 0.37 | stats_biology | YES |
| 373 | 2 | 24455322 | 24462631 | 7309 | loss | 666 | | N | 50 | 9 | 0.00419744 | 0.37 | stats_biology | YES |
| 374 | 2 | 24455322 | 24462631 | 7309 | loss | 671 | | N | 50 | 9 | 0.00419744 | 0.37 | stats_biology | YES |
| 375 | 2 | 24455322 | 24462631 | 7309 | loss | 718 | | N | 50 | 9 | 0.00419744 | 0.37 | stats_biology | YES |
| 376 | 2 | 24455322 | 24462631 | 7309 | loss | 721 | | N | 50 | 9 | 0.00419744 | 0.37 | stats_biology | YES |
| 377 | 2 | 24455322 | 24462631 | 7309 | loss | 729 | | N | 50 | 9 | 0.00419744 | 0.37 | stats_biology | YES |
| 378 | 2 | 24455322 | 24462631 | 7309 | loss | 731 | | N | 50 | 9 | 0.00419744 | 0.37 | stats_biology | YES |
| 379 | 2 | 24455322 | 24462631 | 7309 | loss | 736 | | N | 50 | 9 | 0.00419744 | 0.37 | stats_biology | YES |
| 380 | 2 | 24455322 | 24462631 | 7309 | loss | 774 | | N | 50 | 9 | 0.00419744 | 0.37 | stats_biology | YES |
| 381 | 2 | 24455322 | 24462631 | 7309 | loss | 815 | | N | 50 | 9 | 0.00419744 | 0.37 | stats_biology | YES |
| 382 | 2 | 24455322 | 24462631 | 7309 | loss | 828 | | N | 50 | 9 | 0.00419744 | 0.37 | stats_biology | YES |
| 383 | 2 | 24455322 | 24462631 | 7309 | loss | 832 | | N | 50 | 9 | 0.00419744 | 0.37 | stats_biology | YES |
| 384 | 2 | 24455322 | 24462631 | 7309 | loss | 840 | | N | 50 | 9 | 0.00419744 | 0.37 | stats_biology | YES |
| 385 | 2 | 24455322 | 24462631 | 7309 | loss | 860 | | N | 50 | 9 | 0.00419744 | 0.37 | stats_biology | YES |
| 386 | 2 | 24455322 | 24462631 | 7309 | loss | 861 | | N | 50 | 9 | 0.00419744 | 0.37 | stats_biology | YES |
| 387 | 2 | 24455322 | 24462631 | 7309 | loss | 872 | | N | 50 | 9 | 0.00419744 | 0.37 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | FET | OR | Category | PV |
|---|---|---|---|---|---|---|---|---|---|---|---|---|---|---|
| 388 | 2 | 24455322 | 24462631 | 7305 | loss | 874 | | N | 50 | 9 | 0.00419744 | 0.37 | stats_biology | YES |
| 389 | 2 | 24455322 | 24462631 | 7309 | loss | 878 | | N | 50 | 9 | 0.00419744 | 0.37 | stats_biology | YES |
| 390 | 2 | 24455322 | 24462631 | 7309 | loss | 886 | | N | 50 | 9 | 0.00419744 | 0.37 | stats_biology | YES |
| 391 | 2 | 24455322 | 24462631 | 7309 | loss | 891 | | N | 50 | 9 | 0.00419744 | 0.37 | stats_biology | YES |
| 392 | 2 | 24455322 | 24462631 | 7309 | loss | 895 | | N | 50 | 9 | 0.00419744 | 0.37 | stats_biology | YES |
| 393 | 2 | 24455322 | 24462631 | 7309 | loss | 898 | | N | 50 | 9 | 0.00419744 | 0.37 | stats_biology | YES |
| 394 | 2 | 24455322 | 24462631 | 7309 | loss | 905 | | N | 50 | 9 | 0.00419744 | 0.37 | stats_biology | YES |
| 395 | 2 | 24455322 | 24462631 | 7309 | loss | 906 | | N | 50 | 9 | 0.00419744 | 0.37 | stats_biology | YES |
| 396 | 2 | 24455322 | 24462631 | 7309 | loss | 910 | | N | 50 | 9 | 0.00419744 | 0.37 | stats_biology | YES |
| 397 | 2 | 24455322 | 24462631 | 7309 | loss | 934 | | N | 50 | 9 | 0.00419744 | 0.37 | stats_biology | YES |
| 398 | 2 | 24455322 | 24462631 | 7309 | loss | 935 | | N | 50 | 9 | 0.00419744 | 0.37 | stats_biology | YES |
| 399 | 2 | 24455322 | 24462631 | 7309 | loss | 1163 | | N | 50 | 9 | 0.00419744 | 0.37 | stats_biology | YES |
| 400 | 2 | 24455322 | 24462631 | 7309 | loss | 1188 | | N | 50 | 9 | 0.00419744 | 0.37 | stats_biology | YES |
| 401 | 2 | 24455322 | 24462631 | 7309 | loss | 2292 | | N | 50 | 9 | 0.00419744 | 0.37 | stats_biology | YES |
| 402 | 2 | 24455322 | 24462631 | 7309 | loss | 2448 | | N | 50 | 9 | 0.00419744 | 0.37 | stats_biology | YES |
| 403 | 2 | 24455322 | 24462631 | 7309 | loss | 2460 | | N | 50 | 9 | 0.00419744 | 0.37 | stats_biology | YES |
| 404 | 2 | 24455322 | 24462631 | 7309 | loss | 2501 | | N | 50 | 9 | 0.00419744 | 0.37 | stats_biology | YES |
| 405 | 2 | 24455322 | 24462631 | 7309 | loss | 2516 | | N | 50 | 9 | 0.00419744 | 0.37 | stats_biology | YES |
| 406 | 2 | 24455322 | 24462631 | 7309 | loss | 2519 | | N | 50 | 9 | 0.00419744 | 0.37 | stats_biology | YES |
| 407 | 2 | 24455322 | 24462631 | 7309 | loss | 2534 | | N | 50 | 9 | 0.00419744 | 0.37 | stats_biology | YES |
| 408 | 2 | 24455322 | 24462631 | 7309 | loss | 2622 | | N | 50 | 9 | 0.00419744 | 0.37 | stats_biology | YES |
| 409 | 2 | 24455322 | 24462631 | 7309 | loss | 2628 | | N | 50 | 9 | 0.00419744 | 0.37 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 410 | 2 | 33010969 | 33076511 | 65542 | gain | 323 | LINC00486,LOC100271832,LTBP1 | Y | 3 | 3 | 0.38928787 | 2.15 | biology | |
| 411 | 2 | 33010969 | 33076511 | 65542 | gain | 664 | LINC00486,LOC100271832,LTBP1 | Y | 3 | 3 | 0.38928787 | 2.15 | biology | |
| 412 | 2 | 33010969 | 33076511 | 65542 | gain | 1180 | LINC00486,LOC100271832,LTBP1 | Y | 3 | 3 | 0.38928787 | 2.15 | biology | |
| 413 | 2 | 33010969 | 33076511 | 65542 | gain | 2057 | LINC00486;LOC100271832,LTBP1 | Y | 3 | 3 | 0.38928787 | 2.15 | biology | |
| 414 | 2 | 33010969 | 33076511 | 65542 | gain | 2281 | LINC00486,LOC100271832,LTBP1 | Y | 3 | 3 | 0.38928787 | 2.15 | biology | |
| 415 | 2 | 33010969 | 33076511 | 65542 | gain | 2427 | LINC00486,LOC100271832,LTBP1 | Y | 3 | 3 | 0.38928787 | 2.15 | biology | |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | FET | OR | Category | PV |
|---|---|---|---|---|---|---|---|---|---|---|---|---|---|---|
| 416 | 2 | 44371811 | 44398519 | 26708 | gain | 135 | PREPL,SLC3A1 | Y | 7 | 0 | 0.06166361 | 0.14 | biology | YES |
| 417 | 2 | 44371811 | 44398519 | 26708 | gain | 461 | PREPL,SLC3A1 | Y | 7 | 0 | 0.06166361 | 0.14 | biology | YES |
| 418 | 2 | 44371811 | 44398519 | 26708 | loss | 541 | PREPL,SLC3A1 | Y | 7 | 0 | 0.06166361 | 0.14 | biology | YES |
| 419 | 2 | 44371811 | 44398519 | 26708 | gain | 615 | PREPL,SLC3A1 | Y | 7 | 0 | 0.06166361 | 0.14 | biology | YES |
| 420 | 2 | 44371811 | 44398519 | 26708 | gain | 627 | PREPL,SLC3A1 | Y | 7 | 0 | 0.06166361 | 0.14 | biology | YES |
| 421 | 2 | 44371811 | 44398519 | 26708 | gain | 710 | PREPL,SLC3A1 | Y | 7 | 0 | 0.06166361 | 0.14 | biology | YES |
| 422 | 2 | 44371811 | 44398519 | 26708 | gain | 881 | PREPL,SLC3A1 | Y | 7 | 0 | 0.06166361 | 0.14 | biology | YES |
| 423 | 2 | 88914081 | 88944976 | 30895 | loss | 2246 | | N | 0 | 3 | 0.01019189 | 15.12 | stats_biology | |
| 424 | 2 | 88914081 | 88944976 | 30895 | loss | 2440 | | N | 0 | 3 | 0.01019189 | 15.12 | stats_biology | |
| 425 | 2 | 88914081 | 88944976 | 30895 | loss | 2584 | | N | 0 | 3 | 0.01019189 | 15.12 | stats_biology | |
| 426 | 2 | 88944977 | 88948348 | 3371 | loss | 2246 | | N | 0 | 4 | 0.01007351 | 19.48 | stats_biology | |
| 427 | 2 | 88944977 | 88948348 | 3371 | loss | 2440 | | N | 0 | 4 | 0.01007351 | 19.48 | stats_biology | |
| 428 | 2 | 88944977 | 88948348 | 3371 | loss | 2584 | | N | 0 | 4 | 0.01007351 | 19.48 | stats_biology | |
| 429 | 2 | 88944977 | 88948348 | 3371 | loss | 2615 | | N | 0 | 4 | 0.01007351 | 19.48 | stats_biology | |
| 430 | 2 | 88953798 | 89013439 | 59641 | loss | 2246 | | N | 0 | 4 | 0.01007351 | 19.48 | stats_biology | |
| 431 | 2 | 88953798 | 89013439 | 59641 | loss | 2440 | | N | 0 | 4 | 0.01007351 | 19.48 | stats_biology | |
| 432 | 2 | 88953798 | 89013439 | 59641 | loss | 2584 | | N | 0 | 4 | 0.01007351 | 19.48 | stats_biology | |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 433 | 2 | 88953798 | 89013439 | 59641 | loss | 2615 | | N | 0 | 4 | 0.01007351 | 19.48 | stats_biology | |
| 434 | 2 | 214807911 | 214828475 | 20564 | gain | 149 | SPAG16 | N | 7 | 0 | 0.06166361 | 0.14 | biology | YES |
| 435 | 2 | 214807911 | 214828475 | 20564 | gain | 646 | SPAG16 | N | 7 | 0 | 0.06166361 | 0.14 | biology | YES |
| 436 | 2 | 214807911 | 214828475 | 20564 | gain | 668 | SPAG16 | N | 7 | 0 | 0.06166361 | 0.14 | biology | YES |
| 437 | 2 | 214807911 | 214828475 | 20564 | gain | 756 | SPAG16 | N | 7 | 0 | 0.06166361 | 0.14 | biology | YES |
| 438 | 2 | 214807911 | 214828475 | 20564 | gain | 780 | SPAG16 | N | 7 | 0 | 0.06166361 | 0.14 | biology | YES |
| 439 | 2 | 214807911 | 214828475 | 20564 | gain | 923 | SPAG16 | N | 7 | 0 | 0.06166361 | 0.14 | biology | YES |
| 440 | 2 | 214807911 | 214828475 | 20564 | gain | 1206 | SPAG16 | N | 7 | 0 | 0.06166361 | 0.14 | biology | YES |
| 441 | 3 | 792493 | 825984 | 33491 | gain | 2277 | | N | 0 | 2 | 0.10066129 | 10.78 | biology | |
| 442 | 3 | 792493 | 825984 | 33491 | loss | 2369 | | N | 0 | 2 | 0.10066129 | 10.78 | biology | |
| 443 | 3 | 11386892 | 11388238 | 1346 | loss | 24 | ATG7 | N | 46 | 9 | 0.01170942 | 0.41 | stats_biology | YES |
| 444 | 3 | 11386892 | 11388238 | 1346 | loss | 57 | ATG7 | N | 46 | 9 | 0.01170942 | 0.41 | stats_biology | YES |
| 445 | 3 | 11386892 | 11388238 | 1346 | loss | 72 | ATG7 | N | 46 | 9 | 0.01170942 | 0.41 | stats_biology | YES |
| 446 | 3 | 11386892 | 11388238 | 1346 | loss | 73 | ATG7 | N | 46 | 9 | 0.01170942 | 0.41 | stats_biology | YES |
| 447 | 3 | 11386892 | 11388238 | 1346 | loss | 151 | ATG7 | N | 46 | 9 | 0.01170942 | 0.41 | stats_biology | YES |
| 448 | 3 | 11386892 | 11388238 | 1346 | loss | 177 | ATG7 | N | 46 | 9 | 0.01170942 | 0.41 | stats_biology | YES |
| 449 | 3 | 11386892 | 11388238 | 1346 | loss | 182 | ATG7 | N | 46 | 9 | 0.01170942 | 0.41 | stats_biology | YES |
| 450 | 3 | 11386892 | 11388238 | 1346 | loss | 186 | ATG7 | N | 46 | 9 | 0.01170942 | 0.41 | stats_biology | YES |
| 451 | 3 | 11386892 | 11388238 | 1346 | loss | 188 | ATG7 | N | 46 | 9 | 0.01170942 | 0.41 | stats_biology | YES |
| 452 | 3 | 11386892 | 11388238 | 1346 | loss | 192 | ATG7 | N | 46 | 9 | 0.01170942 | 0.41 | stats_biology | YES |
| 453 | 3 | 11386892 | 11388238 | 1346 | loss | 201 | ATG7 | N | 46 | 9 | 0.01170942 | 0.41 | stats_biology | YES |
| 454 | 3 | 11386892 | 11388238 | 1346 | loss | 203 | ATG7 | N | 46 | 9 | 0.01170942 | 0.41 | stats_biology | YES |
| 455 | 3 | 11386892 | 11388238 | 1346 | loss | 219 | ATG7 | N | 46 | 9 | 0.01170942 | 0.41 | stats_biology | YES |
| 456 | 3 | 11386892 | 11388238 | 1346 | loss | 246 | ATG7 | N | 46 | 9 | 0.01170942 | 0.41 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | FET | OR | Category | PV |
|---|---|---|---|---|---|---|---|---|---|---|---|---|---|---|
| 457 | 3 | 11386892 | 11388238 | 1346 | loss | 266 | ATG7 | N | 46 | 9 | 0.01170942 | 0.41 | stats_biology | YES |
| 458 | 3 | 11386892 | 11388238 | 1346 | loss | 267 | ATG7 | N | 46 | 9 | 0.01170942 | 0.41 | stats_biology | YES |
| 459 | 3 | 11386892 | 11388238 | 1346 | loss | 325 | ATG7 | N | 46 | 9 | 0.01170942 | 0.41 | stats_biology | YES |
| 460 | 3 | 11386892 | 11388238 | 1346 | loss | 329 | ATG7 | N | 46 | 9 | 0.01170942 | 0.41 | stats_biology | YES |
| 461 | 3 | 11386892 | 11388238 | 1346 | loss | 384 | ATG7 | N | 46 | 9 | 0.01170942 | 0.41 | stats_biology | YES |
| 462 | 3 | 11386892 | 11388238 | 1346 | loss | 413 | ATG7 | N | 46 | 9 | 0.01170942 | 0.41 | stats_biology | YES |
| 463 | 3 | 11386892 | 11388238 | 1346 | loss | 419 | ATG7 | N | 46 | 9 | 0.01170942 | 0.41 | stats_biology | YES |
| 464 | 3 | 11386892 | 11388238 | 1346 | loss | 461 | ATG7 | N | 46 | 9 | 0.01170942 | 0.41 | stats_biology | YES |
| 465 | 3 | 11386892 | 11388238 | 1346 | loss | 467 | ATG7 | N | 46 | 9 | 0.01170942 | 0.41 | stats_biology | YES |
| 466 | 3 | 11386892 | 11388238 | 1346 | loss | 481 | ATG7 | N | 46 | 9 | 0.01170942 | 0.41 | stats_biology | YES |
| 467 | 3 | 11386892 | 11388238 | 1346 | loss | 493 | ATG7 | N | 46 | 9 | 0.01170942 | 0.41 | stats_biology | YES |
| 468 | 3 | 11386892 | 11388238 | 1346 | loss | 498 | ATG7 | N | 46 | 9 | 0.01170942 | 0.41 | stats_biology | YES |
| 469 | 3 | 11386892 | 11388238 | 1346 | loss | 510 | ATG7 | N | 46 | 9 | 0.01170942 | 0.41 | stats_biology | YES |
| 470 | 3 | 11386892 | 11388238 | 1346 | loss | 544 | ATG7 | N | 46 | 9 | 0.01170942 | 0.41 | stats_biology | YES |
| 471 | 3 | 11386892 | 11388238 | 1346 | loss | 561 | ATG7 | N | 46 | 9 | 0.01170942 | 0.41 | stats_biology | YES |
| 472 | 3 | 11386892 | 11388238 | 1346 | loss | 574 | ATG7 | N | 46 | 9 | 0.01170942 | 0.41 | stats_biology | YES |
| 473 | 3 | 11386892 | 11388238 | 1346 | loss | 599 | ATG7 | N | 46 | 9 | 0.01170942 | 0.41 | stats_biology | YES |
| 474 | 3 | 11386892 | 11388238 | 1346 | loss | 685 | ATG7 | N | 46 | 9 | 0.01170942 | 0.41 | stats_biology | YES |
| 475 | 3 | 11386892 | 11388238 | 1346 | loss | 729 | ATG7 | N | 46 | 9 | 0.01170942 | 0.41 | stats_biology | YES |
| 476 | 3 | 11386892 | 11388238 | 1346 | loss | 743 | ATG7 | N | 46 | 9 | 0.01170942 | 0.41 | stats_biology | YES |
| 477 | 3 | 11386892 | 11388238 | 1346 | loss | 804 | ATG7 | N | 46 | 9 | 0.01170942 | 0.41 | stats_biology | YES |
| 478 | 3 | 11386892 | 11388238 | 1346 | loss | 821 | ATG7 | N | 46 | 9 | 0.01170942 | 0.41 | stats_biology | YES |
| 479 | 3 | 11386892 | 11388238 | 1346 | loss | 855 | ATG7 | N | 46 | 9 | 0.01170942 | 0.41 | stats_biology | YES |
| 480 | 3 | 11386892 | 11388238 | 1346 | loss | 893 | ATG7 | N | 46 | 9 | 0.01170942 | 0.41 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 481 | 3 | 11386892 | 11388238 | 1346 | loss | 922 | ATG7 | N | 46 | 9 | 0.01170942 | 0.41 | stats_biology | YES |
| 482 | 3 | 11386892 | 11388238 | 1346 | loss | 935 | ATG7 | N | 46 | 9 | 0.01170942 | 0.41 | stats_biology | YES |
| 483 | 3 | 11386892 | 11388238 | 1346 | loss | 936 | ATG7 | N | 46 | 9 | 0.01170942 | 0.41 | stats_biology | YES |
| 484 | 3 | 11386892 | 11388238 | 1346 | loss | 1170 | ATG7 | N | 46 | 9 | 0.01170942 | 0.41 | stats_biology | YES |
| 485 | 3 | 11386892 | 11388238 | 1346 | loss | 1177 | ATG7 | N | 46 | 9 | 0.01170942 | 0.41 | stats_biology | YES |
| 486 | 3 | 11386892 | 11388238 | 1346 | loss | 1178 | ATG7 | N | 46 | 9 | 0.01170942 | 0.41 | stats_biology | YES |
| 487 | 3 | 11386892 | 11388238 | 1346 | loss | 1185 | ATG7 | N | 46 | 9 | 0.01170942 | 0.41 | stats_biology | YES |
| 488 | 3 | 11386892 | 11388238 | 1346 | loss | 1214 | ATG7 | N | 46 | 9 | 0.01170942 | 0.41 | stats_biology | YES |
| 489 | 3 | 11386892 | 11388238 | 1346 | loss | 2213 | ATG7 | N | 46 | 9 | 0.01170942 | 0.41 | stats_biology | YES |
| 490 | 3 | 11386892 | 11388238 | 1346 | loss | 2270 | ATG7 | N | 46 | 9 | 0.01170942 | 0.41 | stats_biology | YES |
| 491 | 3 | 11386892 | 11388238 | 1346 | loss | 2274 | ATG7 | N | 46 | 9 | 0.01170942 | 0.41 | stats_biology | YES |
| 492 | 3 | 11386892 | 11388238 | 1346 | loss | 2360 | ATG7 | N | 46 | 9 | 0.01170942 | 0.41 | stats_biology | YES |
| 493 | 3 | 11386892 | 11388238 | 1346 | loss | 2418 | ATG7 | N | 46 | 9 | 0.01170942 | 0.41 | stats_biology | YES |
| 494 | 3 | 11386892 | 11388238 | 1346 | loss | 2486 | ATG7 | N | 46 | 9 | 0.01170942 | 0.41 | stats_biology | YES |
| 495 | 3 | 11386892 | 11388238 | 1346 | loss | 2561 | ATG7 | N | 46 | 9 | 0.01170942 | 0.41 | stats_biology | YES |
| 496 | 3 | 11386892 | 11388238 | 1346 | loss | 2596 | ATG7 | N | 46 | 9 | 0.01170942 | 0.41 | stats_biology | YES |
| 497 | 3 | 11386892 | 11388238 | 1346 | loss | 2611 | ATG7 | N | 46 | 9 | 0.01170942 | 0.41 | stats_biology | YES |
| 498 | 3 | 48636299 | 48676237 | 39938 | loss | 2591 | CELSR3, MIR4793, SLC26A6 | Y | 0 | 1 | 0.10124937 | 6.45 | biology | |
| 499 | 3 | 162255354 | 162259312 | 3958 | loss | 136 | PPM1L | N | 7 | 0 | 0.06166361 | 0.14 | biology | YES |
| 500 | 3 | 162255354 | 162259312 | 3958 | loss | 287 | PPM1L | N | 7 | 0 | 0.06166361 | 0.14 | biology | YES |
| 501 | 3 | 162255354 | 162259312 | 3958 | loss | 339 | PPM1L | N | 7 | 0 | 0.06166361 | 0.14 | biology | YES |
| 502 | 3 | 162255354 | 162259312 | 3958 | loss | 407 | PPM1L | N | 7 | 0 | 0.06166361 | 0.14 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_-cases | PD_-cases | FET | OR | Category | PV |
|---|---|---|---|---|---|---|---|---|---|---|---|---|---|---|
| 503 | 3 | 162255354 | 162259312 | 3958 | loss | 418 | PPM1L | N | 7 | 0 | 0.06166361 | 0.14 | biology | YES |
| 504 | 3 | 162255354 | 162259312 | 3958 | loss | 496 | PPM1L | N | 7 | 0 | 0.06166361 | 0.14 | biology | YES |
| 505 | 3 | 162255354 | 162259312 | 3958 | loss | 907 | PPM1L | N | 7 | 0 | 0.06166361 | 0.14 | biology | YES |
| 506 | 3 | 172587026 | 172812104 | 225078 | gain | 2053 | PLD1,TNIK | Y | 0 | 1 | 0.10124937 | 6.45 | biology | |
| 507 | 4 | 21662924 | 21676485 | 13561 | loss | 96 | | N | 12 | 1 | 0.07368008 | 0.18 | biology | YES |
| 508 | 4 | 21662924 | 21676485 | 13561 | loss | 394 | | N | 12 | 1 | 0.07368008 | 0.18 | biology | YES |
| 509 | 4 | 21662924 | 21676485 | 13561 | loss | 482 | | N | 12 | 1 | 0.07368008 | 0.18 | biology | YES |
| 510 | 4 | 21662924 | 21676485 | 13561 | loss | 575 | | N | 12 | 1 | 0.07368008 | 0.18 | biology | YES |
| 511 | 4 | 21662924 | 21676485 | 13561 | loss | 694 | | N | 12 | 1 | 0.07368008 | 0.18 | biology | YES |
| 512 | 4 | 21662924 | 21676485 | 13561 | loss | 746 | | N | 12 | 1 | 0.07368008 | 0.18 | biology | YES |
| 513 | 4 | 21662924 | 21676485 | 13561 | loss | 755 | | N | 12 | 1 | 0.07368008 | 0.18 | biology | YES |
| 514 | 4 | 21662924 | 21676485 | 13561 | loss | 823 | | N | 12 | 1 | 0.07368008 | 0.18 | biology | YES |
| 515 | 4 | 21662924 | 21676485 | 13561 | loss | 913 | | N | 12 | 1 | 0.07368008 | 0.18 | biology | YES |
| 516 | 4 | 21662924 | 21676485 | 13561 | loss | 920 | | N | 12 | 1 | 0.07368008 | 0.18 | biology | YES |
| 517 | 4 | 21662924 | 21676485 | 13561 | loss | 945 | | N | 12 | 1 | 0.07368008 | 0.18 | biology | YES |
| 518 | 4 | 21662924 | 21676485 | 13561 | loss | 1193 | | N | 12 | 1 | 0.07368008 | 0.18 | biology | YES |
| 519 | 4 | 21662924 | 21676485 | 13561 | loss | 2251 | | N | 12 | 1 | 0.07368008 | 0.18 | biology | YES |
| 520 | 4 | 40264490 | 40267639 | 3149 | loss | 84 | RBM47 | N | 22 | 4 | 0.08811073 | 0.39 | biology | YES |
| 521 | 4 | 40264490 | 40267639 | 3149 | loss | 179 | RBM47 | N | 22 | 4 | 0.08811073 | 0.39 | biology | YES |
| 522 | 4 | 40264490 | 40267639 | 3149 | loss | 336 | RBM47 | N | 22 | 4 | 0.08811073 | 0.39 | biology | YES |
| 523 | 4 | 40264490 | 40267639 | 3149 | loss | 340 | RBM47 | N | 22 | 4 | 0.08811073 | 0.39 | biology | YES |
| 524 | 4 | 40264490 | 40267639 | 3149 | loss | 381 | RBM47 | N | 22 | 4 | 0.08811073 | 0.39 | biology | YES |
| 525 | 4 | 40264490 | 40267639 | 3149 | loss | 397 | RBM47 | N | 22 | 4 | 0.08811073 | 0.39 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E-cases | PD_-cases | FET | OR | Category | PV |
|---|---|---|---|---|---|---|---|---|---|---|---|---|---|---|
| 526 | 4 | 40264490 | 40267639 | 3149 | loss | 433 | RBM47 | N | 22 | 4 | 0.08811073 | 0.39 | biology | YES |
| 527 | 4 | 40264490 | 40267639 | 3149 | loss | 478 | RBM47 | N | 22 | 4 | 0.08811073 | 0.39 | biology | YES |
| 528 | 4 | 40264490 | 40267639 | 3149 | loss | 501 | RBM47 | N | 22 | 4 | 0.08811073 | 0.39 | biology | YES |
| 529 | 4 | 40264490 | 40267639 | 3149 | loss | 521 | RBM47 | N | 22 | 4 | 0.08811073 | 0.39 | biology | YES |
| 530 | 4 | 40264490 | 40267639 | 3149 | loss | 546 | RBM47 | N | 22 | 4 | 0.08811073 | 0.39 | biology | YES |
| 531 | 4 | 40264490 | 40267639 | 3149 | loss | 556 | R8M47 | N | 22 | 4 | 0.08811073 | 0.39 | biology | YES |
| 532 | 4 | 40264490 | 40267639 | 3149 | loss | 560 | RBM47 | N | 22 | 4 | 0.08811073 | 0.39 | biology | YES |
| 533 | 4 | 40264490 | 40267639 | 3149 | loss | 595 | RBM47 | N | 22 | 4 | 0.08811073 | 0.39 | biology | YES |
| 534 | 4 | 40264490 | 40267639 | 3149 | loss | 611 | RBM47 | N | 22 | 4 | 0.08811073 | 0.39 | biology | YES |
| 535 | 4 | 40264490 | 40267639 | 3149 | loss | 655 | RBM47 | N | 22 | 4 | 0.08811073 | 0.39 | biology | YES |
| 536 | 4 | 40264490 | 40267639 | 3149 | loss | 662 | RBM47 | N | 22 | 4 | 0.08811073 | 0.39 | biology | YES |
| 537 | 4 | 40264490 | 40267639 | 3149 | loss | 768 | RBM47 | N | 22 | 4 | 0.08811073 | 0.39 | biology | YES |
| 538 | 4 | 40264490 | 40267639 | 3149 | loss | 780 | RBM47 | N | 22 | 4 | 0.08811073 | 0.39 | biology | YES |
| 539 | 4 | 40264490 | 40267639 | 3149 | loss | 855 | RBM47 | N | 22 | 4 | 0.08811073 | 0.39 | biology | YES |
| 540 | 4 | 40264490 | 40267639 | 3149 | loss | 1168 | RBM47 | N | 22 | 4 | 0.08811073 | 0.39 | biology | YES |
| 541 | 4 | 40264490 | 40267639 | 3149 | loss | 1194 | RBM47 | N | 22 | 4 | 0.08811073 | 0.39 | biology | YES |
| 542 | 4 | 40264490 | 40267639 | 3149 | loss | 2188 | RBM47 | N | 22 | 4 | 0.08811073 | 0.39 | biology | YES |
| 543 | 4 | 40264490 | 40267639 | 3149 | loss | 2264 | RBM47 | N | 22 | 4 | 0.08811073 | 0.39 | biology | YES |
| 544 | 4 | 40264490 | 40267639 | 3149 | loss | 2435 | RBM47 | N | 22 | 4 | 0.08811073 | 0.39 | biology | YES |
| 545 | 4 | 40264490 | 40267639 | 3149 | loss | 2617 | RBM47 | N | 22 | 4 | 0.08811073 | 0.39 | biology | YES |
| 546 | 4 | 73200621 | 73213381 | 12760 | gain | 2434 | NPFFR2 | Y | 0 | 1 | 0.10124937 | 6.45 | biology | |
| 547 | 4 | 92499781 | 92501024 | 1243 | loss | 330 | CCSER1 | N | 15 | 1 | 0.02889433 | 0.14 | stats_biology | YES |
| 548 | 4 | 92499781 | 92501024 | 1243 | gain | 383 | CCSER1 | N | 15 | 1 | 0.02889433 | 0.14 | stats_biology | YES |
| 549 | 4 | 92499781 | 92501024 | 1243 | loss | 618 | CCSER1 | N | 15 | 1 | 0.02889433 | 0.14 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_ca_ses | FET | OR | Category | PV |
|---|---|---|---|---|---|---|---|---|---|---|---|---|---|---|
| 550 | 4 | 92499781 | 92501024 | 1243 | loss | 647 | CCSER1 | N | 15 | 1 | 0.02889433 | 0.14 | stats_biology | YES |
| 551 | 4 | 92499781 | 92501024 | 1243 | loss | 667 | CCSER1 | N | 15 | 1 | 0.02889433 | 0.14 | stats_biology | YES |
| 552 | 4 | 92499781 | 92501024 | 1243 | loss | 679 | CCSER1 | N | 15 | 1 | 0.02889433 | 0.14 | stats_biology | YES |
| 553 | 4 | 92499781 | 92501024 | 1243 | loss | 688 | CCSER1 | N | 15 | 1 | 0.02889433 | 0.14 | stats_biology | YES |
| 554 | 4 | 92499781 | 92501024 | 1243 | loss | 708 | CCSER1 | N | 15 | 1 | 0.02889433 | 0.14 | stats_biology | YES |
| 555 | 4 | 92499781 | 92501024 | 1243 | loss | 717 | CCSER1 | N | 15 | 1 | 0.02889433 | 0.14 | stats_biology | YES |
| 556 | 4 | 92499781 | 92501024 | 1243 | loss | 798 | CCSER1 | N | 15 | 1 | 0.02889433 | 0.14 | stats_biology | YES |
| 557 | 4 | 92499781 | 92501024 | 1243 | loss | 814 | CCSER1 | N | 15 | 1 | 0.02889433 | 0.14 | stats_biology | YES |
| 558 | 4 | 92499781 | 92501024 | 1243 | loss | 861 | CCSER1 | N | 15 | 1 | 0.02889433 | 0.14 | stats_biology | YES |
| 559 | 4 | 92499781 | 92501024 | 1243 | loss | 862 | CCSER1 | N | 15 | 1 | 0.02889433 | 0.14 | stats_biology | YES |
| 560 | 4 | 92499781 | 92501024 | 1243 | loss | 907 | CCSER1 | N | 15 | 1 | 0.02889433 | 0.14 | stats_biology | YES |
| 561 | 4 | 92499781 | 92501024 | 1243 | loss | 1194 | CCSER1 | N | 15 | 1 | 0.02889433 | 0.14 | stats_biology | YES |
| 562 | 4 | 92499781 | 92501024 | 1243 | loss | 2058 | CCSER1 | N | 15 | 1 | 0.02889433 | 0.14 | stats_biology | YES |
| 563 | 5 | 2098435 | 2117301 | 18866 | loss | 75 | | N | 6 | 0 | 0.18539909 | 0.16 | biology | YES |
| 564 | 5 | 2098435 | 2117301 | 18866 | loss | 95 | | N | 6 | 0 | 0.18539909 | 0.16 | biology | YES |
| 565 | 5 | 2098435 | 2117301 | 18866 | loss | 101 | | N | 6 | 0 | 0.18539909 | 0.16 | biology | YES |
| 566 | 5 | 2098435 | 2117301 | 18866 | loss | 410 | | N | 6 | 0 | 0.18539909 | 0.16 | biology | YES |
| 567 | 5 | 2098435 | 2117301 | 18866 | loss | 749 | | N | 6 | 0 | 0.18539909 | 0.16 | biology | YES |
| 568 | 5 | 2098435 | 2117301 | 18866 | loss | 843 | | N | 6 | 0 | 0.18539909 | 0.16 | biology | YES |
| 569 | 5 | 17397258 | 17409796 | 12538 | loss | 31 | | N | 30 | 3 | 0.0038095 | 0.21 | stats_biology | YES |
| 570 | 5 | 17397258 | 17409796 | 12538 | loss | 41 | | N | 30 | 3 | 0.0038095 | 0.21 | stats_biology | YES |
| 571 | 5 | 17397258 | 17409796 | 12538 | loss | 70 | | N | 30 | 3 | 0.0038095 | 0.21 | stats_biology | YES |
| 572 | 5 | 17397258 | 17409796 | 12538 | loss | 92 | | N | 30 | 3 | 0.0038095 | 0.21 | stats_biology | YES |
| 573 | 5 | 17397258 | 17409796 | 12538 | loss | 100 | | N | 30 | 3 | 0.0038095 | 0.21 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE-cases | PD-cases | FET | OR | Category | PV |
|---|---|---|---|---|---|---|---|---|---|---|---|---|---|---|
| 574 | 5 | 17397258 | 17409796 | 12538 | loss | 126 | | N | 30 | 3 | 0.0038095 | 0.21 | stats_biology | YES |
| 575 | 5 | 17397258 | 17409796 | 12538 | loss | 169 | | N | 30 | 3 | 0.0038095 | 0.21 | stats_biology | YES |
| 576 | 5 | 17397258 | 17409796 | 12538 | loss | 190 | | N | 30 | 3 | 0.0038095 | 0.21 | stats_biology | YES |
| 577 | 5 | 17397258 | 17409796 | 12538 | loss | 205 | | N | 30 | 3 | 0.0038095 | 0.21 | stats_biology | YES |
| 578 | 5 | 17397258 | 17409796 | 12538 | loss | 266 | | N | 30 | 3 | 0.0038095 | 0.21 | stats_biology | YES |
| 579 | 5 | 17397258 | 17409796 | 12538 | loss | 275 | | N | 30 | 3 | 0.0038095 | 0.21 | stats_biology | YES |
| 580 | 5 | 17397258 | 17409796 | 12538 | loss | 439 | | N | 30 | 3 | 0.0038095 | 0.21 | stats_biology | YES |
| 581 | 5 | 17397258 | 17409796 | 12538 | loss | 586 | | N | 30 | 3 | 0.0038095 | 0.21 | stats_biology | YES |
| 582 | 5 | 17397258 | 17409796 | 12538 | loss | 602 | | N | 30 | 3 | 0.0038095 | 0.21 | stats_biology | YES |
| 583 | 5 | 17397258 | 17409796 | 12538 | loss | 713 | | N | 30 | 3 | 0.0038095 | 0.21 | stats_biology | YES |
| 584 | 5 | 17397258 | 17409796 | 12538 | loss | 731 | | N | 30 | 3 | 0.0038095 | 0.21 | stats_biology | YES |
| 585 | 5 | 17397258 | 17409796 | 12538 | loss | 738 | | N | 30 | 3 | 0.0038095 | 0.21 | stats_biology | YES |
| 586 | 5 | 17397258 | 17409796 | 12538 | loss | 747 | | N | 30 | 3 | 0.0038095 | 0.21 | stats_biology | YES |
| 587 | 5 | 17397258 | 17409796 | 12538 | loss | 805 | | N | 30 | 3 | 0.0038095 | 0.21 | stats_biology | YES |
| 588 | 5 | 17397258 | 17409796 | 12538 | loss | 808 | | N | 30 | 3 | 0.0038095 | 0.21 | stats_biology | YES |
| 589 | 5 | 17397258 | 17409796 | 12538 | loss | 824 | | N | 30 | 3 | 0.0038095 | 0.21 | stats_biology | YES |
| 590 | 5 | 17397258 | 17409796 | 12538 | loss | 864 | | N | 30 | 3 | 0.0038095 | 0.21 | stats_biology | YES |
| 591 | 5 | 17397258 | 17409796 | 12538 | loss | 875 | | N | 30 | 3 | 0.0038095 | 0.21 | stats_biology | YES |
| 592 | 5 | 17397258 | 17409796 | 12538 | loss | 880 | | N | 30 | 3 | 0.0038095 | 0.21 | stats_biology | YES |
| 593 | 5 | 17397258 | 17409796 | 12538 | loss | 887 | | N | 30 | 3 | 0.0038095 | 0.21 | stats_biology | YES |
| 594 | 5 | 17397258 | 17409796 | 12538 | loss | 905 | | N | 30 | 3 | 0.0038095 | 0.21 | stats_biology | YES |
| 595 | 5 | 17397258 | 17409796 | 12538 | loss | 914 | | N | 30 | 3 | 0.0038095 | 0.21 | stats_biology | YES |
| 596 | 5 | 17397258 | 17409796 | 12538 | loss | 943 | | N | 30 | 3 | 0.0038095 | 0.21 | stats_biology | YES |
| 597 | 5 | 17397258 | 17409796 | 12538 | loss | 1176 | | N | 30 | 3 | 0.0038095 | 0.21 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E-cases | PD_cases | FET | OR | Category | PV |
|---|---|---|---|---|---|---|---|---|---|---|---|---|---|---|
| 598 | 5 | 17397258 | 17409796 | 12538 | loss | 1190 | | N | 30 | 3 | 0.0038095 | 0.21 | stats_biology | YES |
| 599 | 5 | 17397258 | 17409796 | 12538 | loss | 2172 | | N | 30 | 3 | 0.0038095 | 0.21 | stats_biology | YES |
| 600 | 5 | 17397258 | 17409796 | 12538 | loss | 2220 | | N | 30 | 3 | 0.0038095 | 0.21 | stats_biology | YES |
| 601 | 5 | 17397258 | 17409796 | 12538 | loss | 2600 | | N | 30 | 3 | 0.0038095 | 0.21 | stats_biology | YES |
| 602 | 5 | 22719259 | 22755261 | 36002 | loss | 704 | CDH12 | N | 1 | 1 | 0.5346398 | 2.15 | biology | |
| 603 | 5 | 22719259 | 22755261 | 36002 | gain | 2401 | CDH12 | N | 1 | 1 | 0.5346398 | 2.15 | biology | |
| 604 | 5 | 113630430 | 113683448 | 53018 | loss | 2253 | | N | 0 | 2 | 0.10066129 | 10.78 | biology | |
| 605 | 5 | 113630430 | 113683448 | 53018 | loss | 2627 | | N | 0 | 2 | 0.10066129 | 10.78 | biology | |
| 606 | 6 | 52735825 | 52758917 | 23092 | loss | 78 | GSTA2 | Y | 5 | 0 | 0.18539909 | 0.19 | biology | YES |
| 607 | 6 | 52735825 | 52758917 | 23092 | loss | 96 | GSTA2 | Y | 5 | 0 | 0.18539909 | 0.19 | biology | YES |
| 608 | 6 | 52735825 | 52758917 | 23092 | loss | 434 | GSTA2 | Y | 5 | 0 | 0.18539909 | 0.19 | biology | YES |
| 609 | 6 | 52735825 | 52758917 | 23092 | loss | 771 | GSTA2 | Y | 5 | 0 | 0.18539909 | 0.19 | biology | YES |
| 610 | 6 | 52735825 | 52758917 | 23092 | loss | 1203 | GSTA2 | Y | 5 | 0 | 0.18539909 | 0.19 | biology | YES |
| 611 | 6 | 162674018 | 162678126 | 4108 | gain | 35 | PARK2 | N | 6 | 1 | 0.44219519 | 0.36 | biology | YES |
| 612 | 6 | 162674018 | 162678126 | 4108 | loss | 369 | PARK2 | N | 6 | 1 | 0.44219519 | 0.36 | biology | YES |
| 613 | 6 | 162674018 | 162678126 | 4108 | gain | 571 | PARK2 | N | 6 | 1 | 0.44219519 | 0.36 | biology | YES |
| 614 | 6 | 162674018 | 162678126 | 4108 | loss | 629 | PARK2 | N | 6 | 1 | 0.44219519 | 0.36 | biology | YES |
| 615 | 6 | 162674018 | 162678126 | 4108 | gain | 636 | PARK2 | N | 6 | 1 | 0.44219519 | 0.36 | biology | YES |
| 616 | 6 | 162674018 | 162678126 | 4108 | gain | 1201 | PARK2 | N | 6 | 1 | 0.44219519 | 0.36 | biology | YES |
| 617 | 6 | 162674018 | 162678126 | 4108 | gain | 2237 | PARK2 | N | 6 | 1 | 0.44219519 | 0.36 | biology | YES |
| 618 | 7 | 3524008 | 3573608 | 49600 | loss | 2341 | SDK1 | N | 0 | 1 | 0.10124937 | 6.45 | biology | |
| 619 | 7 | 14979840 | 15000000 | 20160 | gain | 46 | | N | 7 | 0 | 0.06166361 | 0.14 | biology | YES |
| 620 | 7 | 14979840 | 15000000 | 20160 | gain | 84 | | N | 7 | 0 | 0.06166361 | 0.14 | biology | YES |
| 621 | 7 | 14979840 | 15000000 | 20160 | gain | 183 | | N | 7 | 0 | 0.06166361 | 0.14 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE-cases | PD-cases | FET | OR | Category | PV |
|---|---|---|---|---|---|---|---|---|---|---|---|---|---|---|
| 622 | 7 | 14979840 | 15000000 | 20160 | gain | 224 | | N | 7 | 0 | 0.06166361 | 0.14 | biology | YES |
| 623 | 7 | 14979840 | 15000000 | 20160 | gain | 256 | | N | 7 | 0 | 0.06166361 | 0.14 | biology | YES |
| 624 | 7 | 14979840 | 15000000 | 20160 | gain | 270 | | N | 7 | 0 | 0.06166361 | 0.14 | biology | YES |
| 625 | 7 | 14979840 | 15000000 | 20160 | gain | 554 | | N | 7 | 0 | 0.06166361 | 0.14 | biology | YES |
| 626 | 7 | 111031308 | 111035453 | 4145 | gain | 82 | | N | 9 | 0 | 0.03613397 | 0.11 | stats_biology | YES |
| 627 | 7 | 111031308 | 111035453 | 4145 | loss | 110 | | N | 9 | 0 | 0.03613397 | 0.11 | stats_biology | YES |
| 628 | 7 | 111031308 | 111035453 | 4145 | loss | 192 | | N | 9 | 0 | 0.03613397 | 0.11 | stats_biology | YES |
| 629 | 7 | 111031308 | 111035453 | 4145 | gain | 304 | | N | 9 | 0 | 0.03613397 | 0.11 | stats_biology | YES |
| 630 | 7 | 111031308 | 111035453 | 4145 | gain | 417 | | N | 9 | 0 | 0.03613397 | 0.11 | stats_biology | YES |
| 631 | 7 | 111031308 | 111035453 | 4145 | loss | 477 | | N | 9 | 0 | 0.03613397 | 0.11 | stats_biology | YES |
| 632 | 7 | 111031308 | 111035453 | 4145 | loss | 480 | | N | 9 | 0 | 0.03613397 | 0.11 | stats_biology | YES |
| 633 | 7 | 111031308 | 111035453 | 4145 | gain | 680 | | N | 9 | 0 | 0.03613397 | 0.11 | stats_biology | YES |
| 634 | 7 | 111031308 | 111035453 | 4145 | loss | 1167 | | N | 9 | 0 | 0.03613397 | 0.11 | stats_biology | YES |
| 635 | 7 | 131426580 | 131428130 | 1550 | loss | 113 | | N | 20 | 3 | 0.06861499 | 0.32 | biology | YES |
| 636 | 7 | 131426580 | 131428130 | 1550 | loss | 140 | | N | 20 | 3 | 0.06861499 | 0.32 | biology | YES |
| 637 | 7 | 131426580 | 131428130 | 1550 | loss | 141 | | N | 20 | 3 | 0.06861499 | 0.32 | biology | YES |
| 638 | 7 | 131426580 | 131428130 | 1550 | loss | 201 | | N | 20 | 3 | 0.06861499 | 0.32 | biology | YES |
| 639 | 7 | 131426580 | 131428130 | 1550 | loss | 212 | | N | 20 | 3 | 0.06861499 | 0.32 | biology | YES |
| 640 | 7 | 131426580 | 131428130 | 1550 | loss | 241 | | N | 20 | 3 | 0.06861499 | 0.32 | biology | YES |
| 641 | 7 | 131426580 | 131428130 | 1550 | loss | 284 | | N | 20 | 3 | 0.06861499 | 0.32 | biology | YES |
| 642 | 7 | 131426580 | 131428130 | 1550 | loss | 319 | | N | 20 | 3 | 0.06861499 | 0.32 | biology | YES |
| 643 | 7 | 131426580 | 131428130 | 1550 | loss | 353 | | N | 20 | 3 | 0.06861499 | 0.32 | biology | YES |
| 644 | 7 | 131426580 | 131428130 | 1550 | loss | 443 | | N | 20 | 3 | 0.06861499 | 0.32 | biology | YES |
| 645 | 7 | 131426580 | 131428130 | 1550 | loss | 521 | | N | 20 | 3 | 0.06861499 | 0.32 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE-cases | PD-cases | FET | OR | Category | PV |
|---|---|---|---|---|---|---|---|---|---|---|---|---|---|---|
| 646 | 7 | 131426580 | 131428130 | 1550 | loss | 544 | | N | 20 | 3 | 0.06861499 | 0.32 | biology | YES |
| 647 | 7 | 131426580 | 131428130 | 1550 | loss | 570 | | N | 20 | 3 | 0.06861499 | 0.32 | biology | YES |
| 648 | 7 | 131426580 | 131428130 | 1550 | loss | 581 | | N | 20 | 3 | 0.06861499 | 0.32 | biology | YES |
| 649 | 7 | 131426580 | 131428130 | 1550 | loss | 584 | | N | 20 | 3 | 0.06861499 | 0.32 | biology | YES |
| 650 | 7 | 131426580 | 131428130 | 1550 | loss | 680 | | N | 20 | 3 | 0.06861499 | 0.32 | biology | YES |
| 651 | 7 | 131426580 | 131428130 | 1550 | loss | 866 | | N | 20 | 3 | 0.06861499 | 0.32 | biology | YES |
| 652 | 7 | 131426580 | 131428130 | 1550 | loss | 906 | | N | 20 | 3 | 0.06861499 | 0.32 | biology | YES |
| 653 | 7 | 131426580 | 131428130 | 1550 | loss | 1171 | | N | 20 | 3 | 0.06861499 | 0.32 | biology | YES |
| 654 | 7 | 131426580 | 131428130 | 1550 | loss | 1188 | | N | 20 | 3 | 0.06861499 | 0.32 | biology | YES |
| 655 | 7 | 131426580 | 131428130 | 1550 | loss | 2391 | | N | 20 | 3 | 0.06861499 | 0.32 | biology | YES |
| 656 | 7 | 131426580 | 131428130 | 1550 | loss | 2558 | | N | 20 | 3 | 0.06861499 | 0.32 | biology | YES |
| 657 | 7 | 131426580 | 131428130 | 1550 | loss | 2576 | | N | 20 | 3 | 0.06861499 | 0.32 | biology | YES |
| 658 | 8 | 16007459 | 16067927 | 60468 | loss | 58 | MSR1 | Y | 9 | 0 | 0.03613397 | 0.11 | stats_biology | YES |
| 659 | 8 | 16007459 | 16067927 | 60468 | loss | 60 | MSR1 | Y | 9 | 0 | 0.03613397 | 0.11 | stats_biology | YES |
| 660 | 8 | 16007459 | 16067927 | 60468 | loss | 187 | MSR1 | Y | 9 | 0 | 0.03613397 | 0.11 | stats_biology | YES |
| 661 | 8 | 16007459 | 16067927 | 60468 | loss | 335 | MSR1 | Y | 9 | 0 | 0.03613397 | 0.11 | stats_biology | YES |
| 662 | 8 | 16007459 | 16067927 | 60468 | loss | 465 | MSR1 | Y | 9 | 0 | 0.03613397 | 0.11 | stats_biology | YES |
| 663 | 8 | 16007459 | 16067927 | 60468 | loss | 557 | MSR1 | Y | 9 | 0 | 0.03613397 | 0.11 | stats_biology | YES |
| 664 | 8 | 16007459 | 16067927 | 60468 | loss | 577 | MSR1 | Y | 9 | 0 | 0.03613397 | 0.11 | stats_biology | YES |
| 665 | 8 | 16007459 | 16067927 | 60468 | loss | 757 | MSR1 | Y | 9 | 0 | 0.03613397 | 0.11 | stats_biology | YES |
| 666 | 8 | 16007459 | 16067927 | 60468 | loss | 1172 | MSR1 | Y | 9 | 0 | 0.03613397 | 0.11 | stats_biology | YES |
| 667 | 8 | 131071806 | 131074181 | 2375 | gain | 2360 | FAM49B | N | 0 | 4 | 0.01007351 | 19.48 | stats_biology | YES |
| 668 | 8 | 131071806 | 131074181 | 2375 | gain | 2611 | FAM49B | N | 0 | 4 | 0.01007351 | 19.48 | stats_biology | YES |
| 669 | 8 | 131071806 | 131074181 | 2375 | gain | 2622 | FAM49B | N | 0 | 4 | 0.01007351 | 19.48 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE-cases | PD-cases | FET | OR | Category | PV |
|---|---|---|---|---|---|---|---|---|---|---|---|---|---|---|
| 670 | 8 | 13107 1806 | 13107 4181 | 2375 | gain | 2626 | FAM49B | N | 0 | 4 | 0.0100735 1 | 19.48 | stats_biology | YES |
| 671 | 9 | 73135 012 | 73139 210 | 4198 | loss | 82 | | N | 18 | 2 | 0.0495533 | 0.24 | stats_biology | YES |
| 672 | 9 | 73135 012 | 73139 210 | 4198 | loss | 98 | | N | 18 | 2 | 0.0495533 | 0.24 | stats_biology | YES |
| 673 | 9 | 73135 012 | 73139 210 | 4198 | loss | 110 | | N | 18 | 2 | 0.0495533 | 0.24 | stats_biology | YES |
| 674 | 9 | 73135 012 | 73139 210 | 4198 | loss | 184 | | N | 18 | 2 | 0.0495533 | 0.24 | stats_biology | YES |
| 675 | 9 | 73135 012 | 73139 210 | 4198 | loss | 206 | | N | 18 | 2 | 0.0495533 | 0.24 | stats_biology | YES |
| 676 | 9 | 73135 012 | 73139 210 | 4198 | loss | 234 | | N | 18 | 2 | 0.0495533 | 0.24 | stats_biology | YES |
| 677 | 9 | 73135 012 | 73139 210 | 4198 | loss | 258 | | N | 18 | 2 | 0.0495533 | 0.24 | stats_biology | YES |
| 678 | 9 | 73135 012 | 73139 210 | 4198 | loss | 264 | | N | 18 | 2 | 0.0495533 | 0.24 | stats_biology | YES |
| 679 | 9 | 73135 012 | 73139 210 | 4198 | loss | 308 | | N | 18 | 2 | 0.0455533 | 0.24 | stats_biology | YES |
| 680 | 9 | 73135 012 | 73139 210 | 4198 | loss | 404 | | N | 18 | 2 | 0.0495533 | 0.24 | stats_biology | YES |
| 681 | 9 | 73135 012 | 73139 210 | 4198 | loss | 511 | | N | 18 | 2 | 0.0495533 | 0.24 | stats_biology | YES |
| 682 | 9 | 73135 012 | 73139 210 | 4198 | loss | 608 | | N | 18 | 2 | 0.0495533 | 0.24 | stats_biology | YES |
| 683 | 9 | 73135 012 | 73139 210 | 4198 | loss | 668 | | N | 18 | 2 | 0.0495533 | 0.24 | stats_biology | YES |
| 684 | 9 | 73135 012 | 73139 210 | 4198 | loss | 724 | | N | 18 | 2 | 0.0495533 | 0.24 | stats_biology | YES |
| 685 | 9 | 73135 012 | 73139 210 | 4198 | loss | 754 | | N | 18 | 2 | 0.0495533 | 0.24 | stats_biology | YES |
| 686 | 9 | 73135 012 | 73139 210 | 4198 | loss | 825 | | N | 18 | 2 | 0.0495533 | 0.24 | stats_biology | YES |
| 687 | 9 | 73135 012 | 73139 210 | 4198 | loss | 861 | | N | 18 | 2 | 0.0495533 | 0.24 | stats_biology | YES |
| 688 | 9 | 78135 012 | 73139 210 | 4198 | loss | 1167 | | N | 18 | 2 | 0.0495533 | 0:24 | stats_biology | YES |
| 689 | 9 | 73135 012 | 73139 210 | 4198 | loss | 2223 | | N | 18 | 2 | 0.0495533 | 0.24 | stats_biology | YES |
| 690 | 9 | 73135 012 | 73139 210 | 4198 | loss | 2434 | | N | 18 | 2 | 0.0495533 | 0.24 | stats_biology | YES |
| 691 | 9 | 86192 876 | 86196 526 | 3650 | loss | 9 | | N | 19 | 2 | 0.0314160 7 | 0.22 | stats_biology | YES |
| 692 | 9 | 86192 876 | 86196 526 | 3650 | loss | 45 | | N | 19 | 2 | 0.0314160 7 | 0.22 | stats_biology | YES |
| 693 | 9 | 86192 876 | 86196 526 | 3650 | loss | 102 | | N | 19 | 2 | 0.0314160 7 | 0.22 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E-cases | PD_cases | FET | OR | Category | PV |
|---|---|---|---|---|---|---|---|---|---|---|---|---|---|---|
| 694 | 9 | 86192876 | 86196526 | 3650 | loss | 109 | | N | 19 | 2 | 0.03141607 | 0.22 | stats_biology | YES |
| 695 | 9 | 86192876 | 86196526 | 3650 | loss | 181 | | N | 19 | 2 | 0.03141607 | 0.22 | stats_biology | YES |
| 696 | 9 | 86192876 | 86196526 | 3650 | loss | 202 | | N | 19 | 2 | 0.03141607 | 0.22 | stats_biology | YES |
| 697 | 9 | 86192876 | 86196526 | 3650 | loss | 253 | | N | 19 | 2 | 0.03141607 | 0.22 | stats_biology | YES |
| 698 | 9 | 86192876 | 86196526 | 3650 | loss | 332 | | N | 19 | 2 | 0.03141607 | 0.22 | stats_biology | YES |
| 699 | 9 | 86192876 | 86196526 | 3650 | loss | 339 | | N | 19 | 2 | 0.03141607 | 0.22 | stats_biology | YES |
| 700 | 9 | 86192876 | 86196526 | 3650 | loss | 340 | | N | 19 | 2 | 0.03141607 | 0.22 | stats_biology | YES |
| 701 | 9 | 86192876 | 86196526 | 3650 | loss | 358 | | N | 19 | 2 | 0.03141607 | 0.22 | stats_biology | YES |
| 702 | 9 | 86192876 | 86196526 | 3650 | loss | 545 | | N | 19 | 2 | 0.03141607 | 0.22 | stats_biology | YES |
| 703 | 9 | 86192876 | 86196526 | 3650 | loss | 608 | | N | 19 | 2 | 0.03141607 | 0.22 | stats_biology | YES |
| 704 | 9 | 86192876 | 86196526 | 3650 | loss | 618 | | N | 19 | 2 | 0.03141607 | 0.22 | stats_biology | YES |
| 705 | 9 | 86192876 | 86196526 | 3650 | loss | 664 | | N | 19 | 2 | 0.03141607 | 0.22 | stats_biology | YES |
| 706 | 9 | 86192876 | 86196526 | 3650 | loss | 784 | | N | 19 | 2 | 0.03141607. | 0.22 | stats_biology | YES |
| 707 | 9 | 86192876 | 86196526 | 3650 | loss | 785 | | N | 19 | 2 | 0.03141607 | 0.22 | stats_biology | YES |
| 708 | 9 | 86192876 | 86196526 | 3650 | loss | 899 | | N | 19 | 2 | 0.03141607 | 0.22 | stats_biology | YES |
| 709 | 9 | 86192876 | 86196526 | 3650 | loss | 928 | | N | 19 | 2 | 0.03141607 | 0.22 | stats_biology | YES |
| 710 | 9 | 86192876 | 86196526 | 3650 | loss | 2343 | | N | 19 | 2 | 0.03141607 | 0.22 | stats_biology | YES |
| 711 | 9 | 86192876 | 86196526 | 3650 | loss | 2508 | | N | 19 | 2 | 0.03141607 | 0.22 | stats_biology | YES |
| 712 | 9 | 134613502 | 134616971 | 3469 | loss | 31 | AK8 | N | 33 | 7 | 0.05745351 | 0.45 | biology | YES |
| 713 | 9 | 134613502 | 134616971 | 3469 | loss | 78 | AK8 | N | 33 | 7 | 0.05745351 | 0.45 | biology | YES |
| 714 | 9 | 134613502 | 134616971 | 3469 | loss | 111 | AK8 | N | 33 | 7 | 0.05745351 | 0.45 | biology | YES |
| 715 | 9 | 134613502 | 134616971 | 3469 | loss | 114 | AK8 | N | 33 | 7 | 0.05745351 | 0.45 | biology | YES |
| 716 | 9 | 134613502 | 134616971 | 3469 | loss | 136 | AK8 | N | 33 | 7 | 0.05745351 | 0.45 | biology | YES |
| 717 | 9 | 134613502 | 134616971 | 3469 | loss | 161 | AK8 | N | 33 | 7 | 0.05745351 | 0.45 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE-cases | PD_cases | FET | OR | Category | PV |
|---|---|---|---|---|---|---|---|---|---|---|---|---|---|---|
| 718 | 9 | 134613502 | 134616971 | 3469 | loss | 170 | AK8 | N | 33 | 7 | 0.05745351 | 0.45 | biology | YES |
| 719 | 9 | 134613502 | 134616971 | 3469 | loss | 209 | AK8 | N | 33 | 7 | 0.05745351 | 0.45 | biology | YES |
| 720 | 9 | 134613502 | 134616971 | 3469 | loss | 236 | AK8 | N | 33 | 7 | 0.05745351 | 0.45 | biology | YES |
| 721 | 9 | 134613502 | 134616971 | 3469 | loss | 261 | AK8 | N | 33 | 7 | 0.05745351 | 0.45 | biology | YES |
| 722 | 9 | 134613502 | 134616971 | 3469 | loss | 299 | AK8 | N | 33 | 7 | 0.05745351 | 0.45 | biology | YES |
| 723 | 9 | 134613502 | 134616971 | 3469 | loss | 422 | AK8 | N | 33 | 7 | 0.05745351 | 0.45 | biology | YES |
| 724 | 9 | 134613502 | 134616971 | 3469 | loss | 424 | AK8 | N | 33 | 7 | 0.05745351 | 0.45 | biology | YES |
| 725 | 9 | 134613502 | 134616971 | 3469 | loss | 464 | AK8 | N | 33 | 7 | 0.05745351 | 0.45 | biology | YES |
| 726 | 9 | 134613502 | 134616971 | 3469 | gain | 468 | AK8 | N | 33 | 7 | 0.05745351 | 0.45 | biology | YES |
| 727 | 9 | 134613502 | 134616971 | 3469 | loss | 477 | AK8 | N | 33 | 7 | 0.05745351 | 0.45 | biology | YES |
| 728 | 9 | 134613502 | 134616971 | 3469 | loss | 491 | AK8 | N | 33 | 7 | 0.05745351 | 0.45. | biology | YES |
| 729 | 9 | 134613502 | 134616971 | 3469 | loss | 504 | AK8 | N | 33 | 7 | 0.05745351 | 0.45 | biology | YES |
| 730 | 9 | 134613502 | 134616971 | 3469 | loss | 530 | AK8 | N | 33 | 7 | 0.05745351 | 0.45 | biology | YES |
| 731 | 9 | 134613502 | 134616971 | 3469 | loss | 598 | AK8 | N | 33 | 7 | 0.05745351 | 0.45 | biology | YES |
| 732 | 9 | 134613502 | 134616971 | 3469 | loss | 629 | AK8 | N | 33 | 7 | 0.05745351 | 0.45 | biology | YES |
| 733 | 9 | 134613502 | 134616971 | 3469 | loss | 632 | AK8 | N | 33 | 7 | 0.05745351 | 0.45 | biology | YES |
| 734 | 9 | 134613502 | 134616971 | 3469 | loss | 649 | AK8 | N | 33 | 7 | 0.05745351 | 0.45 | biology | YES |
| 735 | 9 | 134613502 | 134616971 | 3469 | loss | 662 | AK8 | N | 33 | 7 | 0.05745351 | 0.45 | biology | YES |
| 736 | 9 | 134613502 | 134616971 | 3469 | loss | 691 | AK8 | N | 33 | 7 | 0.05745351 | 0.45 | biology | YES |
| 737 | 9 | 134613502 | 134616971 | 3469 | loss | 730 | AK8 | N | 33 | 7 | 0.05745351 | 0.45 | biology | YES |
| 738 | 9 | 134613502 | 134616971 | 3469 | loss | 831 | AK8 | N | 33 | 7 | 0.05745351 | 0.45 | biology | YES |
| 739 | 9 | 134613502 | 134616971 | 3469 | gain | 852 | AK8 | N | 33 | 7 | 0.05745351 | 0.45 | biology | YES |
| 740 | 9 | 134613502 | 134616971 | 3469 | loss | 891 | AK8 | N | 33 | 7 | 0.05745351 | 0.45 | biology | YES |
| 741 | 9 | 134613502 | 134616971 | 3469 | loss | 918 | AK8 | N | 33 | 7 | 0.05745351 | 0.45 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_cases | PD_cases | FET | OR | Category | PV |
|---|---|---|---|---|---|---|---|---|---|---|---|---|---|---|
| 742 | 9 | 134613502 | 134616971 | 3469 | loss | 1171 | AK8 | N | 33 | 7 | 0.05745351 | 0.45 | biology | YES |
| 743 | 9 | 134613502 | 134616971 | 3469 | loss | 1183 | AK8 | N | 33 | 7 | 0.05745351 | 0.45 | biology | YES |
| 744 | 9 | 134613502 | 134616971 | 3469 | loss | 1217 | AK8 | N | 33 | 7 | 0.05745351 | 0.45 | biology | YES |
| 745 | 9 | 134613502 | 134616971 | 3469 | loss | 2054 | AK8 | N | 33 | 7 | 0.05745351 | 0.45 | biology | YES |
| 746 | 9 | 134613502 | 134616971 | 3469 | loss | 2182 | AK8 | N | 33 | 7 | 0.05745351 | 0.45 | biology | YES |
| 747 | 9 | 134613502 | 134616971 | 3469 | loss | 2291 | AK8 | N | 33 | 7 | 0.05745351 | 0.45 | biology | YES |
| 748 | 9 | 134613502 | 134616971 | 3469 | loss | 2298 | AK8 | N | 33 | 7 | 0.05745351 | 0.45 | biology | YES |
| 749 | 9 | 134613502 | 134616971 | 3469 | loss | 2371 | AK8 | N | 33 | 7 | 0.05745351 | 0.45 | biology | YES |
| 750 | 9 | 134613502 | 134616971 | 3469 | loss | 2458 | AK8 | N | 33 | 7 | 0.05745351 | 0.45 | biology | YES |
| 751 | 9 | 134613502 | 134616971 | 3469 | loss | 2522 | AK8 | N | 33 | 7 | 0.05745351 | 0.45 | biology | YES |
| 752 | 9 | 138787852 | 138791196 | 3344 | loss | 80 | | N | 48 | 9 | 0.0084106 | 0.39 | stats_biology | YES |
| 753 | 9 | 138787852 | 138791196 | 3344 | loss | 106 | | N | 48 | 9 | 0.0084106 | 0.39 | stats_biology | YES |
| 754 | 9 | 138787852 | 138791196 | 3344 | loss | 124 | | N | 48 | 9 | 0.0084106 | 0.39 | stats_biology | YES |
| 755 | 9 | 138787852 | 138791196 | 3344 | loss | 145 | | N | 48 | 9 | 0.0084106 | 0.39 | stats_biology | YES |
| 756 | 9 | 138787852 | 138791196 | 3344 | loss | 147 | | N | 48 | 9 | 0.0084106 | 0.39 | stats_biology | YES |
| 757 | 9 | 138787852 | 138791196 | 3344 | loss | 173 | | N | 48 | 9 | 0.0084106 | 0.39 | stats_biology | YES |
| 758 | 9 | 138787852 | 138791196 | 3344 | loss | 189 | | N | 48 | 9 | 0.0084106 | 0.39 | stats_biology | YES |
| 759 | 9 | 138787852 | 138791196 | 3344 | loss | 200 | | N | 48 | 9 | 0.0084106 | 0.39 | stats_biology | YES |
| 760 | 9 | 138787852 | 138791196 | 3344 | loss | 201 | | N | 48 | 9 | 0.0084106 | 0.39 | stats_biology | YES |
| 761 | 9 | 138787852 | 138791196 | 3344 | loss | 242 | | N | 48 | 9 | 0.0084106 | 0.39 | stats_biology | YES |
| 762 | 9 | 138787852 | 138791196 | 3344 | loss | 252 | | N | 48 | 9 | 0.0084106 | 0.39 | stats_biology | YES |
| 763 | 9 | 138787852 | 138791196 | 3344 | loss | 290 | | N | 48 | 9 | 0.0084106 | 0.39 | stats_biology | YES |
| 764 | 9 | 138787852 | 138791196 | 3344 | loss | 292 | | N | 48 | 9 | 0.0084106 | 0.39 | stats_biology | YES |
| 765 | 9 | 138787852 | 138791196 | 3344 | loss | 336 | | N | 48 | 9 | 0.0084106 | 0.39 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E-cases | PD_-cases | FET | OR | Category | PV |
|---|---|---|---|---|---|---|---|---|---|---|---|---|---|---|
| 766 | 9 | 138787852 | 138791196 | 3344 | loss | 367 | | N | 48 | 9 | 0.0084106 | 0.39 | stats_biology | YES |
| 767 | 9 | 138787852 | 138791196 | 3344 | loss | 429 | | N | 48 | 9 | 0.0084106 | 0.39 | stats_biology | YES |
| 768 | 9 | 138787852 | 138791196 | 3344 | loss | 445 | | N | 48 | 9 | 0.0084106 | 0.39 | stats_biology | YES |
| 769 | 9 | 138787852 | 138791196 | 3344 | loss | 486 | | N | 48 | 9 | 0.0084106 | 0.39 | stats_biology | YES |
| 770 | 9 | 138787852 | 138791196 | 3344 | loss | 489 | | N | 48 | 9 | 0.0084106 | 0.39 | stats_biology | YES |
| 771 | 9 | 138787852 | 138791196 | 3344 | loss | 500 | | N | 48 | 9 | 0.0084106 | 0.39 | stats_biology | YES |
| 772 | 9 | 138787852 | 138791196 | 3344 | loss | 516 | | N | 48 | 9 | 0.0084106 | 0.39 | stats_biology | YES |
| 773 | 9 | 138787852 | 138791196 | 3344 | loss | 531 | | N | 48 | 9 | 0.0084106 | 0.39 | stats_biology | YES |
| 774 | 9 | 138787852 | 138791196 | 3344 | loss | 536 | | N | 48 | 9 | 0.0084106 | 0.39 | stats_biology | YES |
| 775 | 9 | 138787852 | 138791196 | 3344 | loss | 544 | | N | 48 | 9 | 0.0084106 | 0.39 | stats_biology | YES |
| 776 | 9 | 138787852 | 138791196 | 3344 | loss | 579 | | N | 48 | 9 | 0.0084106 | 0.39 | stats_biology | YES |
| 777 | 9 | 138787852 | 138791196 | 3344 | loss | 583 | | N | 48 | 9 | 0.0084106 | 0.39 | stats_biology | YES |
| 778 | 9 | 138787852 | 138791196 | 3344 | loss | 600 | | N | 48 | 9 | 0.0084106 | 0.39 | stats_biology | YES |
| 779 | 9 | 138787852 | 138791196 | 3344 | loss | 618 | | N | 48 | 9 | 0.0084106 | 0.39 | stats_biology | YES |
| 780 | 9 | 138787852 | 138791196 | 3344 | loss | 621 | | N | 48 | 9 | 0.0084106 | 0.39 | stats_biology | YES |
| 781 | 9 | 138787852 | 138791196 | 3344 | loss | 637 | | N | 48 | 9 | 0.0084106 | 0.39 | stats_biology | YES |
| 782 | 9 | 138787852 | 138791196 | 3344 | loss | 659 | | N | 48 | 9 | 0.0084106 | 0.39 | stats_biology | YES |
| 783 | 9 | 138787852 | 138791196 | 3344 | loss | 660 | | N | 48 | 9 | 0.0084106 | 0.39 | stats_biology | YES |
| 784 | 9 | 138787852 | 138791196 | 3344 | loss | 690 | | N | 48 | 9 | 0.0084106 | 0.39 | stats_biology | YES |
| 785 | 9 | 138787852 | 138791196 | 3344 | loss | 745 | | N | 48 | 9 | 0.0084106 | 0.39 | stats_biology | YES |
| 786 | 9 | 138787852 | 138791196 | 3344 | loss | 753 | | N | 48 | 9 | 0.0084106 | 0.39 | stats_biology | YES |
| 787 | 9 | 138787852 | 138791196 | 3344 | loss | 760 | | N | 48 | 9 | 0.0084106 | 0.39 | stats_biology | YES |
| 788 | 9 | 138787852 | 138791196 | 3344 | loss | 763 | | N | 48 | 9 | 0.0084106 | 0.39 | stats_biology | YES |
| 789 | 9 | 138787852 | 138791196 | 3344 | loss | 771 | | N | 48 | 9 | 0.0084106 | 0.39 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 790 | 9 | 138787852 | 138791196 | 3344 | loss | 795 | | N | 48 | 9 | 0.0084106 | 0.39 | stats_biology | YES |
| 791 | 9 | 138787852 | 138791196 | 3344 | loss | 876 | | N | 48 | 9 | 0.0084106 | 0.39 | stats_biology | YES |
| 792 | 9 | 138787852 | 138791196 | 3344 | loss | 885 | | N | 48 | 9 | 0.0084106 | 0.39 | stats_biology | YES |
| 793 | 9 | 138787852 | 138791196 | 3344 | loss | 894 | | N | 48 | 9 | 0.0084106 | 0.39 | stats_biology | YES |
| 794 | 9 | 138787852 | 138791196 | 3344 | loss | 914 | | N | 48 | 9 | 0.0084106 | 0.39 | stats_biology | YES |
| 795 | 9 | 138787852 | 138791196 | 3344 | loss | 920 | | N | 48 | 9 | 0.0084106 | 0.39 | stats_biology | YES |
| 796 | 9 | 138787852 | 138791196 | 3344 | loss | 1163 | | N | 48 | 9 | 0.0084106 | 0.39 | stats_biology | YES |
| 797 | 9 | 138787852 | 138791196 | 3344 | loss | 1179 | | N | 48 | 9 | 0.0084106 | 0.39 | stats_biology | YES |
| 798 | 9 | 138787852 | 138791196 | 3344 | loss | 1210 | | N | 48 | 9 | 0.0084106 | 0.39 | stats_biology | YES |
| 799 | 9 | 138787852 | 138791196 | 3344 | loss | 1215 | | N | 48 | 9 | 0.0084106 | 0.39 | stats_biology | YES |
| 800 | 9 | 138787852 | 138791196 | 3344 | loss | 2050 | | N | 48 | 9 | 0.0084106 | 0.39 | stats_biology | YES |
| 801 | 9 | 138787852 | 138791196 | 3344 | loss | 2186 | | N | 48 | 9 | 0.0084106 | 0.39 | stats_biology | YES |
| 802 | 9 | 138787852 | 138791196 | 3344 | loss | 2244 | | N | 48 | 9 | 0.0084106 | 0.39 | stats_biology | YES |
| 803 | 9 | 138787852 | 138791196 | 3344 | loss | 2377 | | N | 48 | 9 | 0.0084106 | 0.39 | stats_biology | YES |
| 804 | 9 | 138787852 | 138791196 | 3344 | loss | 2388 | | N | 48 | 9 | 0.0084106 | 0.39 | stats_biology | YES |
| 805 | 9 | 138787852 | 138791196 | 3344 | loss | 2464 | | N | 48 | 9 | 0.0084106 | 0.39 | stats_biology | YES |
| 806 | 9 | 138787852 | 138791196 | 3344 | loss | 2488 | | N | 48 | 9 | 0.0084106 | 0.39 | stats_biology | YES |
| 807 | 9 | 138787852 | 138791196 | 3344 | loss | 2616 | | N | 48 | 9 | 0.0084106 | 0.39 | stats_biology | YES |
| 808 | 9 | 138787852 | 138791196 | 3344 | loss | 2626 | | N | 48 | 9 | 0.0084106 | 0.39 | stats_biology | YES |
| 809 | 10 | 67981351 | 67984288 | 2937 | loss | 113 | CTNNA3 | N | 8 | 1 | 0.28678336 | 0.27 | biology | YES |
| 810 | 10 | 67981351 | 67984288 | 2937 | loss | 244 | CTNNA3 | N | 8 | 1 | 0.28678336 | 0.27 | biology | YES |
| 811 | 10 | 67981351 | 67984288 | 2937 | loss | 273 | CTNNA3 | N | 8 | 1 | 0.28678336 | 0.27 | biology | YES |
| 812 | 10 | 67981351 | 67984288 | 2937 | loss | 276 | CTNNA3 | N | 8 | 1 | 0.28678336 | 0.27 | biology | YES |
| 813 | 10 | 67981351 | 67984288 | 2937 | loss | 477 | CTNNA3 | N | 8 | 1 | 0.28678336 | 0.27 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE-cases | PD-cases | FET | OR | Category | PV |
|---|---|---|---|---|---|---|---|---|---|---|---|---|---|---|
| 814 | 10 | 67981351 | 67984288 | 2937 | loss | 596 | CTNNA3 | N | 8 | 1 | 0.28678336 | 0.27 | biology | YES |
| 815 | 10 | 67981351 | 67984288 | 2937 | loss | 728 | CTNNA3 | N | 8 | 1 | 0.28678336 | 0.27 | biology | YES |
| 816 | 10 | 67981351 | 67984288 | 2937 | loss | 1175 | CTNNA3 | N | 8 | 1 | 0.28678336 | 0.27 | biology | YES |
| 817 | 10 | 67981351 | 67984288 | 2937 | loss | 2607 | CTNNA3 | N | 8 | 1 | 0.28678336 | 0.27 | biology | YES |
| 818 | 10 | 68023387 | 68032304 | 8917 | loss | 113 | CTNNA3 | N | 8 | 1 | 0.28678336 | 0.27 | biology | YES |
| 819 | 10 | 68023387 | 68032304 | 8917 | loss | 154 | CTNNA3 | N | 8 | 1 | 0.28678336 | 0.27 | biology | YES |
| 820 | 10 | 68023387 | 68032304 | 8917 | loss | 381 | CTNNA3 | N | 8 | 1 | 0.28678336 | 0.27 | biology | YES |
| 821 | 10 | 68023387 | 68032304 | 8917 | loss | 477 | CTNNA3 | N | 8 | 1 | 0.28678336 | 0.27 | biology | YES |
| 822 | 10 | 68023387 | 68032304 | 8917 | loss | 596 | CTNNA3 | N | 8 | 1 | 0.28678336 | 0.27 | biology | YES |
| 823 | 10 | 68023387 | 68032304 | 8917 | loss | 728 | CTNNA3 | N | 8 | 1 | 0.28678336 | 0.27 | biology | YES |
| 824 | 10 | 68023387 | 68032304 | 8917 | loss | 858 | CTNNA3 | N | 8 | 1 | 0.28678336 | 0.27 | biology | YES |
| 825 | 10 | 68023387 | 68032304 | 8917 | loss | 1175 | CTNNA3 | N | 8 | 1 | 0.28678336 | 0.27 | biology | YES |
| 826 | 10 | 68023387 | 68032304 | 8917 | loss | 2299 | CTNNA3 | N | 8 | 1 | 0.28678336 | 0.27 | biology | YES |
| 827 | 10 | 116629173 | 116872694 | 243521 | gain | 2264 | ATRNL1, FAM160B1, TRUB1 | Y | 0 | 1 | 0.10124937 | 6.45 | biology | |
| 828 | 11 | 69754380 | 69760985 | 6605 | loss | 27 | | N | 25 | 4 | 0.04237816 | 0.34 | stats_biology | YES |
| 829 | 11 | 69754380 | 69760985 | 6605 | loss | 115 | | N | 25 | 4 | 0.04237816 | 0.34 | stats_biology | YES |
| 830 | 11 | 69754380 | 69760985 | 6605 | loss | 125 | | N | 25 | 4 | 0.04237816 | 0.34 | stats_biology | YES |
| 831 | 11 | 69754380 | 69760985 | 6605 | loss | 129 | | N | 25 | 4 | 0.04237816 | 0.34 | stats_biology | YES |
| 832 | 11 | 69754380 | 69760985 | 6605 | loss | 255 | | N | 25 | 4 | 0.04237816 | 0.34 | stats_biology | YES |
| 833 | 11 | 69754380 | 69760985 | 6605 | loss | 276 | | N | 25 | 4 | 0.04237816 | 0.34 | stats_biology | YES |
| 834 | 11 | 69754380 | 69760985 | 6605 | loss | 319 | | N | 25 | 4 | 0.04237816 | 0.34 | stats_biology | YES |
| 835 | 11 | 69754380 | 69760985 | 6605 | loss | 513 | | N | 25 | 4 | 0.04237816 | 0.34 | stats_biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 836 | 11 | 69754380 | 69760985 | 6605 | loss | 520 | | N | 25 | 4 | 0.04237816 | 0.34 | stats_biology | YES |
| 837 | 11 | 69754380 | 69760985 | 6605 | loss | 530 | | N | 25 | 4 | 0.04237816 | 0.34 | stats_biology | YES |
| 838 | 11 | 69754380 | 69760985 | 6605 | loss | 597 | | N | 25 | 4 | 0.04237816 | 0.34 | stats_biology | YES |
| 839 | 11 | 69754380 | 69760985 | 6605 | loss | 601 | | N | 25 | 4 | 0.04237816 | 0.34 | stats_biology | YES |
| 840 | 11 | 69754380 | 69760985 | 6605 | loss | 629 | | N | 25 | 4 | 0.04237816 | 0.34 | stats_biology | YES |
| 841 | 11 | 69754380 | 69760985 | 6605 | loss | 670 | | N | 25 | 4 | 0.04237816 | 0.34 | stats_biology | YES |
| 842 | 11 | 69754380 | 69760985 | 6605 | loss | 721 | | N | 25 | 4 | 0.04237816 | 0.34 | stats_biology | YES |
| 843 | 11 | 69754380 | 69760985 | 6605 | loss | 767 | | N | 25 | 4 | 0.04237816 | 0.34 | stats_biology | YES |
| 844 | 11 | 69754380 | 69760985 | 6605 | loss | 787 | | N | 25 | 4 | 0.04237816 | 0.34 | stats_biology | YES |
| 845 | 11 | 69754380 | 69760985 | 6605 | loss | 790 | | N | 25 | 4 | 0.04237816 | 0.34 | stats_biology | YES |
| 846 | 11 | 69754380 | 69760985 | 6605 | loss | 847 | | N | 25 | 4 | 0.04237816 | 0.34 | stats_biology | YES |
| 847 | 11 | 69754380 | 69760985 | 6605 | loss | 852 | | N | 25 | 4 | 0.04237816 | 0.34 | stats_biology | YES |
| 848 | 11 | 69754380 | 69760985 | 6605 | loss | 883 | | N | 25 | 4 | 0.04237816 | 0.34 | stats_biology | YES |
| 849 | 11 | 69754380 | 69760985 | 6605 | loss | 887 | | N | 25 | 4 | 0.04237816 | 0.34 | stats_biology | YES |
| 850 | 11 | 69754380 | 69760985 | 6605 | loss | 1209 | | N | 25 | 4 | 0.04237816 | 0.34 | stats_biology | YES |
| 851 | 11 | 69754380 | 69760985 | 6605 | loss | 1217 | | N | 25 | 4 | 0.04237816 | 0.34 | stats_biology | YES |
| 852 | 11 | 69754380 | 69760985 | 6605 | loss | 1219 | | N | 25 | 4 | 0.04237816 | 0.34 | stats_biology | YES |
| 853 | 11 | 69754380 | 69760985 | 6605 | loss | 2417 | | N | 25 | 4 | 0.04237816 | 0.34 | stats_biology | YES |
| 854 | 11 | 69754380 | 69760985 | 6605 | loss | 2438 | | N | 25 | 4 | 0.04237816 | 0.34 | stats_biology | YES |
| 855 | 11 | 69754380 | 69760985 | 6605 | loss | 2626 | | N | 25 | 4 | 0.04237816 | 0.34 | stats_biology | YES |
| 856 | 11 | 69754380 | 69760985 | 6605 | loss | 2645 | | N | 25 | 4 | 0.04237816 | 0.34 | stats_biology | YES |
| 857 | 11 | 125741939 | 125751054 | 9115 | gain | 276 | ST3GAL4 | N | 6 | 0 | 0.18539909 | 0.16 | biology | YES |
| 858 | 11 | 125741939 | 125751054 | 9115 | gain | 350 | ST3GAL4 | N | 6 | 0 | 0.18539909 | 0.16 | biology | YES |

Figure 9D (Continued)

| Figure 9D | | | | | | | | | | | | | | |
|---|---|---|---|---|---|---|---|---|---|---|---|---|---|---|
| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_ca_ses | FET | OR | Category | PV |
| 859 | 11 | 125741939 | 125751054 | 9115 | gain | 708 | ST3GAL4 | N | 6 | 0 | 0.18539909 | 0.16 | biology | YES |
| 860 | 11 | 125741939 | 125751054 | 9115 | gain | 721 | ST3GAL4 | N | 6 | 0 | 0.18539909 | 0.16 | biology | YES |
| 861 | 11 | 125741939 | 125751054 | 9115 | gain | 751 | ST3GAL4 | N | 6 | 0 | 0.18539909 | 0.16 | biology | YES |
| 862 | 11 | 125741939 | 125751054 | 9115 | gain | 924 | ST3GAL4 | N | 6 | 0 | 0.18539909 | 0.16 | biology | YES |
| 863 | 11 | 129500616 | 129544906 | 44290 | gain | 2581 | APLP2,ST14 | Y | 0 | 1 | 0.10124937 | 6.45 | biology | |
| 864 | 12 | 99462740 | 99468590 | 5850 | loss | 8 | NR1H4 | N | 9 | 0 | 0.3613397 | 0.11 | stats_biology | YES |
| 865 | 12 | 99462740 | 99468590 | 5850 | loss | 914 | NR1H4 | N | 9 | 0 | 0.3613397 | 0.11 | stats_biology | YES |
| 866 | 12 | 99462740 | 99468590 | 5850 | loss | | NR1H4 | N | 9 | 0 | 0.3613397 | 0.11 | stats_biology | YES |
| 867 | 12 | 99462740 | 99468590 | 5850 | loss | | NR1H4 | N | 9 | 0 | 0.3613397 | 0.11 | stats_biology | YES |
| 868 | 12 | 99462740 | 99468590 | 5850 | loss | | NR1H4 | N | 9 | 0 | 0.3613397 | 0.11 | stats_biology | YES |
| 869 | 12 | 99462740 | 99468590 | 5850 | loss | 920 | NR1H4 | N | 9 | 0 | 0.3613397 | 0.11 | stats_biology | YES |
| 870 | 12 | 99462740 | 99468590 | 5850 | loss | | NR1H4 | N | 9 | 0 | 0.3613397 | 0.11 | stats_biology | YES |
| 871 | 12 | 99462740 | 99468590 | 5850 | loss | | NR1H4 | N | 9 | 0 | 0.3613397 | 0.11 | stats_biology | YES |
| 872 | 12 | 99462740 | 99468590 | 5850 | loss | 1163 | NR1H4 | N | 9 | 0 | 0.3613397 | 0.11 | stats_biology | YES |
| 873 | 13 | 49475817 | 49964838 | 489021 | loss | 2615 | DLEU1,DLEU2,KCNRG,MIR15A,MIR16-1,ST13P4,TRIM13 | Y | 0 | 1 | 0.10124937 | 6.45 | biology | |

Figure 9D (Continued)

| Figure 9D | | | | | | | | | | | | | |
|---|---|---|---|---|---|---|---|---|---|---|---|---|---|
| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NVE_-cases | PD_-cases | FET | OR | Category | PV |
| 8874 | 15 | 51761901 | 51763629 | 1728 | loss | 138 | WDR72 | N | 9 | 0 | 0.03613397 | 011 | stats_biology | YES |
| 8875 | 15 | 51761901 | 51763629 | 1728 | loss | 339 | WDR72 | N | 9 | 0 | 0.03613397 | 011 | stats_biology | YES |
| 8876 | 15 | 51761901 | 51763629 | 1728 | loss | 383 | WDR72 | N | 9 | 0 | 0.03613397 | 011 | stats_biology | YES |
| 8877 | 15 | 51761901 | 51763629 | 1728 | loss | 419 | WDR72 | N | 9 | 0 | 0.03613397 | 011 | stats_biology | YES |
| 8878 | 15 | 51761901 | 51763629 | 1728 | loss | 593 | WDR72 | N | 9 | 0 | 0.03613397 | 011 | stats_biology | YES |
| 8879 | 15 | 51761901 | 51763629 | 1728 | loss | 643 | WDR72 | N | 9 | 0 | 0.03613397 | 011 | stats_biology | YES |
| 8880 | 15 | 51761901 | 51763629 | 1728 | loss | 681 | WDR72 | N | 9 | 0 | 0.03613397 | 011 | stats_biology | YES |
| 8881 | 15 | 51761901 | 51763629 | 1728 | loss | 1190 | WDR72 | N | 9 | 0 | 0.03613397 | 011 | stats_biology | YES |
| 8882 | 15 | 51761901 | 51763629 | 1728 | loss | 1204 | WDR72 | N | 9 | 0 | 0.03613397 | 011 | stats_biology | YES |
| 8883 | 15 | 55454821 | 55474767 | 19946 | gain | 26 | CGNL1 | Y | 8 | 0 | 0.06166361 | 0.13 | biology | YES |
| 8884 | 15 | 55454821 | 55474767 | 19946 | gain | 164 | CGNL1 | Y | 8 | 0 | 0.06166361 | 0.13 | biology | YES |
| 8885 | 15 | 55454821 | 55474767 | 19946 | gain | 185 | CGNL1 | Y | 8 | 0 | 0.06166361 | 0.13 | biology | YES |
| 8886 | 15 | 55454821 | 55474767 | 19946 | gain | 594 | CGNL1 | Y | 8 | 0 | 0.06166361 | 0.13 | biology | YES |
| 8887 | 15 | 55454821 | 55474767 | 19946 | gain | 731 | CGNL1 | Y | 8 | 0 | 0.06166361 | 0.13 | biology | YES |
| 8888 | 15 | 55454821 | 55474767 | 19946 | gain | 736 | CGNL1 | Y | 8 | 0 | 0.06166361 | 0.13 | biology | YES |
| 8889 | 15 | 55454821 | 55474767 | 19946 | gain | 751 | CGNL1 | Y | 8 | 0 | 0.06166361 | 0.13 | biology | YES |
| 8890 | 15 | 55454821 | 55474767 | 19946 | gain | 855 | CGNL1 | Y | 8 | 0 | 0.06166361 | 0.13 | biology | YES |
| 8891 | 19 | 61436857 | 61445887 | 9030 | gain | 2054 | | N | 0 | 3 | 0.01019189 | 15.12 | stats_biology | |
| 8892 | 19 | 61436857 | 61445887 | 9030 | gain | 2318 | | N | 0 | 3 | 0.01019189 | 15.12 | stats_biology | |
| 8893 | 19 | 61436857 | 61445887 | 9030 | gain | 2462 | | N | 0 | 3 | 0.01019189 | 15.12 | stats_biology | |
| 8894 | 19 | 61455201 | 61500757 | 45556 | loss | 2547 | | N | 0 | 1 | 0.10124937 | 6.45 | biology | |
| 8895 | 20 | 24366891 | 24373694 | 6803 | gain | 169 | | N | 7 | 0 | 0.06166361 | 0.14 | biology | YES |
| 8896 | 20 | 24366891 | 24373694 | 6803 | gain | 260 | | N | 7 | 0 | 0.06166361 | 0.14 | biology | YES |
| 8897 | 20 | 24366891 | 24373694 | 6803 | gain | 305 | | N | 7 | 0 | 0.06166361 | 0.14 | biology | YES |

| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV_E_cases | PD_cases | FET | OR | Category | PV |
|---|---|---|---|---|---|---|---|---|---|---|---|---|---|---|
| 898 | 20 | 24366891 | 24373694 | 6803 | gain | 361 | | N | 7 | 0 | 0.06166361 | 0.14 | biology | YES |
| 899 | 20 | 24366891 | 24373694 | 6803 | gain | 843 | | N | 7 | 0 | 0.06166361 | 0.14 | biology | YES |
| 900 | 20 | 24366891 | 24373694 | 6803 | gain | 880 | | N | 7 | 0 | 0.06166361 | 0.14 | biology | YES |
| 901 | 20 | 24366891 | 24373694 | 6803 | gain | 887 | | N | 7 | 0 | 0.06166361 | 0.14 | biology | YES |
| 902 | 22 | 20647851 | 20797301 | 149450 | gain | 39 | TOP3B | Y | 12 | 1 | 0.07368008 | 0.18 | biology | YES |
| 903 | 22 | 20647851 | 20797301 | 149450 | gain | 59 | TOP3B | Y | 12 | 1 | 0.07368008 | 0.18 | biology | YES |
| 904 | 22 | 20647851 | 20797301 | 149450 | gain | 131 | TOP3B | Y | 12 | 1 | 0.07368008 | 0.18 | biology | YES |
| 905 | 22 | 20647851 | 20797301 | 149450 | loss | 213 | TOP3B | Y | 12 | 1 | 0.07368008 | 0.18 | biology | YES |
| 906 | 22 | 20647851 | 20797301 | 149450 | gain | 347 | TOP3B | Y | 12 | 1 | 0.07368008 | 0.18 | biology | YES |
| 907 | 22 | 20647851 | 20797301 | 149450 | loss | 435 | TOP3B | Y | 12 | 1 | 0.07368008 | 0.18 | biology | YES |
| 908 | 22 | 20647851 | 20797301 | 149450 | gain | 571 | TOP3B | Y | 12 | 1 | 0.07368008 | 0.18 | biology | YES |
| 909 | 22 | 20647851 | 20797301 | 149450 | gain | 581 | TOP3B | Y | 12 | 1 | 0.07368008 | 0.18 | biology | YES |
| 910 | 22 | 20647851 | 20797301 | 149450 | gain | 709 | TOP3B | Y | 12 | 1 | 0.07368008 | 0.18 | biology | YES |
| 911 | 22 | 20647851 | 20797301 | 149450 | loss | 756 | TOP3B | Y | 12 | 1 | 0.07368008 | 0.18 | biology | YES |
| 912 | 22 | 20647851 | 20797301 | 149450 | loss | 857 | TOP3B | Y | 12 | 1 | 0.07368008 | 0.18 | biology | YES |
| 913 | 22 | 20647851 | 20797301 | 149450 | loss | 1180 | TOP3B | Y | 12 | 1 | 0.07368008 | 0.18 | biology | YES |
| 914 | 22 | 20647851 | 20797301 | 149450 | loss | 2625 | TOP3B | Y | 12 | 1 | 0.07368008 | 0.18 | biology | YES |
| 915 | 22 | 31759670 | 31764719 | 5049 | loss | 2628 | SYN3 | N | 0 | 1 | 0.10124937 | 6.45 | biology | |
| 916 | 22 | 31790222 | 31796114 | 5892 | loss | 2219 | | N | 0 | 2 | 0.10066129 | 10.78 | biology | |
| 917 | 22 | 31790222 | 31796114 | 5892 | loss | 2588 | | N | 0 | 2 | 0.10066129 | 10.78 | biology | |
| 918 | 23 | 129493185 | 130000884 | 507699 | gain | 2634 | ENOX2 | Y | 0 | 1 | 0.10124937 | 6.45 | biology | |
| 919 | 23 | 151404321 | 151407087 | 2766 | loss | 559 | | N | 1 | 3 | 0.09742503 | 6.48 | biology | |
| 920 | 23 | 151404321 | 151407087 | 2766 | loss | 2197 | | N | 1 | 3 | 0.09742503 | 6.48 | biology | |
| 921 | 23 | 151404321 | 151407087 | 2766 | loss | 2268 | | N | 1 | 3 | 0.09742503 | 6.48 | biology | |

| Figure 9D | | | | | | | | | | | | | |
|---|---|---|---|---|---|---|---|---|---|---|---|---|---|
| SRN | Chromosome | CNV_Subregion_Start | CNV_Subregion_Stop | CNV_Subregion_Size | CNV_Type | PD_Case_ID(s) | RefSeq_Gene_Symbol | Exon_overlap | NV E-cases | PD-cases | FET | OR | Category | PV |
| 922 | 23 | 15140 4321 | 15140 7087 | 2766 | loss | 2430 | | N | 1 | 3 | 0.0974250 3 | 6.48 | biology | |

Figure 9D (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| 1 | AAAS | exonic | 8086 | aladin isoform 1 | The protein encoded by this gene is a member of the WD-repeat family of regulatory proteins and may be involved in normal development of the peripheral and central nervous system. The encoded protein is part of the nuclear pore complex and is anchored there by NDC1. Defects in this gene are a cause of achalasia-addisonianism-alacrima syndrome (AAAS), also called triple-A syndrome or Allgrove syndrome. Two transcript variants encoding different isoforms have been found for this gene. [provided by RefSeq, Mar 2010]. Transcript Variant: This variant (1) represents the longer transcript and encodes the longer isoform (1). Publication Note: This RefSeq record includes a subset of the publications that are available for this gene. Please see the Gene record to access additional publications. ##Evidence-Data-START## Transcript exon combination :: BC000659.2, AF226048.1 [ECO:0000332] RNAseq introns :: mixed/partial sample support ERS025081, ERS025082 NCO:0000350] ##Evidence-Data-END## |
| 2 | ABCB9 | exonic | 23457 | ATP-binding cassette sub-family B member 9 isoform 1 | The membrane-associated protein encoded by this gene is a member of the superfamily of ATP-binding cassette (ABC) transporters. ABC proteins transport various molecules across extra- and intra-cellular membranes. ABC genes are divided into seven distinct subfamilies (ABC1, MDR/TAP, MRP, ALD, OABP, GCN20, White). This protein is a member of the MDR/TAP subfamily. Members of the MDR/TAP subfamily are involved in multidrug resistance as well as antigen presentation. This family member functions in the translocation of peptides from the cytosol into the lysosomal lumen. Alternative splicing of this gene results in distinct isoforms which are likely to have different substrate specificities. [provided by RefSeq, Jul 2011). Transcript Variant: This variant (1, also known as 12A) represents the longest transcript and encodes the longest isoform (1). Publication Note: This RefSeq record includes a subset of the publications that are available for this gene. Please see the Gene record to access additional publications. ##Evidence-Data-START## Transcript exon combination :: AF216494.1, AB177852.1 [ECO:0000332] RNAseq introns :: mixed/partial sample support ERS025081, ERS025082 [ECO:0000350] ##Evidence-Data-END## |
| 3 | ACAD | exonic | 80724 | acyl-CoA | This gene encodes a member of the acyl-CoA |

Figure 10A (Continued)

| Figure 10A | | | | | |
|---|---|---|---|---|---|
| Gene Numb er (GN) | RefSeq Gene Symbol | Exon _overl ap | NCBI_ Gene_I D | Gene_Description | RefSeq_Summary |
| | | 10 | c | dehydrogenase family member 10 isoform a | dehydrogenase family of enzymes (ACADs), which participate in the beta-oxidation of fatty acids in mitochondria. The encoded enzyme contains a hydrolase domain at the N-terminal portion, a serine/threonine protein kinase catlytic domain in the central region, and a conserved ACAD domain at the C-terminus. Several alternatively spliced transcript variants of this gene have been described, but the full-length nature of some of these variants has not been determined. [provided by RefSeq, Nov 2008]. Transcript Variant: This variant (1) represents the longest transcript and encodes the longest isoform (a). ##Evidence-Data-START## Transcript exon combination :: AL832043.1 [ECO:0000332] RNAseq introns :: mixed/partial sample support ERS025081, ERS025082 [ECO:0000350] ##Evidence-Data-END## |
| 4 | ACE2 | exoni c | 59272 | angiotensin-converting enzyme 2 precursor | The protein encoded by this gene belongs to the angiotensin-converting enzyme family of dipeptidyl carboxydipeptidases and has considerable homology to human angiotensin 1 converting enzyme. This secreted protein catalyzes the cleavage of angiotensin I into angiotensin 1-9, and angiotensin II into the vasodilator angiotensin 1-7. The organ- and cell-specific expression of this gene suggests that it may play a role in the regulation of cardiovascular and renal function, as well as fertility. In addition, the encoded protein is a functional receptor for the spike glycoprotein of the human coronaviruses SARS and HCoV-NL63. [provided by RefSeq, Jul 2008]. Publication Note: This RefSeq record includes a subset of the publications that are available for this gene. Please see the Gene record to access additional publications. ##Evidence-Data-START## Transcript exon combination :: AB193259.1, AK315144.1 [ECO:0000332] RNAseq introns :: single sample supports all introns ERS025083 [ECO:0000348] ##Evidence-Data-END## |
| 5 | ACTR1 B | exoni c | 10120 | beta-centractin | This gene encodes a 42.3 kD subunit of dynactin, a macromolecular complex consisting of 10 subunits ranging in size from 22 to 150 kD. Dynactin binds to both microtubules and cytoplasmic dynein and is involved in a diverse array of cellular functions, including ER-to-Golgi transport, the centripetal movement of lysosomes and endosomes, spindle formation, chromosome movement, nuclear positioning, and axonogenesis. This subunit, like ACTR1A, is an actin-related protein. These two proteins, which are of equal length and share 90% amino acid identity, are present in a constant ratio |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | of approximately 1:15 in the dynactin complex. [provided by RefSeq, Aug 2008]. ##Evidence-Data-START## Transcript exon combination :: BC010090.2, X82207.1 [ECO:0000332] RNAseq introns :: mixed/partial sample support ERS025081, ERS025082 [ECO:0000350] ##Evidence-Data-END## |
| 6 | ACY3 | exonic | 91703 | aspartoacylase-2 | N/A |
| 7 | ADAM 29 | exonic | 11086 | disintegrin and metalloproteinase domain-containing protein 29 preproprotein | This gene encodes a member of the ADAM (a disintegrin and metalloprotease domain) family. Members of this family are membrane-anchored proteins structurally related to snake venom disintegrins, and have been implicated in a variety of biological processes involving cell-cell and cell-matrix interactions, including fertilization, muscle development, and neurogenesis. The protein encoded by this gene is highly expressed in testis and may be involved in human spermatogenesis. Alternative splicing results in multiple transcript variants that encode the same protein. [provided by RefSeq, Jul 2008]. Transcript Variant: This variant (1) encodes the functional protein. Variants 1, 2, 3, 4, 5, 6, and 7 encode the same protein. ##Evidence-Data-START## Transcript exon combination :: CD625430.1, CD625433.1 [ECO:0000332] RNAseq introns :: single sample supports all introns ERS025085 [ECO:0000348] ##Evidence-Data-END## |
| 8 | ALDH 2 | exonic | 217 | aldehyde dehydrogenase, mitochondrial isoform 1 precursor | This protein belongs to the aldehyde dehydrogenase family of proteins. Aldehyde dehydrogenase is the second enzyme of the major oxidative pathway of alcohol metabolism. Two major liver isoforms of aldehyde dehydrogenase, cytosolic and mitochondrial, can be distinguished by their electrophoretic mobilities, kinetic properties, and subcellular localizations. Most Caucasians have two major isozymes, while approximately 50% of Orientals have the cytosolic isozyme but not the mitochondrial isozyme. A remarkably higher frequency of acute alcohol intoxication among Orientals than among Caucasians could be related to the absence of a catalytically active form of the mitochondrial isozyme. The increased exposure to acetaldehyde in individuals with the catalytically inactive form may also confer greater susceptibility to many types of cancer. This gene encodes a mitochondrial isoform, which has a low Km for acetaldehydes, and is localized in mitochondrial matrix. Alternative splicing results in multiple transcript variants encoding distinct |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | isoforms.[provided by RefSeq, Mar 2011]. Transcript Variant: This variant (1) represents the longer transcript and encodes the longer isoform (1). Publication Note: This RefSeq record includes a subset of the publications that are available for this gene. Please see the Gene record to access additional publications. ##Evidence-Data-START## Transcript exon combination :: BC002967.1, AY621070.1 [ECO:0000332] RNAseq introns single sample supports all introns ERS025081, ERS025082 [ECO:0000348] ##Evidence-Data-END## ##RefSeq-Attributes-START## gene product(s) localized to mito. :: reported by MitoCarta ##RefSeq-Attributes-END## |
| 9 | ALDH 3B2 | exoni c | 222 | aldehyde dehydrogenase family 3 member B2 | This gene encodes a member of the aldehyde dehydrogenase family, a group of isozymes that may play a major role in the detoxification of aldehydes generated by alcohol metabolism and lipid peroxidation. The gene of this particular family member is over 10 kb in length. The expression of these transcripts is restricted to the salivary gland among the human tissues examined. Alternate transcriptional splice variants have been characterized. [provided by RefSeq, Jul 2008]. Transcript Variant: This variant (1) represents the longer transcript. Variants 1 and 2 encode the same protein. ##Evidence-Data-START## CDS exon combination :: BC007685.2, AK092464.1 [ECO:0000331] RNAseq introns :: mixed/partial sample support ERS025084 [ECO:0000350] ##Evidence-Data-END## |
| 10 | ANKR D11 | both | 29123 | ankyrin repeat domain-containing protein 11 | This locus encodes an ankryin repeat domain-containing protein. The encoded protein inhibits ligand-dependent activation of transcription. Mutations in this gene have been associated with KBG syndrome, which is characterized by macrodontia, distinctive craniofacial features, short stature, skeletal anomalies, global developmental delay, seizures and intellectual disability. Alternatively spliced transcript variants have been described. Related pseudogenes exist on chromosomes 2 and X. [provided by RefSeq, Jan 2012]. Transcript Variant: This variant (1) represents the longest transcript. Variants 1, 2 and 3 encode the same protein. ##Evidence-Data-START## Transcript exon combination :: AY533563.1 [ECO:0000332] RNAseq introns :: single sample supports all introns ERS025084, ERS025088 [ECO:0000348] ##Evidence-Data-END## |
| 11 | ANKR | exoni | 284615 | ankyrin repeat | N/A |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | D34A | c | | domain-containing protein 34A | |
| 12 | ANKR D35 | exoni c | 148741 | ankyrin repeat domain-containing protein 35 isoform 1 | N/A |
| 13 | ANKR D36B | exoni c | 57730 | ankyrin repeat domain-containing protein 36B | N/A |
| 14 | APBA2 | exoni c | 321 | amyloid beta A4 precursor protein-binding family A member 2 isoform a | The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is believed to be involved in signal transduction processes. It is also regarded as a putative vesicular trafficking protein in the brain that can form a complex with the potential to couple synaptic vesicle exocytosis to neuronal cell adhesion. Multiple transcript variants encoding different isoforms have been found for this gene. [provided by RefSeq, Jul 2008]. Transcript Variant: This variant (1) represents the longest transcript and encodes the longest isoform (a). Publication Note: This RefSeq record includes a subset of the publications that are available for this gene. Please see the Gene record to access additional publications. ##Evidence-Data-START## Transcript exon combination :: AF047348.1 [ECO:0000332] RNAseq introns :: single sample supports all introns ERS025082 [ECO:0000348] ##Evidence-Data-END### |
| 15 | ARGF X | exoni c | 503582 | arginine-fifty homeobox | Homeobox genes encode DNA-binding proteins, many of which are thought to be involved in early embryonic development. Homeobox genes encode a DNA-binding domain of 60 to 63 amino acids referred to as the homeodomain. This gene is a member of the ARGFX homeobox gene family. [provided by RefSeq, Jul 2008]. |
| 16 | ARHG AP11A | exoni c | 9824 | rho GTPase-activating protein 11A isoform 1 | N/A |
| 17 | ARRB 1 | exoni c | 408 | beta-arrestin-1 isoform A | Members of arrestin/beta-arrestin protein family are thought to participate in agonist-mediated desensitization of G-protein-coupled receptors and cause specific dampening of cellular responses to stimuli such as hormones, neurotransmitters, or sensory signals. Arrestin beta 1 is a cytosolic |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | protein and acts as a cofactor in the beta-adrenergic receptor kinase (BARK) mediated desensitization of beta-adrenergic receptors. Besides the central nervous system, it is expressed at high levels in peripheral blood leukocytes, and thus the BARK/beta-arrestin system is believed to play a major role in regulating receptor-mediated immune functions. Alternatively spliced transcripts encoding different isoforms of arrestin beta 1 have been described. [provided by RefSeq, Jan 2011]. Transcript Variant: This variant (1) represents the longer transcript variant and encodes the longer isoform (A). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: BC003636.2, AK289718.1 [ECO:0000332] RNAseq introns :: mixed/partial sample support ERS025081, ERS025082 [ECO:0000350] ##Evidence-Data-END## |
| 18 | ARSB | intron ic | 411 | arylsulfatase B isoform 1 precursor | Arylsulfatase B encoded by this gene belongs to the sulfatase family. The arylsulfatase B homodimer hydrolyzes sulfate groups of N-Acetyl-D-galactosamine, chondriotin sulfate, and dermatan sulfate. The protein is targetted to the lysozyme. Mucopolysaccharidosis type VI is an autosomal recessive lysosomal storage disorder resulting from a deficiency of arylsulfatase B. Two alternatively spliced transcript variants encoding distinct isoforms have been found for this gene. [provided by RefSeq, Jul 2008]. Transcript Variant: This variant (1) encodes the longer isoform (1). Sequence Note: This RefSeq record was created from transcript and genomic sequence data because transcript sequence consistent with the reference genome assembly was not available for all regions of the RefSeq transcript. The extent of this transcript is supported by transcript alignments. Publication Note: This RefSeq record includes a subset of the publications that are available for this gene. Please see the Gene record to access additional publications. ##Evidence-Data-START## Transcript exon combination :: M32373.1, J05225.1 [ECO:0000332] RNAseq |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | introns :: single sample supports all introns ERS025088 [ECO:0000348] ##Evidence-Data-END## |
| 19 | ATG7 | intron ic | 10533 | ubiquitin-like modifier-activating enzyme ATG7 isoform a | This gene was identified based on homology to Pichia pastoris GSA7 and Saccharomyces cerevisiae APG7. In the yeast, the protein appears to be required for fusion of peroxisomal and vacuolar membranes. The protein shows homology to the ATP-binding and catalytic sites of the E1 ubiquitin activating enzymes. [provided by RefSeq, Jan 2009]. Transcript Variant: This variant (1) represents the longest transcript and encodes the longest isoform (a). Publication Note: This RefSeq record includes a subset of the publications that are available for this gene. Please see the Gene record to access additional publications. ##Evidence-Data-START## Transcript exon combination :: AK075221.1 [ECO:0000332] RNAseq introns :: single sample supports all introns ERS025081, ERS025085 [ECO:0000348] ##Evidence-Data-END## |
| 20 | ATG16 L1 | exoni c | 55054 | autophagy-related protein 16-1 isoform 1 | The protein encoded by this gene is part of a large protein complex that is necessary for autophagy, the major process by which intracellular components are targeted to lysosomes for degradation. Defects in this gene are a cause of susceptibility to inflammatory bowel disease type 10 (IBD10). Several transcript variants encoding different isoforms have been found for this gene.[provided by RefSeq, Jun 2010]. Transcript Variant: This variant (1) encodes the longest isoform (1). Publication Note: This RefSeq record includes a subset of the publications that are available for this gene. Please see the Gene record to access additional publications. ##Evidence-Data-START## Transcript exon combination :: AY398617.1, BC117337.1 [ECO:0000332] RNAseq introns :: single sample supports all introns ERS025081, ERS025082 [ECO:0000348] ##Evidence-Data-END## |
| 21 | BCL2L 1 | exoni c | 598 | bcl-2-like protein 1 isoform 1 | The protein encoded by this gene belongs to the BCL-2 protein family. BCL-2 family members form hetero- or homodimers and act as anti- or pro-apoptotic regulators that are involved in a wide variety of cellular activities. The proteins encoded by this gene are located at the outer mitochondrial membrane, and have been shown to regulate outer mitochondrial membrane channel (VDAC) opening. VDAC regulates mitochondrial membrane potential, and thus controls the production of reactive oxygen species and release of cytochrome |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | C by mitochondria, both of which are the potent inducers of cell apoptosis. Two alternatively spliced transcript variants, which encode distinct isoforms, have been reported. The longer isoform acts as an apoptotic inhibitor and the shorter form acts as an apoptotic activator. [provided by RefSeq, Jul 2008]. Transcript Variant: This variant (1) is also known as bcl-xL. It encodes a longer isoform (1). Publication Note: This RefSeq record includes a subset of the publications that are available for this gene. Please see the Gene record to access additional publications. ##Evidence-Data-START## Transcript exon combination :: BC019307.1, B0927754.1 [ECO:0000332] RNAseq introns single sample supports all introns ERS025081, ERS025082 [ECO:0000348] ##Evidence-Data-END## ##RefSeq-Attributes-START## gene product(s) localized to mito. :: inferred from homology ##RefSeq-Attributes-END## |
| 22 | BMX | exoni c | 660 | cytoplasmic tyrosine-protein kinase BMX | This gene encodes a non-receptor tyrosine kinase belonging to the Tec kinase family. The protein contains a PH-like domain, which mediates membrane targeting by binding to phosphatidylinositol 3,4,5-triphosphate (PIP3), and a SH2 domain that binds to tyrosine-phosphorylated proteins and functions in signal transduction. The protein is implicated in several signal transduction pathways including the Stat pathway, and regulates differentiation and tumorigenicity of several types of cancer cells. Multiple alternatively spliced variants, encoding the same protein, have been identified.[provided by RefSeq, Sep 2009]. Transcript Variant: This variant (1) is the longer transcript. Publication Note: This RefSeq record includes a subset of the publications that are available for this gene. Please see the Gene record to access additional publications. ##Evidence-Data-START## Transcript exon combination :: AK291824.1, X83107.1 [ECO:0000332] RNAseq introns :: single sample supports all introns ERS025081, ERS025084 [ECO:0000348] ##Evidence-Data-END## |
| 23 | BUB1 B | exoni c | 701 | mitotic checkpoint serine/threonine- protein kinase BUB1 beta | This gene encodes a kinase involved in spindle checkpoint function. The protein has been localized to the kinetochore and plays a role in the inhibition of the anaphase-promoting complex/cyclosome (APC/C), delaying the onset of anaphase and ensuring proper chromosome segregation. Impaired spindle checkpoint function has been found in many forms of cancer. [provided by RefSeq, Jul 2008]. Publication Note: This RefSeq record includes a |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | subset of the publications that are available for this gene. Please see the Gene record to access additional publications. ##Evidence-Data-START## Transcript exon combination :: AF053306.1, AB208782.1 [ECO:0000332] RNAseq introns :: single sample supports all introns ERS025085 [ECO:0000348] ##Evidence-Data-END## |
| 24 | C1QTNF4 | exonic | 114900 | complement C1q tumor necrosis factor-related protein 4 precursor | N/A |
| 25 | C5orf46 | exonic | 389336 | uncharacterized protein C5orf46 precursor | N/A |
| 26 | C7orf63 | exonic | 79846 | uncharacterized protein C7orf63 isoform 1 | N/A |
| 27 | C11orf82 | exonic | 220042 | nitric oxide-inducible gene protein | N/A |
| 28 | C12orf10 | exonic | 60314 | UPF0160 protein MYG1, mitochondrial precursor | N/A |
| 29 | C21orf59 | exonic | 56683 | N/A | N/A |
| 30 | CA5B | exonic | 11238 | carbonic anhydrase 5B, mitochondrial precursor | Carbonic anhydrases (CAs) are a large family of zinc metalloenzymes that catalyze the reversible hydration of carbon dioxide. They participate in a variety of biological processes, including respiration, calcification, acid-base balance, bone resorption, and the formation of aqueous humor, cerebrospinal fluid, saliva, and gastric acid. They show extensive diversity in tissue distribution and in their subcellular localization. CA VB is localized in the mitochondria and shows the highest sequence similarity to the other mitochondrial CA, CA VA. It has a wider tissue distribution than CA VA, which is restricted to the liver. The differences in tissue distribution suggest that the two mitochondrial carbonic anhydrases evolved to assume different physiologic roles. [provided by RefSeq, Jul 2008]. ##RefSeq-Attributes-START## gene product(s) localized to mito. :: reported by MitoCarta ##RefSeq-Attributes-END## ##Evidence-Data-START## Transcript exon combination :: AK291050.1, AB021660.1 [ECO:0000332] RNAseq introns :: single sample supports all introns ERS025081, ERS025082 [ECO:0000348] |

Figure 10A (Continued)

| Figure 10A | | | | | |
|---|---|---|---|---|---|
| Gene Number (GN) | RefSeq Gene Symbol | Exon _overlap | NCBI_ Gene_ID | Gene_Description | RefSeq_Summary |
| | | | | | ##Evidence-Data-END## |
| 31 | CACN A1C | intronic | 775 | voltage-dependent L-type calcium channel subunit alpha-1C isoform 1 | This gene encodes an alpha-1 subunit of a voltage-dependent calcium channel. Calcium channels mediate the influx of calcium ions into the cell upon membrane polarization. The alpha-1 subunit consists of 24 transmembrane segments and forms the pore through which ions pass into the cell. The calcium channel consists of a complex of alpha-1, alpha-2/delta, beta, and gamma subunits in a 1:1:1:1 ratio. There are multiple isoforms of each of these proteins, either encoded by different genes or the result of alternative splicing of transcripts. The protein encoded by this gene binds to and is inhibited by dihydropyridine. Alternative splicing results in many transcript variants encoding different proteins. Some of the predicted proteins may not produce functional ion channel subunits. [provided by RefSeq, Oct 2012]. Transcript Variant: This variant (1), also referred to as HFCC, encodes the longest isoform (1). This isoform (1) is predicted to form a non-functional calcium channel subunit because it contains an aberrant number of transmembrane domains. Publication Note: This RefSeq record includes a subset of the publications that are available for this gene. Please see the Gene record to access additional publications. ##Evidence-Data-START## RNAseq introns :: mixed/partial sample support ERS025081, ERS025082 [ECO:0000350] ##Evidence-Data-END## |
| 32 | CADP S2 | intronic | 93664 | calcium-dependent secretion activator 2 isoform a | This gene encodes a member of the calcium-dependent activator of secretion (CAPS) protein family, which are calcium binding proteins that regulate the exocytosis of synaptic and dense-core vesicles in neurons and neuroendocrine cells. Mutations in this gene may contribute to autism susceptibility. Multiple transcript variants encoding different isoforms have been found for this gene. [provided by RefSeq, Nov 2009]. Transcript Variant: This variant (1) lacks an alternate in-frame exon and includes an alternate in-frame exon, compared to variant 3. The resulting isoform (a) differs in two regions and is shorter compared to isoform c. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: AY264289.1 [ECO:0000332] RNAseq introns :: mixed/partial sample support |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | ERS025081, ERS025082 [ECO:0000350] ##Evidence-Data-END## |
| 33 | CALCRL | intronic | 10203 | calcitonin gene-related peptide type 1 receptor precursor | N/A |
| 34 | CAPN2 | exonic | 824 | calpain-2 catalytic subunit isoform 1 | The calpains, calcium-activated neutral proteases, are nonlysosomal, intracellular cysteine proteases. The mammalian calpains include ubiquitous, stomach-specific, and muscle-specific proteins. The ubiquitous enzymes consist of heterodimers with distinct large, catalytic subunits associated with a common small, regulatory subunit. This gene encodes the large subunit of the ubiquitous enzyme, calpain 2. Multiple heterogeneous transcriptional start sites in the 5' UTR have been reported. Two transcript variants encoding different isoforms have been found for this gene. [provided by RefSeq, Mar 2009]. Transcript Variant: This variant (1) represents the longer transcript and encodes the longer isoform (1). Publication Note: This RefSeq record includes a subset of the publications that are available for this gene. Please see the Gene record to access additional publications. ##Evidence-Data-START## Transcript exon combination :: AF261089.1, M23254.1 [ECO:0000332] RNAseq introns :: single sample supports all introns ERS025081, ERS025082 [ECO:0000348] ##Evidence-Data-END## |
| 35 | CAPN8 | exonic | 388743 | calpain-8 | N/A |
| 36 | CARD6 | exonic | 84674 | caspase recruitment domain-containing protein 6 | This gene encodes a protein that contains a caspase recruitment domain (CARD), an antiparallel six-helical bundle that mediates homotypic protein-protein interactions. The encoded protein is a microtubule-associated protein that has been shown to interact with receptor-interacting protein kinases and positively modulate signal transduction pathways converging on activation of the inducible transcription factor NF-kB. [provided by RefSeq, Jul 2008]. ##Evidence-Data-START## Transcript exon combination :: AF356193.1, BC093825.1 [ECO:0000332] RNAseq introns :: single sample supports all introns ERS025081, ERS025083 [ECO:0000348] ##Evidence-Data-END## |
| 37 | CBFA2T3 | exonic | 863 | protein CBFA2T3 isoform 1 | This gene encodes a member of the myeloid translocation gene family which interact with DNA-bound transcription factors and recruit a range of corepressors to facilitate transcriptional repression. The t(16;21)(q24;q22) translocation is one of the less common karyotypic abnormalities in acute |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | myeloid leukemia. The translocation produces a chimeric gene made up of the 5'-region of the runt-related transcription factor 1 gene fused to the 3'-region of this gene. This gene is also a putative breast tumor suppressor. Alternative splicing results in transcript variants. [provided by RefSeq, Nov.2010]. Transcript Variant: This variant (1) represents the longer transcript, encodes the longer isoform (1) and is also known as MTG16a. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: AB010419.1, BC047019.1 [ECO:0000332] RNAseq introns :: mixed/partial sample support ERS025081, ER5025082 [ECO:0000350] ##Evidence-Data-END## |
| 38 | CBR3 | exonic | 874 | carbonyl reductase [NADPH] 3 | Carbonyl reductase 3 catalyzes the reduction of a large number of biologically and pharmacologically active carbonyl compounds to their corresponding alcohols. The enzyme is classified as a monomeric NADPH-dependent oxidoreductase. CBR3 contains three exons spanning 11.2 kilobases and is closely linked to another carbonyl reductase gene - CBR1. [provided by RefSeq, Jul 2008]. Publication Note: This RefSeq record includes a subset of the publications that are available for this gene. Please see the Gene record to access additional publications. ##Evidence-Data-START## Transcript exon combination :: BC002812.2, AB041012.1 [ECO:00003321 RNAseq introns :: single sample supports all introns ERS025081, ERS025082 [ECO:0000348] ##Evidence-Data-END## |
| 39 | CBR3-AS1 | exonic | 1005064 28 | N/A | N/A |
| 40 | CCDC 74B | exonic | 91409 | coiled-coil domain-containing protein 74B isoform 1 | N/A |
| 41 | CDC25 C | exonic | 995 | M-phase inducer phosphatase 3 isoform a | This gene is highly conserved during evolution and it plays a key role in the regulation of cell division. The encoded protein is a tyrosine phosphatase and belongs to the Cdc25 phosphatase family. It directs dephosphorylation of cyclin B-bound CDC2 and triggers entry into mitosis. It is also thought to |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | suppress p53-induced growth arrest. Multiple alternatively spliced transcript variants of this gene have been described, however, the full-length nature of many of them is not known. [provided by RefSeq, Jul 2008]. Transcript Variant: This variant (1) encodes the longer isoform (a). Publication Note: This RefSeq record includes a subset of the publications that are available for this gene. Please see the Gene record to access additional publications. ##Evidence-Data-START## Transcript exon combination :: M34065.1 [ECO:0000332] RNAseq introns :: single sample supports all introns ERS025085 [ECO:0000348] ##Evidence-Data-END## |
| 42 | CDCA7L | exonic | 55536 | cell division cycle-associated 7-like protein isoform 1 | N/A |
| 43 | CDH2 | both | 1000 | cadherin-2 preproprotein | This gene is a classical cadherin from the cadherin superfamily. The encoded protein is a calcium dependent cell-cell adhesion glycoprotein comprised of five extracellular cadherin repeats, a transmembrane region and a highly conserved cytoplasmic tail. The protein functions during gastrulation and is required for establishment of left-right asymmetry. At certain central nervous system synapses, presynaptic to postsynaptic adhesion is mediated at least in part by this gene product. [provided by RefSeq, Jul 2008]. Publication Note: This RefSeq record includes a subset of the publications that are available for this gene. Please see the Gene record to access additional publications. ##Evidence-Data-START## Transcript exon combination :: S42303.1, BC036470.1 [ECO:0000332] RNAseq introns :: single sample supports all introns ERS025088 [ECO:0000348]##Evidence-Data-END## |
| 44 | CDK14 | both | 5218 | cyclin-dependent kinase 14 | PFTK1 is a member of the CDC2 (MIM 116940)-related protein kinase family (Yang and Chen, 2001 [PubMed 11313143]).[supplied by OMIM, Mar 2008]. Publication Note: This RefSeq record includes a subset of the publications that are available for this gene. Please see the Gene record to access additional publications. ##Evidence-Data-START## Transcript exon combination :: AB020641.1, BC152436.1 [ECO:0000332] ##Evidence-Data-END## |
| 45 | CHST3 | exonic | 9469 | carbohydrate sulfotransferase 3 | This gene encodes an enzyme which catalyzes the sulfation of chondroitin, a proteoglycan found in the extracellular matrix and most cells which is involved in cell migration and differentiation. |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | Mutations in this gene are associated with spondylepiphyseal dysplasia and humerospinal dysostosis. [provided by RefSeq, Mar 2009]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: AB017915.1, A0012192.1 [ECO:0000332] RNAseq introns :: single sample supports all introns ERS025081, ERS025082 [ECO:0000348] ##Evidence-Data-END## |
| 46 | CINP | exonic | 51550 | cyclin-dependent kinase 2-interacting protein | The protein encoded by this gene is reported to be a component of the DNA replication complex as well as a genome-maintenance protein. It may interact with proteins important for replication initiation and has been shown to bind chromatin at the G1 phase of the cell cycle and dissociate from chromatin with replication initiation. It may also serve to regulate checkpoint signaling as part of the DNA damage response. [provided by RefSeq, Jul 2013]. ##Evidence-Data-START## Transcript exon combination :: BC000600.2, AF228149.1 [ECO:0000332] RNAseq introns :: single sample supports all introns ERS025088 [ECO:0000348] ##Evidence-Data-END## |
| 47 | CLDN14 | exonic | 23562 | claudin-14 | Tight junctions represent one mode of cell-to-cell adhesion in epithelial or endothelial cell sheets, forming continuous seals around cells and serving as a physical barrier to prevent solutes and water from passing freely through the paracellular space. These junctions are comprised of sets of continuous networking strands in the outwardly facing cytoplasmic leaflet, with complementary grooves in the inwardly facing extracytoplasmic leaflet. The protein encoded by this gene, a member of the claudin family, is an integral membrane protein and a component of tight junction strands. The encoded protein also binds specifically to the WW domain of Yes-associated protein. Defects in this gene are the cause of an autosomal recessive form of nonsyndromic sensorineural deafness. It is also reported that four synonymous variants in this gene are associated with kidney stones and reduced bone mineral density. Several transcript variants encoding the same protein have been found for this |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | gene. [provided by RefSeq, Jun 2010]. Transcript Variant: This variant (delta) differs in the 5' UTR compared to variant 1. All five variants encode the same protein. Publication Note: This RefSeq record includes a subset of the publications that are available for this gene. Please see the Gene record to access additional publications. ##Evidence-Data-START## Transcript exon combination :: AJ566766.1 [ECO:0000332] RNAseq introns :: mixed/partial sample support ERS025092 [ECO:0000350] ##Evidence-Data-END## |
| 48 | CLTCL 1 | exoni c | 8218 | clathrin heavy chain 2 isoform 1 | This gene is a member of the clathrin heavy chain family and encodes a major protein of the polyhedral coat of coated pits and vesicles. Chromosomal aberrations involving this gene are associated with meningioma, DiGeorge syndrome, and velo-cardio-facial syndrome. Multiple transcript variants encoding different isoforms have been found for this gene. [provided by RefSeq, Jun 2009]. Transcript Variant: This variant (1) represents the longer transcript and encodes the longer isoform (1). Publication Note: This RefSeq record includes a subset of the publications that are available for this gene. Please see the Gene record to access additional publications. ##Evidence-Data-START## Transcript exon combination :: U41763.1, X95486.1 [ECO:0000332] RNAseq introns :: mixed/partial sample support ERS025081, ERS025082 [ECO:0000350] ##Evidence-Data-END## |
| 49 | CNTN 6 | exoni c | 27255 | contactin-6 precursor | The protein encoded by this gene is a member of the immunoglobulin superfamily. It is a glycosylphosphatidylinositol (GPI)-anchored neuronal membrane protein that functions as a cell adhesion molecule. It may play a role in the formation of axon connections in the developing nervous system. [provided by RefSeq, Jul 2008]. ##Evidence-Data-START## Transcript exon combination :: AB003592.1 [ECO:0000332] RNAseq introns :: mixed/partial sample support ERS025082, ERS025084 [ECO:0000350] ##Evidence-Data-END## |
| 50 | COMM D1 | both | 150684 | COMM domain-containing protein | COMMD1 is a regulator of copper homeostasis, sodium uptake, and NF-kappa-B (see MIM 164011) signaling (de Bie et al., 2005 (PubMed 16267171)).[supplied by OMIM, Sep 2009]. Publication Note: This RefSeq record includes a subset of the publications that are available for this gene. Please see the Gene record to access additional publications. ##Evidence-Data-START## Transcript exon combination :: |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | BI831122.1, BC022046.1 [ECO:0000332] RNAseq introns :: single sample supports all introns ERS025081, ERS025082 [ECO:0000348] ##Evidence-Data-END## |
| 51 | COX4I 2 | exoni c | 84701 | cytochrome c oxidase subunit 4 isoform 2, mitochondria) | Cytochrome c oxidase (COX), the terminal enzyme of the mitochondrial respiratory chain, catalyzes the electron transfer from reduced cytochrome c to oxygen. It is a heteromeric complex consisting of 3 catalytic subunits encoded by mitochondrial genes and multiple structural subunits encoded by nuclear genes. The mitochondrially-encoded subunits function in electron transfer, and the nuclear-encoded subunits may be involved in the regulation and assembly of the complex. This nuclear gene encodes isoform 2 of subunit IV. Isoform 1 of subunit IV is encoded by a different gene, however, the two genes show a similar structural organization. Subunit IV is the largest nuclear encoded subunit which plays a pivotal role in COX regulation. [provided by RefSeq, Jul 2008]. Publication Note: This RefSeq record includes a subset of the publications that are available for this gene. Please see the Gene record to access additional publications. ##RefSeq-Attributes-START## gene product(s) localized to mito. :: reported by MitoCarta ##RefSeq-Attributes-END## ##Evidence-Data-START## Transcript exon combination :: AF257180.1, BC057779.1 [ECO:0000332] RNAseq introns :: single sample supports all introns ERS025083, ERS025084 [ECO:0000348] ##Evidence-Data-END## |
| 52 | COX5 B | exoni c | 1329 | cytochrome c oxidase subunit 5B, mitochondrial precursor | Cytochrome C oxidase (COX) is the terminal enzyme of the mitochondrial respiratory chain. It is a multi-subunit enzyme complex that couples the transfer of electrons from cytochrome c to molecular oxygen and contributes to a proton electrochemical gradient across the inner mitochondrial membrane. The complex consists of 13 mitochondrial- and nuclear-encoded subunits. The mitochondrially-encoded subunits perform the electron transfer and proton pumping activities. The functions of the nuclear-encoded subunits are unknown but they may play a role in the regulation and assembly of the complex. This gene encodes the nuclear-encoded subunit Vb of the human mitochondrial respiratory chain enzyme. [provided by RefSeq, Jul 2008]. Publication Note: This RefSeq record includes a subset of the publications that are available for this gene. Please see the Gene record to access additional publications: ##RefSeq-Attributes-START## gene product(s) localized to |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | mito. :: reported by MitoCarta ##RefSeq-Attributes-END## ##Evidence-Data-START## Transcript exon combination :: BC006229.2, CD174552.1 [ECO:0000332] RNAseq introns :: single sample supports all introns ERS025081, ERS025082 [ECO:0000348] ##Evidence-Data-END## |
| 53 | COX6 A1 | exoni c | 1337 | cytochrome c oxidase subunit 6A1, mitochondrial | Cytochrome c oxidase (COX), the terminal enzyme of the mitochondrial respiratory chain, catalyzes the electron transfer from reduced cytochrome c to oxygen. It is a heteromeric complex consisting of 3 catalytic subunits encoded by mitochondrial genes and multiple structural subunits encoded by nuclear genes. The mitochondrially-encoded subunits function in the electron transfer and the nuclear-encoded subunits may function in the regulation and assembly of the complex. This nuclear gene encodes polypeptide 1 (liver isoform) of subunit VIa, and polypeptide 1 is found in all non-muscle tissues. Polypeptide 2 (heart/muscle isoform) of subunit VIa is encoded by a different gene, and is present only in striated muscles. These two polypeptides share 66% amino acid sequence identity. It has been reported that there may be several pseudogenes on chromosomes 1, 6, 7q21, 7q31-32 and 12. However, only one pseudogene (COX6A1P) on chromosome 1p31.1 has been documented. [provided by RefSeq, Jul 2008]. Publication Note: This RefSeq record includes a subset of the publications that are available for this gene. Please see the Gene record to access additional publications. ##RefSeq-Attributes-START## gene product(s) localized to mito. reported by MitoCarta ##RefSeq-Attributes-END## ##Evidence-Data-START## Transcript exon combination :: BP378295.1, BP342628.1 [ECO:0000332] RNAseq introns :: single sample supports all introns ERS025081, ER5025082 [ECO:0000348] |
| 54 | CREM | both | 1390 | cAMP-responsive element modulator isoform 1 | This gene encodes a bZIP transcription factor that binds to the cAMP responsive element found in many viral and cellular promoters. It is an important component of cAMP-mediated signal transduction during the spermatogenetic cycle, as well as other complex processes. Alternative promoter and translation initiation site usage allows this gene to exert spatial and temporal specificity to cAMP responsiveness. Multiple alternatively spliced transcript variants encoding several different isoforms have been found for this gene, with some of them functioning as activators and some as repressors of transcription. [provided by RefSeq, Jul |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | 2008]. Transcript Variant: This variant (1) encodes the longest isoform (1). This isoform represents an activator taut isoform. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: BC041810.1 [ECO:0000332) RNAseq introns :: single sample supports all introns ERS025084, ERS025085 [ECG:0000348] ##Evidence-Data-END## |
| 55 | CSAD | exoni c | 51380 | cysteine sulfinic acid decarboxylase isoform 1 | This gene encodes a member of the group 2 decarboxylase family. A similar protein in rodents plays a role in multiple biological processes as the rate-limiting enzyme in taurine biosynthesis, catalyzing the decarboxylation of cysteinesulfinate to hypotaurine. Alternatively spliced transcript variants encoding multiple isoforms have been observed for this gene. [provided by RefSeq, Sep 2011]. Transcript Variant: This variant (1) represents the longest transcript and encodes the longest isoform (1). ##Evidence-Data-START## Transcript exon combination :: AF116548.1 [ECO:0000332] RNAseq introns :: mixed/partial sample support ERS025081, ERS025082 [ECO:0000350] ##Evidence-Data-END## |
| 56 | CTNN A3 | both | 29119 | catenin alpha-3 | N/A |
| 57 | CUL2 | exoni c | 8453 | cullin-2 isoform a | N/A |
| 58 | CYP2R 1 | exoni c | 120227 | vitam D 25- hydroxylase | This gene encodes a member of the cytochrome P450 superfamily of enzymes. The cytochrome P450 proteins are monooxygenases which catalyze many reactions involved in drug metabolism and synthesis of cholesterol, steroids and other lipids. This enzyme is a microsomal vitamin D hydroxylase that converts vitamin D into the active ligand for the vitamin D receptor. A mutation in this gene has been associated with selective 25-hydroxyvitamin D deficiency. [provided by RefSeq, Jul 2008]. Publication Note: This RefSeq record includes a subset of the publications that are available for this gene. Please see the Gene record to access additional publications. ##Evidence-Data-START## Transcript exon combination :: AY323817.1, BC104907.1 [ECO:0000332] |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | RNAseq introns :: single sample supports all introns ERS025084, ERS025087 [ECO:0000348] ##Evidence-Data-END## |
| 59 | DAP3 | exoni c | 7818 | 28S ribosomal protein S29, mitochondrial isoform 1 | and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 28S subunit protein that also participates in apoptotic pathways which are initiated by tumor necrosis factor-alpha, Fas ligand, and gamma interferon. This protein potentially binds ATP/GTP and might be a functional partner of the mitoribosomal protein S27. Multiple alternatively spliced transcript variants encoding distinct isoforms have been found for this gene. Pseudogenes corresponding to this gene are found on chromosomes 1q and 2q. [provided by RefSeq, Dec 2010]. Transcript Variant: This variant (1) has an additional segment in the 5' UTR, as compared to variant 2. Variants 1, 2 and 3 encode the same isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##RefSeq-Attributes-START## gene product(s) localized to mito. :: reported by MitoCarta ##RefSeq-Attributes-END## ##Evidence-Data-START## Transcript exon combination :: BC107488.1, CR749790.1 [ECO:0000332] RNAseq introns :: single sample supports all introns ERS025081, ERS025082 [ECO:0000348] |
| 60 | DDHD 2 | exoni c | 23259 | phospholipase DDHD2 isoform 1 | N/A |
| 61 | DERL3 | exoni c | 91319 | derlin-3 isoform 1 | The protein encoded by this gene belongs to the derlin family, and resides in the endoplasmic reticulum (ER). Proteins that are unfolded or misfolded in the ER must be refolded or degraded |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | to maintain the homeostasis of the ER. This protein appears to be involved in the degradation of misfolded glycoproteins in the ER. Several alternatively spliced transcript variants encoding different isoforms have been identified for this gene. [provided by RefSeq, Oct 2008]. Transcript Variant: This variant (1) encodes the longest isoform (1). ##Evidence-Data-START## Transcript exon combination :: CR456372.1 [ECO:0000332] RNAseq introns :: single sample supports all introns ERS025084, ERS025085 [ECO:0000348] ##Evidence-Data-END## |
| 62 | DGCR 6L | exoni c | 85359 | protein DGCR6L | This gene, the result of a duplication at this locus, is one of two functional genes encoding nearly identical proteins that have similar expression patterns. The product of this gene is a protein that shares homology with the Drosophila gonadal protein, expressed in gonadal tissues and germ cells, and with the human laminin gamma-1 chain that functions in cell attachment and migration. This gene is located in a region of chromosome 22 implicated in the DiGeorge syndrome, one facet of a broader collection of anomalies referred to as the CATCH 22 syndrome. [provided by RefSeq, Jul 2008]. ##Evidence-Data-START## Transcript exon combination :: AF228708.1, AK289952.1 [ECO:0000332] RNAseq introns :: single sample supports all introns ERS025088 [ECO:0000348] ##Evidence-Data-END## |
| 63 | DGKD | exoni c | 8527 | diacylglycerol kinase delta isoform 1 | This gene encodes a cytoplasmic enzyme that phosphorylates diacylglycerol to produce phosphatidic acid. Diacylglycerol and phosphatidic acid are two lipids that act as second messengers in signaling cascades. Their cellular concentrations are regulated by the encoded protein, and so it is thought to play an important role in cellular signal transduction. Alternative splicing results in two transcript variants encoding different isoforms. [provided by RefSeq, Jul 2008]. Transcript Variant: This variant (1) differs in the 5' UTR and uses a different in-frame start codon, compared to variant 2. The encoded isoform (1) has a shorter, distinct N-terminus, compared to isoform 2. Publication Note: This RefSeq record includes a subset of the publications that are available for this gene. Please see the Gene record to access additional publications. ##Evidence-Data-START## Transcript exon combination :: D73409.1 [ECO:0000332] RNAseq introns :: single sample supports all introns ERS025084, ERS025085 [ECO:0000348] ##Evidence-Data-END# |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| 64 | DHTK D1 | exoni c | 55526 | probable 2-oxoglutarate dehydrogenase E1 component DHKTD1, mitochondrial | This gene encodes a component of a mitochondrial 2-oxoglutarate-dehydrogenase-complex-like protein involved in the degradation pathways of several amino acids, including lysine. Mutations in this gene are associated with 2-aminoadipic 2-oxoadipic aciduria and Charcot-Marie-Tooth Disease Type 2Q. [provided by RefSeq, May 2013]. ##Evidence-Data-START## Transcript exon combination :: BC002477.2 [ECO:0000332] RNAseq introns :: single sample supports all introns ERS025081, ERS025083 [ECO:0000348] ##Evidence-Data-END## ##RefSeq-Attributes-START## gene product(s) localized to mito. :: reported by MitoCarta ##RefSeq-Attributes-END## |
| 65 | DIAPH 2 | exoni c | 1730 | protein diaphanous homolog 2 isoform 12C | The product of this gene belongs to the diaphanous subfamily of the formin homology family of proteins. This gene may play a role in the development and normal function of the ovaries. Defects in this gene have been linked to premature ovarian failure 2. Alternatively spliced transcript variants encoding different isoforms have been identified. [provided by RefSeq, Jul 2008]. Transcript Variant: This variant (12C) differs in the 3' UTR and the 3' coding region, compared to variant 156. The resulting isoform (isoform 12C) contains a distinct C-terminus, compared to isoform 156. Publication Note: This RefSeq record includes a subset of the publications that are available for this gene. Please see the Gene record to access additional publications. ##Evidence-Data-START## Transcript exon combination :: Y15908.1, AK291272.1 [ECO:0000332] RNAseq introns :: single sample supports all introns ERS025081, ERS025084 [ECO:0000348] ###Evidence-Data-END## |
| 66 | DIAPH 3 | exoni c | 81624 | protein diaphanous homolog 3 isoform a | This gene encodes a member of the diaphanous subfamily of the formin family. Members of this family are involved in actin remodeling and regulate cell movement and adhesion. Mutations in this gene are associated with autosomal dominant auditory neuropathy 1. Multiple transcript variants encoding different isoforms have been found for this gene. [provided by RefSeq, Apr 2012]. Transcript Variant: This variant (1) represents the longest transcript and encodes the longest isoform (a). Sequence Note: This RefSeq record was created from transcript and genomic sequence data to make the sequence consistent with the reference genome assembly. The genomic coordinates used for the transcript record were based on transcript alignments. Publication Note: This RefSeq record |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | includes a subset of the publications that are available for this gene. Please see the Gene record to access additional publications. ##Evidence-Data-START## Transcript exon combination :: AY750055.1 [ECO:0000332] RNAseq introns :: mixed/partial sample support ERS025081, ERS025082 [ECO:0000350] ##Evidence-Data-END## |
| 67 | DLGAP1 | intronic | 9229 | disks large-associated protein 1 isoform 1 | N/A |
| 68 | DLGAP5 | exonic | 9787 | disks large-associated protein 5 isoform a | N/A |
| 69 | DNAH11 | exonic | 8701 | dynein heavy chain 11, axonemal | This gene encodes a ciliary outer dynein arm protein and is a member of the dynein heavy chain family. It is a microtubule-dependent motor ATPase and has been reported to be involved in the movement of respiratory cilia. Mutations in this gene have been implicated in causing Kartagener Syndrome (a combination of situs inversus totalis and Primary Ciliary Dyskinesia (PCD), also called Immotile Cilia Syndrome 1 (ICS1)) and male sterility. [provided by RefSeq, Mar 2013]. Publication Note: This RefSeq record includes a subset of the publications that are available for this gene. Please see the Gene record to access additional publications. ##Evidence-Data-START## RNAseq introns :: mixed/partial sample support ER5025083, ER5025084 [ECO:0000350] ##Evidence-Data-END## |
| 70 | DOC2 GP | exonic | 390213 | N/A | N/A |
| 71 | DOPEY2 | exonic | 9980 | protein dopey-2 | N/A |
| 72 | DPY19 L2P4 | exonic | 442523 | N/A | N/A |
| 73 | EPHA4 | intronic | 2043 | ephrin type-A receptor 4 precursor | This gene belongs to the ephrin receptor subfamily of the protein-tyrosine kinase family. EPH and EPH-related receptors have been implicated in mediating developmental events, particularly in the nervous system. Receptors in the EPH subfamily typically have a single kinase domain and an extracellular region containing a Cys-rich domain and 2 fibronectin type III repeats. The ephrin receptors are divided into 2 groups based on the similarity of their extracellular domain sequences and their affinities for binding ephrin-A and ephrin-B ligands. [provided by RefSeq, Jul 2008]. Publication Note: This RefSeq record includes a |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | subset of the publications that are available for this gene. Please see the Gene record to access additional publications. ##Evidence-Data-START## CDS exon combination :: 136645.1, AK290306.1 [ECO:0000331] RNAseq introns :: single sample supports all introns ERS025084 [ECO:0000348] ##Evidence-Data-END## ##RefSeq-Attributes-START## NMD candidate :: PMID: 21873938 ##RefSeq-Attributes-END## |
| 74 | ERCC8 | exonic | 1161 | DNA excision repair protein ERCC-8 | This gene encodes a WD repeat protein, which interacts with Cockayne syndrome type B (CSB) protein and with p44 protein, a subunit of the RNA polymerase II transcription factor IIH. Mutations in this gene have been identified in patients with hereditary disease Cockayne syndrome (CS). CS cells are abnormally sensitive to ultraviolet radiation and are defective in the repair of transcriptionally active genes. [provided by RefSeq, Jul 2008]. Publication Note: This RefSeq record includes a subset of the publications that are available for this gene. Please see the Gene record to access additional publications. ##Evidence-Data-START## Transcript exon combination :: U28413.1, AK290726.1 [ECO:0000332] RNAseq introns :: single sample supports all introns ERS025088 [ECO:0000348] ##Evidence-Data-END## |
| 75 | ESPL1 | exonic | 9700 | separin | Stable cohesion between sister chromatids before anaphase and their timely separation during anaphase are critical for chromosome inheritance. In vertebrates, sister chromatid cohesion is released in 2 steps via distinct mechanisms. The first step involves phosphorylation of STAG1 (MIM 604358) or STAG2 (MIM 300826) in the cohesin complex. The second step involves cleavage of the cohesin subunit SCC1 (RAD21; MIM 606462) by ESPL1, or separase, which initiates the final separation of sister chromatids (Sun et al., 2009 [PubMed 19345191]).[supplied by OMIM, Nov 2010]. Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. ##Evidence-Data-START## CDS exon combination :: AY455930.1 [ECO:0000331] RNAseq introns :: mixed/partial sample support ERS025081, ERS025082 [ECO:0000350] |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | ##Evidence-Data-END## |
| 76 | EXOC 4 | exoni c | 60412 | exocyst complex component 4 isoform a | The protein encoded by this gene is a component of the exocyst complex, a multiple protein complex essential for targeting exocytic vesicles to specific docking sites on the plasma membrane. Though best characterized in yeast, the component proteins and functions of exocyst complex have been demonstrated to be highly conserved in higher eukaryotes. At least eight components of the exocyst complex, including this protein, are found to interact with the actin cytoskeletal remodeling and vesicle transport machinery. The complex is also essential for the biogenesis of epithelial cell surface polarity. Alternate transcriptional splice variants, encoding different isoforms, have been characterized. [provided by RefSeq, Jul 2008] Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: AL831989.2, AF380839.1 [ECO:0000332] RNAseq introns :: single sample supports all introns ERS025081, ERS025082 [ECO:0000348] ##Evidence-Data-END## |
| 77 | FAM86 C2P | exoni c | 645332 | N/A | N/A |
| 78 | FAM18 0B | exoni c | 399888 | protein FAM180B precursor | N/A |
| 79 | FBLN7 | exoni c | 129804 | fibulin-7 isoform 1 precursor | N/A |
| 80 | FBXO4 0 | exoni c | 51725 | F-box only protein 40 | Members of the F-box protein family, such as FBXO40, are characterized by an approximately 40-amino acid F-box motif. SCF complexes, formed by SKP1 (MIM 601434), cullin (see CUL1; MIM 603134), and F-box proteins, act as protein-ubiquitin ligases. F-box proteins interact with SKP1 through the F box, and they interact with ubiquitination targets through other protein interaction domains (Jin et al., 2004 [PubMed 15520277]).[supplied by OMIM, Mar 2008]. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: AB033021.1, AF204674.1 |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | [ECO:0000332) RNAseq introns :: single sample supports all introns ERS025083, ERS025084 [ECO:0000348] ##Evidence-Data-END## |
| 81 | FMN1 | exonic | 342184 | formin-1 isoform a | N/A |
| 82 | FXN | exonic | 2395 | frataxin, mitochondrial isoform 1 preproprotein | This nuclear gene encodes a mitochondrial protein which belongs to FRATAXIN family. The protein functions in regulating mitochondrial iron transport and respiration. The expansion of intronic trinucleotide repeat GAA results in Friedreich ataxia. Alternative splicing results in multiple transcript variants. [provided by RefSeq, Jun 2009]. Transcript Variant: This variant (1) encodes the longer isoform (1). Sequence Note: This RefSeq record was created from transcript and genomic sequence data to make the sequence consistent with the reference genome assembly. The genomic coordinates used for the transcript record were based on transcript alignments, Publication Note: This RefSeq record includes a subset of the publications that are available for this gene. Please see the Gene record to access additional publications. ##Evidence-Data-START## Transcript exon combination :: BC023633.2, U43747.1 [ECO:0000332] RNAseq introns :: single sample supports all introns ERS025081, ERS025083 [ECO:0000348] ##Evidence-Data-END## ##RefSeq-Attributes-START## gene product(s) localized to mito.:: reported by MitoCarta ##RefSeq-Attributes-END## |
| 83 | GABARAPL3 | exonic | 23766 | N/A | N/A |
| 84 | GALNS | exonic | 2588 | N-acetylgalactosamine-6-sulfatase precursor | This gene encodes N-acetylgalactosamine-6-sulfatase which is a lysosomal exohydrolase required for the degradation of the glycosaminoglycans, keratan sulfate, and chondroitin 6-sulfate. Sequence alterations including point, missense and nonsense mutations, as well as those that affect splicing, result in a deficiency of this enzyme. Deficiencies of this enzyme lead to Morquio A syndrome, a lysosomal storage disorder. [provided by RefSeq, Jul 2008]. Publication Note: This RefSeq record includes a subset of the publications that are available for this gene. Please see the Gene record to access additional publications. ##Evidence-Data-START## Transcript exon combination :: BC056151.1, BC050684.1 [ECO:0000332] RNAseq introns :: mixed/partial sample support ERS025081, ERS025082 [ECO:0000350] ##Evidence-Data-END## |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| 85 | GATC | exonic | 283459 | glutamyl-tRNA(Gln) amidotransferase subunit C, mitochondrial | N/A |
| 86 | GFRA3 | exonic | 2676 | GDNF family receptor alpha-3 preproprotein | The protein encoded by this gene is a glycosylphosphatidylinositol(GPI)-linked cell surface receptor and a member of the GDNF receptor family. It forms a signaling receptor complex with RET tyrosine kinase receptor and binds the ligand, artemin. [provided by RefSeq, Jul 2008]. Publication Note: This RefSeq record includes a subset of the publications that are available for this gene. Please see the Gene record to access additional publications. ##Evidence-Data-START## Transcript exon combination :: BC037951.1, AY358997.1 [ECO:0000332] RNAseq introns :: single sample supports all introns ERS025084, ERS025088 [ECO:0000348] ##Evidence-Data-END## |
| 87 | GLRA 3 | both | 8001 | glycine receptor subunit alpha-3 isoform a precursor | The GLRA3 gene encodes the alpha-3 subunit of the neuronal glycine receptor, a ligand-gated chloride channel composed of ligand-binding alpha and structural beta polypeptides (Kingsmore et al., 1994 [PubMed 7894176]).[supplied by OMIM, Nov 2009). ##Evidence-Data-START## Transcript exon combination :: BC036086.1 [ECO:0000332] RNAseq introns :: mixed/partial sample support ERS025081, ERS025082 [ECO:0000350] ##Evidence-Data-END## |
| 88 | GNRH R2 | exonic | 114814 | primates and non-mammalian vertebrates, the gonadotropin releasing hormone 2 receptor gene (GnRHR2) encodes a seven-transmembrane G-protein coupled receptor. However, in human, the corresponding reading frame contains a premature stop codon, which has been suggested to encode a selenocysteine residue, but there is | In non-hominoid primates and non-mammalian vertebrates, the gonadotropin releasing hormone 2 receptor gene (GnRHR2) encodes a seven-transmembrane G-protein coupled receptor. However, in human, the corresponding reading frame contains a premature stop codon, which has been suggested to encode a selenocysteine residue, but there is no solid evidence for selenocysteine incorporation (PMID: 12538601). It appears that the human GnRHR2 transcription occurs but the gene does not likely produce a functional multi-transmembrane protein. A non-transcribed pseudogene of GnRHR2 is located on chromosome 14. Multiple alternatively spliced transcript variants have been found for this gene. [provided by RefSeq, Aug 2013]. Transcript Variant: This variant (1) represents the longest transcript. Publication Note: This RefSeq record includes a subset of the publications that are available for this gene. Please see the Gene record to access additional publications. ##RefSeq-Attributes-START## |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | no solid evidence for selenocysteine incorporation (PMID: 12538601). It appears that the | unitary pseudogene :: PMID: 11352653; inferred protein-coding ortholog GeneID: 574163 ##RefSeq-Attributes-END## |
| 89 | GOLGB1 | exonic | 2804 | Golgin subfamily B member 1 isoform 1 | N/A |
| 90 | GPR39 | intronic | 2863 | G-protein coupled receptor 39 | N/A |
| 91 | GREM1 | exonic | 26585 | gremlin-1 isoform 1 precursor | This gene encodes a member of the BMP (bone morphogenic protein) antagonist family. Like BMPs, BMP antagonists contain cystine knots and typically form homo- and heterodimers. The CAN (cerberus and dan) subfamily of BMP antagonists, to which this gene belongs, is characterized by a C-terminal cystine knot with an eight-membered ring. The antagonistic effect of the secreted glycosylated protein encoded by this gene is likely due to its direct binding to BMP proteins. As an antagonist of BMP, this gene may play a role in regulating organogenesis, body patterning, and tissue differentiation. In mouse, this protein has been shown to relay the sonic hedgehog (SHH) signal from the polarizing region to the apical ectodermal ridge during limb bud outgrowth. Alternatively spliced transcript variants encoding different isoforms have been found for this gene. [provided by RefSeq, Jul 2010]. Transcript Variant: This variant (1) is the longest transcript and encodes the longest isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence Data-START## Transcript exon combination :: DA573392.1, AY232290.1 [ECO:0000332] RNAseq introns :: single sample supports all introns ER5025081, ERS025084 [KO:0000348] ##Evidence-Data-END## |
| 92 | GRIA3 | exonic | 2892 | glutamate receptor 3 isoform 1 precursor | Glutamate receptors are the predominant excitatory neurotransmitter receptors in the mammalian brain and are activated in a variety of normal neurophysiologic processes. These receptors are heteromeric protein complexes composed of multiple subunits, arranged to form ligand-gated ion channels. The classification of glutamate receptors |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | is based on their activation by different pharmacologic agonists. The subunit encoded by this gene belongs to a family of AMPA (alpha-amino-3-hydroxy-5-methyl-4-isoxazole propionate)-sensitive glutamate receptors, and is subject to RNA editing (AGA->GGA; R->G). Alternative splicing at this locus results in different isoforms, which may vary in their signal transduction properties. [provided by RefSeq, Jul 2008]. Transcript Variant: This variant (1) encodes isoform 1 (also known as flip isoform). RNA editing (AGA->GGA) changes Arg775Gly. Publication Note: This RefSeq record includes a subset of the publications that are available for this gene. Please see the Gene record to access additional publications. ##RefSeq-Attributes-START## undergoes RNA editing :: PMID: 10688364, 7992055 ##RefSeq-Attributes-END## ##Evidence-Data-START## Transcript exon combination :: U10301.1 [ECO:0000332] RNAseq introns :: single sample supports all introns ERS025082, ERS025084 [ECO:0000348] ##Evidence-Data END## |
| 93 | GRIP1 | exoni c | 23426 | glutamate receptor-interacting protein 1 isoform 1 | This gene encodes a member of the glutamate receptor interacting protein family. The encoded scaffold protein binds to and mediates the trafficking and membrane organization of a number of transmembrane proteins. Alternatively spliced transcript variants encoding different isoforms have been described. [provided by RefSeq, May 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: BC115393.1 [ECO:0000332] RNAseq introns :: mixed/partial sample support ERS025082, ERS025083 [ECO:0000350] ##Evidence-Data-END## |
| 94 | GRM1 | intron ic | 2911 | metabotropic glutamate receptor 1 isoform alpha precursor | L-glutamate is the major excitatory neurotransmitter in the central nervous system and activates both ionotropic and metabotropic glutamate receptors. Glutamatergic neurotransmission is involved in most aspects of normal brain function and can be |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | perturbed in many neuropathologic conditions. The metabotropic glutamate receptors are a family of G protein-coupled receptors, that have been divided into 3 groups on the basis of sequence homology, putative signal transduction mechanisms, and pharmacologic properties. Group I includes GRM1 and GRM5 and these receptors have been shown to activate phospholipase C. Group II includes GRM2 and GRM3 while Group III includes GRM4, GRM6, GRM7 and GRM8. Group II and III receptors are linked to the inhibition of the cyclic AMP cascade but differ in their agonist selectivities. The canonical alpha isoform of the metabotropic glutamate receptor 1 gene is a disulfide-linked homodimer whose activity is mediated by a G-protein-coupled phosphatidylinositol-calcium second messenger system. Alternative splicing results in multiple transcript variants encoding distinct isoforms; some of which may have distinct functions. [provided by RefSeq, Jul 2008]. Transcript Variant: This variant (1) encodes the longer isoform (alpha). Publication Note: This RefSeq record includes a subset of the publications that are available for this gene. Please see the Gene record to access additional publications. ##Evidence-Data-START## CDS exon combination :: L76627.1, U31215.1 [ECO:0000331] ##Evidence-Data-END## |
| 95 | GSTP1 | exonic | 2950 | Glutathione S-transferase P N/A | Glutathione S-transferases (GSTs) are a family of enzymes that play an important role in detoxification by catalyzing the conjugation of many hydrophobic and electrophilic compounds with reduced glutathione. Based on their biochemical, immunologic, and structural properties, the soluble GSTs are categorized into 4 main classes: alpha, mu, pi, and theta. This GST family member is a polymorphic gene encoding active, functionally different GSTP1 variant proteins that are thought to function in xenobiotic metabolism and play a role in susceptibility to cancer, and other diseases. [provided by RefSeq, Jul 2008]. Publication Note: This RefSeq record includes a subset of the publications that are available for this gene. Please see the Gene record to access additional publications. ##Evidence-Data-START## Transcript exon combination :: BG473224.1, BQ722817.1 [ECO:0000332] RNAseq introns :: single sample supports all introns ERS025081, ERS025082 [ECO:0000348] ##Evidence-Data-END## |
| 96 | GUCY | exonic | 2974 | N/A | N/A |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | 1B2 | c | | | |
| 97 | GYG2 | exonic | 8908 | glycogenin-2 isoform a | This gene encodes a member of the the glycogenin family. Glycogenin is a self-glucosylating protein involved in the initiation reactions of glycogen biosynthesis. A gene on chromosome 3 encodes the muscle glycogenin and this X-linked gene encodes the glycogenin mainly present in liver; both are involved in blood glucose homeostasis. This gene has a short version on chromosome Y, which is 3' truncated and can not make a functional protein. Multiple alternatively spliced transcript variants encoding different isoforms have been identified.[provided by RefSeq, May 2010]. Transcript Variant: This variant (1) lacks an in-frame exon in the CDS, as compared to variant 2. The resulting isoform (a) lacks an internal segment, as compared to isoform' b. ##Evidence-Data-START## Transcript exon combination :: BC023152.1, AK292496.1 [ECO:0000332] RNAseq introns :: single sample supports all introns ERS025081, ERS025084 [ECO:0000348] ##Evidence-Data-END## |
| 98 | HCLS1 | exonic | 3059 | hematopoietic lineage cell-specific protein | N/A |
| 99 | HEPH L1 | exonic | 341208 | hephaestin-like protein 1 precursor | N/A |
| 100 | HFE2 | exonic | 148738 | hemojuvelin isoform a precursor | The product of this gene is involved in iron metabolism. It may be a component of the signaling pathway which activates hepcidin or it may act as a modulator of hepcidin expression. It could also represent the cellular receptor for hepcidin. Alternatively spliced transcript variants encoding different isoforms have been identified for this gene. Defects in this gene are the cause of hemochromatosis type 2A, also called juvenile hemochromatosis (JH). JH is an early-onset autosomal recessive disorder due to severe iron overload resulting in hypogonadotrophic hypogonadism, hepatic fibrosis or cirrhosis and cardiomyopathy, occurring typically before age of 30. [provided by RefSeq, Jul 2008]. Transcript Variant: This variant (a) represents the longest transcript, and encodes the longest isoform (a). Publication Note: This RefSeq record includes a subset of the publications that are available for this gene. Please see the Gene record to access additional publications. ##Evidence-Data-START## Transcript exon combination :: AK124273.1, AK292742.1 [ECO:0000332] RNAseq introns :: single sample supports all introns |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | ERS025083, ERS025084 [ECO:0000348] ##Evidence-Data-END## |
| 101 | HIRA | exonic | 7290 | protein HIRA | This gene encodes a histone chaperone that preferentially places the variant histone H3.3 in nucleosomes. Orthologs of this gene in yeast, flies, and plants are necessary for the formation of transcriptionally silent heterochromatin. This gene plays an important role in the formation of the senescence-associated heterochromatin foci. These foci likely mediate the irreversible cell cycle changes that occur in senescent cells. It is considered the primary candidate gene in some haploinsufficiency syndromes such as DiGeorge syndrome, and insufficient production of the gene may disrupt normal embryonic development. [provided by RefSeq, Jul 2008]. Publication Note: This RefSeq record includes a subset of the publications that are available for this gene. Please see the Gene record to access additional publications. ##Evidence-Data-START## Transcript exon combination :: X89887.1, BC039835.1 [ECO:0000332] RNAseq introns :: mixed/partial sample support ERS025081, ERS025082 [ECO:0000350] ##Evidence-Data-END## |
| 102 | HLCS | intronic | 3141 | biotin--protein ligase | This gene encodes an enzyme that catalyzes the binding of biotin to carboxylases and histones. The protein plays an important role in gluconeogenesis, fatty acid synthesis and branched chain amino acid catabolism. Defects in this gene are the cause of holocarboxylase synthetase deficiency. Multiple alternatively spliced variants, encoding the same protein, have been identified.[provided by RefSeq, Jun 2011]. Transcript Variant: This variant (1) is the shortest transcript. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: D23672.2, BC060787.1 [ECO:0000332] RNAseq introns :: mixed/partial sample support ERS025081, ERS025084 [ECO:0000350] ##Evidence-Data-END## |
| 103 | HM13 | exoni | 81502 | minor | The protein encoded by this gene, which localizes |

| Gene Number (GN) | RefSeq Gene Symbol | Exon_overlap | NCBI_Gene_ID | Gene_Description | RefSeq_Summary |
|---|---|---|---|---|---|
| | | c | | histocompatibility antigen H13 isoform 1 | to the endoplasmic reticulum, catalyzes intramembrane proteolysis of some signal peptides after they have been cleaved from a preprotein. This activity is required to generate signal sequence-derived human lymphocyte antigen-E epitopes that are recognized by the immune system, and to process hepatitis C virus core protein. The encoded protein is an integral membrane protein with sequence motifs characteristic of the presenilin-type aspartic proteases. Multiple transcript variants encoding several different isoforms have been found for this gene. [provided by RefSeq, Jul 2008]. Transcript Variant: This variant (1) encodes the predominant isoform (1). Publication Note: This RefSeq record includes a subset of the publications that are available for this gene. Please see the Gene record to access additional publications. ##Evidence-Data-START## Transcript exon combination :: AI345029.1, AF483215.1 [ECO:0000332] RNAseq introns :: single sample supports all introns ERS025081, ERS025082 [ECO:0000348] ##Evidence-Data-END## |
| 104 | HM13-AS1 | exonic | 100874042 | N/A | N/A |
| 105 | HTR7 | exonic | 3363 | 5-hydroxytryptamine receptor 7 isoform a | The neurotransmitter, serotonin, is thought to play a role in various cognitive and behavioral functions. The serotonin receptor encoded by this gene belongs to the superfamily of G protein-coupled receptors and the gene is a candidate locus for involvement in autistic disorder and other neuropsychiatric disorders. Three splice variants have been identified which encode proteins that differ in the length of their carboxy terminal ends. [provided by RefSeq, Jul 2008]. Transcript Variant: This variant (a) results from the alternative usage of the first of two tandemly arranged splice donor sites at the 5' end of intron 2, which causes the protein to have a 13 amino acid longer carboxy tail relative to isoform b. Publication Note: This RefSeq record includes a subset of the publications that are available for this gene. Please see the Gene record to access additional publications. ##Evidence-Data-START## Transcript exon combination :: BC047526.1,L21195.1 [ECO:0000332] RNAseq introns :: single sample supports all introns ERS025083, ERS025084 [ECO:0000348] ##Evidence-Data-END## |
| 106 | ID1 | exonic | 3397 | DNA-binding protein inhibitor ID-1 isoform a | The protein encoded by this gene is a helix-loop-helix (HLH) protein that can form heterodimers with members of the basic HLH family of transcription factors. The encoded protein has no |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | DNA binding activity and therefore can inhibit the DNA binding and transcriptional activation ability of basic HLH proteins with which it interacts. This protein may play a role in cell growth, senescence, and differentiation. Two transcript variants encoding different isoforms have been found for this gene. [provided by RefSeq, Jul 2008]. Transcript Variant: This variant (1) encodes the longer isoform (a, also called ID-1H). Publication Note: This RefSeq record includes a subset of the publications that are available for this gene. Please see the Gene record to access additional publications. ##Evidence-Data-START## Transcript exon combination :: BM459926.1, BC012420.1 [ECO:0000332] RNAseq introns :: single sample supports all introns ERS025081, ERS025082 [ECO:0000348] ##Evidence-Data-END## |
| 107 | INE2 | exonic | 8551 | N/A | N/A |
| 108 | IQGAP1 | exonic | 8826 | ras GTPase-activating-like protein IQGAP1 | This gene encodes a member of the IQGAP family. The protein contains four IQ domains, one calponin homology domain, one Ras-GAP dOmain and one WW domain. It interacts with components of the cytoskeleton, with cell adhesion molecules, and with several signaling molecules to regulate cell morphology and motility. Expression of the protein is upregulated by gene amplification in two gastric cancer cell lines. [provided by RefSeq, Jul 2008]. Publication Note: This RefSeq record includes a subset of the publications that are available for this gene. Please see the Gene record to access additional publications. ##Evidence-Data-START## Transcript exon combination :: BC151834.1, D29640.1 [ECO:0000332] RNAseq introns :: single sample supports all introns ERS025081, ERS025082 [ECO:0000348] ##Evidence-Data-END## |
| 109 | IQGAP2 | intronic | 10788 | ras GTPase-activating-like protein IQGAP2 | This gene encodes a member of the IQGAP family. The protein contains three IQ domains, one calponin homology domain, one Ras-GAP domain and one WW domain. It interacts with components of the cytoskeleton, with cell adhesion molecules, and with several signaling molecules to regulate cell morphology and motility. [provided by RefSeq, Jul 2008]. Publication Note:• This RefSeq record includes a subset of the publications that are available for this gene. Please see the Gene record to access additional publications. ##Evidence-Data-START## Transcript exon combination :: U51903.1, AK291066.1 [ECO:0000332] RNAseq |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | introns :: single sample supports all introns ERS025084, ERS025088 [ECO:0000348] ##Evidence-Data-END## |
| 110 | ITGA1 0 | exoni c | 8515 | integrin alpha-10 precursor | Integrins are integral membrane proteins composed of an alpha chain and a beta chain, and are known to participate in cell adhesion as well as cell-surface mediated signalling. The I-domain containing alpha 10 combines with the integrin beta 1 chain (ITGB1) to form a novel collagen type II-binding integrin expressed in cartilage tissue. [provided by RefSeq, Jul 2008]. ##Evidence-Data-START## Transcript exon combination :: AF112345.1, AF074015.1 [ECO:0000332] RNAseq introns :: mixed/partial sample support ERS025081, ERS025082 [ECO:0000350] ##Evidence-Data-END## |
| 111 | ITGB7 | exoni c | 3695 | integrin beta-7 precursor | This gene encodes a protein that is a member of the integrin superfamily. Members of this family are adhesion receptors that function in signaling from the extracellular matrix to the cell. Integrins are heterodimeric integral membrane proteins composed of an alpha chain and a beta chain. The encoded protein forms dimers with an alpha4 chain or an alphaE chain and plays a role in leukocyte adhesion. Dimerization with alpha4 forms a homing receptor for migration of lymphocytes to the intestinal mucosa and Peyer's patches. Dimerization with alphaE permits binding to the ligand epithelial cadherin, a calcium-dependent adhesion molecule. Alternate splicing results in multiple transcript variants. Additional alternatively spliced transcript variants of this gene have been described, but their full-length nature is not known. [provided by RefSeq, Sep 2013]. Transcript Variant: This variant (1) represents the longer transcript. Publication Note: This RefSeq record includes a subset of the publications that are available for this gene. Please see the Gene record to access additional publications. ##Evidence-Data-START## Transcript exon combination :: S80335.1, M68892.1 [ECO:0000332] RNAseq introns :: mixed/partial sample support ERS025081, ERS025082 [ECO:0000350] ##Evidence-Data-END## |
| 112 | JAKMI P2 | exoni c | 9832 | janus kinase and microtubule interacting protein 2 isoform 1 | The protein encoded by this gene is reported to be a component of the Golgi matrix. It may act as a golgin protein by negatively regulating transit of secretory cargo and by acting as a structural scaffold of the Golgi. Alternative splicing results in multiple transcript variants. [provided by RefSeq, Aug 2012]. Transcript Variant: This variant (1) represents the longest transcript and encodes the |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | longest isoform (1). Sequence Note: This RefSeq record was created from transcript and genomic sequence data to make the sequence consistent with the reference genome assembly. The genomic coordinates used for the transcript record were based on transcript alignments. ##Evidence-Data-START## CDS exon combination :: EF512550.1 [ECO:0000331] RNAseq introns :: mixed/partial sample support ERS025082, ERS025083 [ECO:0000350] ##Evidence-Data-END## |
| 113 | JPH3 | intron ic | 57338 | junctophilin-3 isoform 1 | Junctional complexes between the plasma membrane and endoplasmic/sarcoplasmic reticulum are a common feature of all excitable cell types and mediate cross talk between cell surface and intracellular ion channels. The protein encoded by this gene is a component of junctional complexes and is composed of a C-terminal hydrophobic segment spanning the endoplasmic/sarcoplasmic reticulum membrane and a remaining cytoplasmic domain that shows specific affinity for the plasma membrane. CAG/CTG repeat expansions at the Huntington's disease (HD)-like 2 locus have been identified in this gene, which is a member of the junctophilin gene family. Alternatively spliced transcript variants have been described for this gene. [provided by RefSeq, Oct 2012]. Transcript Variant: This variant (1) represents the longest transcript and encodes the longest isoform (1). Publication Note: This RefSeq record includes a subset of the publications that are available for this gene. Please see the Gene record to access additional publications. ##Evidence-Data-START## Transcript exon combination :: 8C036533.2, A8042636.1 [ECO:0000332] RNAseq introns :: single sample supports all introns ERS025082, ERS025084 [ECO:0000348] ##Evidence-Data-END## |
| 114 | KCND 2 | intron ic | 3751 | potassium voltage-gated channel subfamily D member 2 precursor | Voltage-gated potassium (Kv) channels represent the most complex class of voltage-gated ion channels from both functional and structural standpoints. Their diverse functions include regulating neurotransmitter release, heart rate, insulin secretion, neuronal excitability, epithelial electrolyte transport, smooth muscle contraction, and cell volume. Four sequence-related potassium channel genes - shaker, shaw, shab, and ihal - have been identified in Drosophila, and each has been shown to have human homolog(s). This gene encodes a member of the potassium channel, voltage-gated, shal-related subfamily, members of which form voltage-activated A-type potassium ion |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | channels and are prominent in the repolarization phase of the action potential. This member mediates a rapidly inactivating, A-type outward potassium current which is not under the control of the N terminus as it is in Shaker channels. [provided by RefSeq, Jul 2008]. Publication Note: This RefSeq record includes a subset of the publications that are available for this gene. Please see the Gene record to access additional publications. ##Evidence-Data-START## Transcript exon combination :: AB028967.1, BC110449.1 [ECO:0000332] RNAseq introns :: single sample supports all introns ERS025082, ERS025084 [ECO:0000348] ##Evidence-Data-END## |
| 115 | KCNE 1 | exoni c | 3753 | potassium voltage-gated channel subfamily E member 1 | The product of this gene belongs to the potassium channel KCNE family. Potassium ion channels are essential to many cellular functions and show a high degree of diversity, varying in their electrophysiologic and pharmacologic properties. This gene encodes a transmembrane protein known to associate with the product of the KVLQT1 gene to form the delayed rectifier potassium channel. Mutation in this gene are associated with both Jervell and Lange-Nielsen and Romano-Ward forms of long-QT syndrome. Alternatively spliced transcript variants encoding the same protein have been identified. [provided by RefSeq, Jul 2008]. Transcript Variant: This variant (1) differs in the 5' UTR, compared to variant 2. All variants encode the same protein. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: EU008570.1, AY789480.1 [ECO:0000332] RNAseq introns :: single sample supports all introns ERS025083, ERS025084 [ECO:0000348] ##Evidence-Data-END## ##RefSeq-Attributes-START## CDS uses downstream in-frame AUG :: upstream AUG and CDS extension is not conserved ##RefSeq-Attributes-END## |
| 116 | KCNIP 4 | both | 80333 | Kv channel-interacting protein 4 isoform 1 | This gene encodes a member of the family of voltage-gated potassium (Kv) channel-interacting proteins (KCNIPs), which belong to the recoverin branch of the EF-hand superfamily. Members of the |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | KCNIP family are small calcium binding proteins. They all have EF-hand-like domains, and differ from each other in the N-terminus. They are integral subunit components of native Kv4 channel complexes. They may regulate A-type currents, and hence neuronal excitability, in response to changes in intracellular calcium. This protein member also interacts with presenilin. Multiple alternatively spliced transcript variants encoding distinct isoforms have been identified for this gene. [provided by RefSeq, Jul 2008]. Transcript Variant: This variant (1) encodes the longest isoform (1, also known as KCHIP4.1). Publication Note: This RefSeq record includes a subset of the publications that are available for this gene. Please see the Gene record to access additional publications. ##Evidence-Data-START## Transcript exon combination :: B1596848.1, AK289922.1 [ECO:0000332] RNAseq introns :: single sample supports all introns ERS025088 [ECO:0000348] ##Evidence-Data-END## |
| 117 | KCNN2 | intronic | 3781 | small conductance calcium-activated potassium channel protein 2 isoform a | Action potentials in vertebrate neurons are followed by an afterhyperpolarization (AHP) that may persist for several seconds and may have profound consequences for the firing pattern of the neuron. Each component of the AHP is kinetically distinct and is mediated by different calcium-activated potassium channels. The protein encoded by this gene is activated before membrane hyperpolarization and is thought to regulate neuronal excitability by contributing to the slow component of synaptic AHP. This gene is a member of the KCNN family of potassium channel genes. The encoded protein is an integral membrane protein that forms a voltage-independent calcium-activated channel with three other calmodulin-binding subunits. Alternate splicing of this gene results in multiple transcript variants. [provided by RefSeq, May 2013]. Transcript Variant: This variant (1) represents the longest transcript and encodes the longer isoform (a). Publication Note: This RefSeq record includes a subset of the publications that are available for this gene. Please see the Gene record to access additional publications. ##Evidence-Data-START## Transcript exon combination :: AF239613.1, AK289948.1 [ECO:0000332] RNAseq introns :: single sample supports all introns ERS025083, ERS025084 [ECO:00003481 ##Evidence-Data-END## |
| 118 | KCTD | exoni | 65987 | BTB/POZ domain- | N/A |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | 14 | c | | containing protein KCTD14 isoform 1 | |
| 119 | KLHL2 2 | exoni c | 84861 | kelch-like protein 22 | N/A |
| 120 | LIX1L | exoni c | 128077 | LIX1-like protein | N/A |
| 121 | LOC28 4889 | exoni c | 284889 | N/A | N/A |
| 122 | LOC44 0905 | exoni c | 440905 | N/A | N/A |
| 123 | LOC72 9444 | exoni c | 729444 | N/A | N/A |
| 124 | LOC10 050654 8 | exoni c | 1005065 48 | N/A | N/A |
| 125 | LYG1 | exoni c | 129530 | lysozyme g-like protein 2 precursor | N/A |
| 126 | LYG2 | exoni c | 254773 | lysozyme g-like protein 2 precursor | The protein encoded by this gene contains a SLT domain, a protein domain present in bacterial lytic transglycosylase (SIT) and in eukaryotic lysozymes (GEWL). SLT domain catalyzes the cleavage of the beta-1,4-glycosidic bond between N-acetylmuramic acid (MurNAc) and N-acetyglucosamine (GlcNAc). [provided by RefSeq, Jul 2008]. ##Evidence-Data-START## CDS exon combination :: BC100882.3 [ECO:0000331] ##Evidence-Data-END## |
| 127 | MAPK APK5 | exoni c | 8550 | MAP kinase-activated protein kinase 5 isoform 1 | The protein encoded by this gene is a tumor suppressor and member of the serine/threonine kinase family. In response to cellular stress and proinflammatory cytokines, this kinase is activated through its phosphorylation by MAP kinases including MAPK1/ERK, MAPK14/p38-alpha, and MAPK11/p38-beta. The encoded protein is found in the nucleus but translocates to the cytoplasm upon phosphorylation and activation. This kinase phosphorylates heat shock protein HSP27 at its physiologically relevant sites. Two alternately spliced transcript variants of this gene encoding distinct isoforms have been reported. [provided by RefSeq, Nov 2012]. Transcript Variant: This variant (1) is the more frequently occurring transcript. Publication Note: This RefSeq record includes a subset of the publications that are available for this gene. Please see the Gene record to access additional publications. ##Evidence-Data-START## Transcript exon combination :: AK122767.1, BC041049.1 [ECO:0000332] RNAseq introns :: single sample supports all introns ERS025081, ERS025082 [ECO:0000348] ##Evidence-Data-END## |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| 128 | MAPKAPK5-AS1 | exonic | 51275 | N/A | N/A |
| 129 | MED15 | exonic | 51586 | mediator of RNA polymerase II transcription subunit 15 isoform a | The protein encoded by this gene is a subunit of the multiprotein complexes PC2 and ARC/DRIP and may function as a transcriptional coactivator in RNA polymerase II transcription. This gene contains stretches of trinucleotide repeats and is located in the chromosome 22 region which is deleted in DiGeorge syndrome. Two transcript variants encoding different isoforms have been found for this gene. [provided by RefSeq, Jul 2008]. Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: AK090465.1 [ECO:0000332] RNAseq introns :: single sample supports all introns ERS025082, ERS025085 [ECO:0000348] ##Evidence-Data-END## |
| 130 | MERTK | exonic | 10461 | tyrosine-protein kinase Mer precursor | This gene is a member of the MER/AXL/TYRO3 receptor kinase family and encodes a transmembrane protein with two fibronectin type-III domains, two Ig-like C2-type (immunoglobulin-like) domains, and one tyrosine kinase domain. Mutations in this gene have been associated with disruption of the retinal pigment epithelium (RPE) phagocytosis pathway and onset of autosomal recessive retinitis pigmentosa (RP). [provided by RefSeq, Jul 2008]. Publication Note: This RefSeq record includes a subset of the publications that are available for this gene. Please see the Gene record to access additional publications. ##Evidence-Data-START## Transcript exon combination :: U08023.1, AK316584.1 [ECO:0000332] RNAseq introns :: single sample supports all introns ERS025083, ERS025084 [ECO:0000348] ##Evidence-Data-END## |
| 131 | MFSD5 | exonic | 84975 | major facilitator superfamily domain-containing protein 5 isoform 1 | N/A |
| 132 | MIF | exonic | 4282 | macrophage migration inhibitory factor | This gene encodes a lymphokine involved in cell-mediated immunity, immunoregulation, and inflammation. It plays a role in the regulation of macrophage function in host defense through the suppression of anti-inflammatory effects of glucocorticoids. This lymphokine and the JAB1 |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | protein form a complex in the cytosol near the peripheral plasma membrane, which may indicate an additional role in integrin signaling pathways. [provided by RefSeq, Jul 2008]. Publication Note: This RefSeq record includes a subset of the publications that are available for this gene. Please see the Gene record to access additional publications. ##Evidence-Data-START## Transcript exon combination :: BU599051.1, BC022414.1 [ECO:0000332] RNAseq introns :: single sample supports all introns ERS025081, ERS025082 [ECO:0000348] ##Evidence-Data-END## |
| 133 | MIR32 6 | exoni c | 442900 | (miRNAs) are short (20-24 nt) non-coding RNAs that are involved in post transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-ceding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. Publication Note: This RefSeq record includes a subset of the publications that are available for this gene. Please see the Gene record to access additional publications. |
| 134 | MIR31 93 | exoni c | 1004229 04 | (miRNAs) are short (20-24 nt) non-coding RNAs that are involved in post-transcriptional regulation of gene expression in multicellular | microRNAs (miRNAs) are short (20-24 nt) non-coding RNAs that are involved in stability and post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non- |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha | coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The primary transcripts mature miRNA is incorporated into a RNA-induced silencing complex (RISC), that which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a primary transcript predicted microRNA stem-loop as defined by miRBase. Some sequence at the 5' and 3' ends may not be included in the intermediate precursor miRNA produced by Drosha cleavage. |
| 135 | MPHOSPH8 | exonic | 54737 | M-phase phosphoprotein 8 | N/A |
| 136 | MRPL41 | exonic | 64975 | 39S ribosomal protein L41, mitochondrial | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 39S subunit protein that belongs to the YmL27 ribosomal protein family. [provided by RefSeq, Jul 2008]. Publication Note: This RefSeq record includes a subset of the publications that are available for this gene. Please see the Gene record to access additional publications. ##RefSeq-Attributes-START## gene product(s) localized to mito. :: reported by MitoCarta ##RefSeq-Attributes-END## ##Evidence-Data-START## Transcript exon combination :: BC040035.1, BE387384.1 (ECO:0000332) RNAseq introns :: single sample supports all introns ERS025081, ERS025082 [ECO:0000348] ##Evidence-Data-END## |
| 137 | MTCH2 | exonic | 23788 | mitochondrial carrier homolog 2 | N/A |
| 138 | MTFM | exonic | 123263 | methionyl-tRNA | The protein encoded by this nuclear gene localizes |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | T | c | | formyltransferase, mitochondrial | to the mitochondrion, where it catalyzes the formylation of methionyl-tRNA. [provided by RefSeq, Jun 2011]. ##RefSeq-Attributes-START## gene product(s) localized to mito. reported by MitoCarta ##RefSeq-Attributes-END## ##Evidence-Data-START## Transcript exon combination :: BC033687.1, AK055688.1 [ECO:0000332] RNAseq introns :: single sample supports all introns ER5025084 (ECO:0000348] ##Evidence-Data-END## |
| 139 | MYO1 B | exoni c | 4430 | unconventional myosin-Ib isoform 1 | N/A |
| 140 | NAV3 | intron ic | 89795 | neuron navigator 3 | This gene belongs to the neuron navigator family and is expressed predominantly in the nervous system. The encoded protein contains coiled-coil domains and a conserved AAA domain characteristic for ATPases associated with a variety of cellular activities. This gene is similar to unc-53, a Caenorhabditis elegans gene involved in axon guidance. Multiple alternatively spliced transcript variants for this gene have been described but only one has had its full-length nature determined. [provided by RefSeq, Jul 2008]. Publication Note: This RefSeq record includes a subset of the publications that are available for this gene. Please see the Gene record to access additional publications. ##Evidence-Data-START## RNAseq introns :: mixed/partial sample support ERS025081, ERS025082 [ECO:0000350] ##Evidence-Data-END## |
| 141 | NBEA | exoni c | 26960 | neurobeachin isoform 1 | This gene encodes a member of a large, diverse group of A-kinase anchor proteins that target the activity of protein kinase A to specific subcellular sites by binding to its type II regulatory subunits. Brain-specific expression and coat protein-like membrane recruitment of a highly similar protein in mouse suggest an involvement in neuronal post-Golgi membrane traffic. Mutations in this gene may be associated with a form of autism. This gene and its expression are frequently disrupted in patients with multiple myeloma. Alternative splicing results in multiple transcript variants encoding distinct isoforms. Additional transcript variants may exist, but their full-length nature has not been determined.[provided by RefSeq, Feb 2011]. Transcript Variant: This variant (1) represents the longer transcript and encodes the longer isoform (1). Publication Note: This RefSeq record includes a subset of the publications that are available for this gene. Please see the Gene record to access |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | additional publications. ##Evidence-Data-START## CDS exon combination :: AF467288.1 [ECO:0000331] RNAseq introns :: single sample supports all introns ERS025082, ERS025088 [ECO:0000348] intEvidence-Data-END## |
| 142 | NDUFAF2 | both | 91942 | mimitin, mitochondrial | NADH:ubiquinone oxidoreductase (complex I) catalyzes the transfer of electrons from NADH to ubiquinone (coenzyme Q) in the first step of the mitochondrial respiratory chain, resulting in the translocation of protons across the inner mitochondrial membrane. This gene encodes a complex I assembly factor. Mutations in this gene cause progressive encephalopathy resulting from mitochondrial complex I deficiency. [provided by RefSeq, Jul 2008]. ##RefSeq-Attributes-START## gene product(s) localized to mito.:: PMID: 16200211; reported by MitoCarta ##RefSeq-Attributes-END## ##Evidence-Data-START## Transcript exon combination :: CN345284.1, AF087990.1 [ECO:0000332] RNAseq introns :: single sample supports all introns ERS025084, ERS025088 [ECO:0000348] ##Evidence-Data-END## |
| 143 | NDUFC2-KCTD14 | exonic | 100532726 | NADH dehydrogenase [ubiquinone] 1 subunit C2, isoform 2 isoform 1 | This locus represents naturally occurring read-through transcription between the neighboring NDUFC2 (NADH dehydrogenase (ubiquinone) 1, subcomplex unknown, 2, 14.5kDa) and KCTD14 (potassium channel tetramerisation domain containing 14) genes on chromosome 11. The read-through transcripts share sequence identity with the upstream gene product and one variant has a frameshifted C-terminal region derived from the downstream gene exons. [provided by RefSeq, Feb 2011]. Transcript Variant: This variant (1) represents the longest transcript and encodes the longest isoform (1). Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: FY211285.1, FY212562.1 [ECO:0000332] ##Evidence-Data-END## ##RefSeq-Attributes-START## readthrough transcript :: includes exons from GeneID 4718, 65987 ##RefSeq-Attributes-END## |
| 144 | NDUFS4 | intronic | 4724 | NADH dehydrogenase [ubiquinone] iron-sulfur protein 4, | This gene encodes an accessory subunit of the mitochondrial membrane respiratory chain NADH dehydrogenase (Complex I), or NADH:ubiquinone oxidoreductase, the first multi-subunit enzyme |

Figure 10A (Continued)

| Figure 10A | | | | | |
|---|---|---|---|---|---|
| Gene Number (GN) | RefSeq Gene Symbol | Exon _overlap | NCBI_Gene_ID | Gene_Description | RefSeq_Summary |
| | | | | mitochondrial precursor | complex of the mitochondrial respiratory chain. Complex I plays a vital role in cellular ATP production, the primary source of energy for many crucial processes in living cells. It removes electrons from NADH and passes them by a series of different protein-coupled redox centers to the electron acceptor ubiquinone. In well-coupled mitochondria, the electron flux leads to ATP generation via the building of a proton gradient across the inner membrane. Complex I is composed of at least 41 subunits, of which 7 are encoded by the mitochondrial genome and the remainder by nuclear genes. [provided by RefSeq, Jul 2008]. Publication Note: This RefSeq record includes a subset of the publications that are available for this gene. Please see the Gene record to access additional publications. ##RefSeq-Attributes-START## gene product(s) localized to mito. :: reported by MitoCarta ##RefSeq-Attributes-END## ##Evidence-Data-START## Transcript exon combination :: BP375708.1, CD173665.1 [ECO:0000332] RNAseq introns :: single sample supports all introns ERS025081, ERS025082 [ECO:0000348] ##Evidence-Data-END## |
| 145 | NDUFV1 | exonic | 4723 | NADH dehydrogenase [ubiquinone] flavoprotein 1, mitochondrial isoform 1 precursor | The mitochondrial respiratory chain provides energy to cells via oxidative , phosphorylation and consists of four membrane-bound electron-transporting protein complexes (I-IV) and an ATP synthase (complex V). This gene encodes a 51 kDa subunit of the NADH:ubiquinone oxidoreductase complex I; a large complex with at least 45 nuclear and mitochondrial encoded subunits that liberates electrons from NADH and channels them to ubiquinone. This subunit carries the NADH-binding site as well as flavin mononucleotide (FMN)- and Fe-S-biding sites. Defects in complex I are a common cause of mitochondrial dysfunction; a syndrome that occurs in approximately 1 in 10,000 live births. Mitochondrial complex I deficiency is linked to myopathies, encephalomyopathies, and neurodegenerative disorders such as Parkinson's disease and Leigh syndrome. Alternative splicing results in multiple transcript variants encoding distinct isoforms.[provided by RefSeq, Oct 2009]. Transcript Variant: This variant (1) represents the longer transcript and encodes the longer protein (isoform 1). Publication Note: This RefSeq record includes a subset of the publications that are available for this gene. Please see the Gene record to access additional publications. ##Evidence-Data-START## Transcript exon combination :: |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | AF092131.1, AF053070.1 [ECO:0000332] RNAseq introns single sample supports all introns ERS025081, ERS025082 [ECO:0000348] ##Evidence-Data-END## ##RefSeq-Attributes-START## gene product(s) localized to mito. :: reported by MitoCarta ##RefSeq-Attributes-END## |
| 146 | NEU3 | exonic | 10825 | sialidase-3 | This gene product belongs to a family of glycohydrolytic enzymes which remove sialic acid residues from glycoproteins and glycolipids. It is localized in the plasma membrane, and its activity is specific for gangliosides. It may play a role in modulating the ganglioside content of the lipid bilayer. [provided by RefSeq, Jul 2008]. Publication Note: This RefSeq record includes a subset of the publications that are available for this gene. Please see the Gene record to access additional publications. ##Evidence-Data-START## Transcript exon combination :: DB240271.1, Y18563.1 [ECO:0000332] RNAseq introns :: single sample supports all introns ERS025081, ERS025083 [ECO:0000348] ##Evidence-Data-END## |
| 147 | NLRC4 | exonic | 58484 | NLR family CARD domain-containing protein 4 | In C. elegans, Ced4 binds and activates Ced3, an apoptotic initiator caspase, via caspase-associated recruitment domains (CARDs). Human Ced4 homologs include APAF1 (MIM 602233), NOD1/CARD4 (MIM 605980), and NOD2/CARD15 (MIM 605956). These proteins have at least 1 N-terminal CARD domain followed by a centrally located nucleotide-binding domain (NBD or NACHT) and a C-terminal regulatory domain, found only in mammals, that contains either WD40 repeats or leucine-rich repeats (LRRs). CARD12 is a member of the Ced4 family and can induce apoptosis;supplied by OMIM, Mar 2008]. Transcript Variant: This variant (1) and variants 2 and 3 encode the--same protein. Publication Note: This RefSeq record includes a subset of the publications that are available for this gene. Please see the Gene record to access additional publications. ##Evidence-Data-START## Transcript exon combination :: AY027787.1 [ECO:0000332] RNAseq introns :: single sample domain-containing supports all introns ERS025084, ERS025088 [ECO:0000348] ##Evidence-Data-END## |
| 148 | NLRP3 | exonic | 114548 | NACHT, LRR and PYD domains-containing protein 3 isoform a | binding site (NBS) domain, and a leucine-rich repeat (LRR) motif. This protein interacts with the apoptosis-associated speck-like protein PYCARD/ASC, which contains a caspase recruitment domain, and is a member of the NALP3 |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | inflammasome complex. This complex functions as an upstream activator of NF-kappaB signaling, and it plays a role in the regulation of inflammation, the immune response, and apoptosis. Mutations in this gene are associated with familial cold autoinflammatory syndrome (FCAS), Muckle-Wells syndrome (MWS), chronic infantile neurological cutaneous and articular (CINCA) syndrome, and neonatal-onset multisystem inflammatory disease (NOMID). Multiple alternatively spliced transcript variants encoding distinct isoforms have been identified for this gene. Alternative 5' UTR structures are suggested by available data; however, insufficient evidence is available to determine if all of the represented 5' UTR splice patterns are biologically valid. [provided by RefSeq, Oct 2008]. Transcript Variant: This variant (1) represents the longest transcript and encodes the longest isoform (a). Both variants 1 and 3 encode the same isoform. Sequence Note: This RefSeq contains an alternative downstream translation start codon, which would result in a protein that is 2 as shorter at the N-terminus. The residue coordinates referred to in the literature, including PMIDs:11687797, 11786556 and 12522564, are based on the use of the downstream start codon. No experimental evidence exists to show which start codon is preferentially used. The RefSeq transcript and protein were derived from genomic sequence to make the sequence consistent with the reference genome assembly. The genomic coordinates used for the transcript record were based on transcript alignments. CCDS Note: This CCDS representation uses the 5'-most in-frame start codon, which is conserved in primates, rat, kangaroo rat, dolphin, cow, cat, elephant, tenrec |
| 149 | NLRP1 4 | exoni c | 338323 | NACHT, LRR and PYD domains-containing protein 14 | The protein encoded by this gene belongs to the NALP protein family. Members of the NALP protein family typically contain a NACHT domain, a NACHT-associated domain (NAD), a C-terminal leucine-rich repeat (LRR) region, and an N-terminal pyrin domain (PYD). This protein may play a regulatory role in the innate immune system as similar family members belong to the signal-induced multiprotein complex, the inflammasome, that activates the pro-inflammatory caspases, caspase-1 and caspase-5. [provided by RefSeq, Jul 2008]. ##Evidence-Data-START## CDS exon combination :: BK001107.1, AY154469.1 [ECO:0000331] ##Evidence-Data-END## |
| 150 | NQ01 | exoni | 1728 | NAD(P)H | This gene is a member of the NAD(P)H |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | c | | dehydrogenase [quinone] 1 isoform a | dehydrogenase (quinone) family and encodes a cytoplasmic 2-electron reductase. This FAD-binding protein forms homodimers and reduces quinones to hydroquinones. This protein's enzymatic activity prevents the one electron reduction of quinones that results in the production of radical species. Mutations in this gene have been associated with tardive dyskinesia (TD), an increased risk of hematotoxicity after exposure to benzene, and susceptibility to various forms of cancer. Altered expression of this protein has been seen in many tumors and is also associated with Alzheimer's disease (AD). Alternate transcriptional splice variants, encoding different isoforms, have been characterized. [provided by RefSeq, Jul 2008]. Transcript Variant: This variant (1) represents the longest transcript and encodes the longest isoform (a). Publication Note: This RefSeq record includes a subset of the publications that are available for this gene. Please see the Gene record to access additional publications. ##Evidence-Data-START## Transcript exon combination :: J03934.1, BC007659.2 [ECO:0000332] RNAseq introns :: single sample supports all introns ERS025081, ERS025082 [ECO:0000348] ##Evidence-Data-END## |
| 151 | NUDT 8 | exoni c | 254552 | Nucleoside diphosphate-linked moiety X motif 8, mitochondrial isoform 1 | N/A |
| 152 | NUDT 17 | exoni c | 200035 | Nucleoside diphosphate-linked moiety X motif 17 | N/A |
| 153 | NUP54 | exoni c | 53371 | nucleoporin p54 isoform 1 | The nuclear envelope creates distinct nuclear and cytoplasmic compartments in eukaryotic cells. It consists of two concentric membranes perforated by nuclear pores, large protein complexes that form aqueous channels to regulate the flow of macromolecules between the nucleus and the cytoplasm. These complexes are composed of at least 100 different polypeptide subunits, many of which belong to the nucleoporin family. This gene encodes a member of the phe-gly (FG) repeat-containing nucleoporin subset. Multiple alternatively spliced transcript variants have been found for this gene. [provided by RefSeq, Jun 2013]. Transcript Variant: This variant (1) encodes the longer isoform (1). ##Evidence-Data-START## Transcript exon combination :: BC012559.1, AK001517.1 [ECO:0000332] RNAseq introns :: |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | single sample supports all introns ERS025098 [ECO:0000348] ##Evidence-Data-END## |
| 154 | PABPC1L | exonic | 80336 | polyadenylate-binding protein 1 like | N/A |
| 155 | PABPN1L | exonic | 390748 | embryonic polyadenylate-binding protein 2 | N/A |
| 156 | PACRG | both | 135138 | parkin coregulated gene protein isoform 1 | This gene encodes a protein that is conserved across metazoans. In vertebrates, this gene is linked in a head-to-head arrangement with the adjacent parkin gene, which is associated with autosomal recessive juvenile Parkinson's disease. These genes are co-regulated in various tissues and they share a bi-directional promoter. Both genes are associated with susceptibility to leprosy. The parkin co-regulated gene protein forms a large molecular complex with chaperones, including heat shock proteins 70 and 90, and chaperonin components. This protein is also a component of Lewy bodies in Parkinson's disease patients, and it suppresses unfolded Pael receptor-induced neuronal cell death. Multiple transcript variants encoding different isoforms have been found for this gene. [provided by RefSeq, Jul 2008]. Transcript Variant: This variant (1) represents the longest transcript and encodes the longer isoform' (1). Publication Note: This RefSeq record includes a subset of the publications that are available for this gene. Please see the Gene record to access additional publications. ##Evidence-Data-START## Transcript exon combination :: AK057286.1 [ECO:0000332] RNAseq introns :: mixed/partial sample support ERS025083, ERS025084 [ECO:0000350J ##Evidence-Data-END## |
| 157 | PACRGL | exonic | 133015 | N/A | N/A |
| 158 | PAK6 | exonic | 56924 | serine/threonine-protein kinase PAK 6 isoform 1 | This gene encodes a member of a family of p21-stimulated serine/threonine protein kinases, which contain an amino-terminal Cdc42/Rac interactive binding (CRIB) domain and a carboxyl-terminal kinase domain. These kinases function in a number of cellular processes, including cytoskeleton rearrangement, apoptosis, and the mitogen-activated protein (MAP) kinase signaling pathway. The protein encoded by this gene interacts with androgen receptor (AR) and translocates to the nucleus, where it is involved in transcriptional regulation. Changes in expression of this gene have been linked to prostate cancer. Alternative splicing |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | results in multiple transcript variants. [provided by RefSeq, Mar 2013]. Transcript Variant: This variant (1) encodes isoform 1. Variants 1, 2, 3, and 4 encode the same isoform (1). Publication Note: This RefSeq record includes a subset of the publications that are available for this gene. Please see the Gene record to access additional publications. ##Evidence-Data-START## Transcript exon combination :: AI236915.1 [ECO:0000332] RNAseq introns :: single sample supports all introns ERS025088 [ECO:0000348] ##Evidence-Data-END## |
| 159 | PANX1 | exonic | 24145 | pannexin-1 | The protein encoded by this gene belongs to the innexin family. Innexin family members are the structural components of gap junctions. This protein and pannexin 2 are abundantly expressed in central nerve system (CNS) and are coexpressed in various neuronal populations. Studies in Xenopus oocytes suggest that this protein alone and in combination with pannexin 2 may form cell type-specific gap junctions with distinct properties. [provided by RefSeq, Jul 2008]. Publication Note: This RefSeq record includes a subset of the publications that are available for this gene. Please see the Gene record to access additional publications. ##Evidence-Data-START## Transcript exon combination :: BC016931.1, AK074897.1 [ECO:0000332] RNAseq introns single sample supports all introns ERS025081, ERS025082 [ECO:0000348] ##Evidence-Data-END## |
| 160 | PDE3B | exonic | 5410 | cGMP-inhibited 3',5'-cyclic phosphodiesterase B | N/A |
| 161 | PDE4D | both | 5144 | cAMP-specific 3',5'-cyclic phosphodiesterase 4D isoform PDE4D1 | This gene encodes one of four mammalian counterparts to the fruit fly 'dunce' gene. The encoded protein has 3',5-cyclic-AMP phosphodiesterase activity and degrades cAMP, which acts as a signal transduction molecule in multiple cell types. This gene uses different promoters to generate multiple alternatively spliced transcript variants that encode functional proteins.(provided by RefSeq, Sep 2009]. Transcript Variant: This variant (8) differs in the 5' UTR and coding region, compared to variant 1. Isoform PDE4D1 (also known as isoform 8) is shorter and has a distinct N-terminus, compared to isoform PDE4D4. Sequence Note: This RefSeq record was created from transcript and genomic sequence data to make the sequence consistent with the reference genome assembly. The genomic coordinates used |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | for the transcript record were based on transcript alignments. Publication Note: This RefSeq record includes a subset of the publications that are available for this gene. Please see the Gene record to access additional publications. ##Evidence-Data-START## Transcript exon combination :: U50157.1 [ECO:0000332] RNAseq introns :: single sample supports all introns ERS025084, ERS025098 [ECO:0000348] ##Evidence-Data-END## |
| 162 | PEX11 B | exoni c | 8799 | encoded by this gene facilitates peroxisomal proliferation and interacts with PEX19. The encoded protein is found in the peroxisomal membrane. Several transcript variants, some protein-coding and some not protein-coding, have been found for this gene. [provided by Ref Seq, Dec 2012]. Transcript Variant: This variant (3) uses and alternate splice junction at the 3' end of the rirst exon comparet to variant 1. This prefoldin subunit 5 isoform alpha | The protein encoded by this gene facilitates peroxisomal proliferation and interacts with PEX19. The encoded protein is found in the peroxisomal membrane. Several transcript variants, some protein-coding and some not protein-coding, have been found for this gene. [provided by RefSeq, Dec 2012]. Transcript Variant: This variant (3) uses an alternate splice junction at the 3' end of the first exon compared to variant 1. This variant is represented as non-coding due to the presence of an upstream ORF that is predicted to interfere with translation of the longest ORF; translation of the upstream ORF renders the transcript a candidate for nonsense-mediated mRNA decay (NMD). Publication Note: This RefSeq record includes a subset of the publications that are available for this gene. Please see the Gene record to access additional publications. ##Evidence-Data-START## Transcript exon combination :: HY110059.1, HY108328.1 [ECO:0000332] RNAseq introns :: single sample supports all introns ERS025081, ERS025086 [ECO:0000348) ##Evidence-Data-END## |
| 163 | PFDN5 | exoni c | 5204 | prefoldin subunit 5 isoform alpha | This gene encodes a member of the prefoldin alpha subunit family. The encoded protein is one of six subunits of prefoldin, a molecular chaperone complex that binds and stabilizes newly synthesized polypeptides, thereby allowing them to fold correctly. The complex, consisting of two alpha and four beta subunits, forms a double beta barrel assembly with six protruding coiled-coils. The encoded protein may also repress the transcriptional activity of the proto-oncogene c-Myc. Alternatively spliced transcript variants encoding different isoforms have been described. [provided by RefSeq, Jul 2008]. Transcript Variant: This variant (1) encodes the longest isoform (alpha). Publication Note: This RefSeq record includes a subset of the |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | publications that are available for this gene. Please see the Gene record to access additional publications. ##Evidence-Data-START## Transcript exon combination :: BI856104.1, BG707826.1 [ECO:0000332] RNAseq introns :: single sample supports all introns ERS025081, ERS025082 [ECO:0000348] ##Evidence-Data-END## |
| 164 | PGLY RP4 | exoni c | 57115 | peptidoglycan recognition protein 4 precursor | Peptidoglycan recognition proteins, such as PGRPI-beta, are part of the innate immune system and recognize peptidoglycan, a ubiquitous component of bacterial cell walls.[supplied by OMIM, Apr 2004]. ##Evidence-Data-START## Transcript exon combination :: AY035377.1, BC142636.1 [ECO:0000332] ##Evidence-Data-END## |
| 165 | PGM5 | exoni c | 5239 | phosphoglucomuta and actin regulator 3 isoform 1 | This gene encodes a member of the phosphatase and actin regulator protein family. The encoded protein is associated with the nuclear scaffold in proliferating cells, and binds to actin and the catalytic subunit of protein phosphatase-1, suggesting that it functions as a regulatory subunit of protein phosphatase-1. Alternative splicing results in multiple transcript variants. [provided by RefSeq, Jul 2013]. Transcript Variant: This variant (1) represents the longest transcript and encodes the longest isoform (1). ##Evidence-Data- START## Transcript exon combination :: BC108303.1, AI311122.2 [ECO:0000332] RNAseq introns :: single sample supports all introns ERS025082, ERS025084 [ECO:0000348] ##Evidence-Data-END## |
| 166 | PHAC TR3 | intron ic | 116154 | phosphatase and actin regulator 3 | This gene encodes a member of the phosphatase and actin regulator protein family. The encoded protein is associated with the nuclear scaffold in proliferating cells, and binds to actin and the catalytic subunit of protein phosphatase-1, suggesting that it functions as a regulatory subunit of protein phosphatase-1. Alternative splicing results in multiple transcript variants. [provided by RefSeq, Jul 2013]. Transcript Variant: This variant (1) represents the longest transcript and encodes the longest isoform (1). ##Evidence-Data- START## Transcript exon combination :: BC108303.1, AI311122.2 [ECO:0000332] RNAseq introns :: single sample supports all introns ERS025082, ERS025084 [ECO:0000348] ##Evidence-Data-END## |
| 167 | PHAC TR4 | exoni c | 65979 | phosphatase and actin regulator 4 isoform 1 | This gene encodes a member of the phosphatase and actin regulator (PHACTR) family. Other PHACTR family members have been shown to inhibit protein phosphatase 1 (PP1) activity, and the homolog of |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | this gene in the mouse has been shown to interact with actin and PP1. Multiple transcript variants encoding different isoforms have been found for this gene. [provided by RefSeq, Jul 2008]. Transcript Variant: This variant (1) represents the longer transcript but encodes the shorter isoform (1). Sequence Note: This RefSeq record was created from transcript and genomic sequence data to make the sequence consistent with the reference genome assembly. The genomic coordinates used for the transcript record were based on transcript alignments. ittiEvidence-Data-START## Transcript exon combination :: CR749449.1, BC029266.1 [ECO:0000332] RNAseq introns :: single sample supports all introns ERS025084, ERS025087 [ECO:0000348] ##Evidence-Data-END## |
| 168 | PI4KAP1 | exonic | 728233 | N/A | N/A |
| 169 | PIAS3 | exonic | 10401 | E3 SUMO-protein ligase PIAS3 | This gene encodes a member of the PIAS [protein inhibitor of activated STAT (signal transducer and activator of transcription)] family of transcriptional modulators. The protein functions as a SUMO (small ubiquitin-like modifier)-E3 ligase which catalyzes the covalent attachment of a SUMO protein to specific target substrates. It directly binds to several transcription factors and either blocks or enhances their activity. Alternatively spliced transcript variants of this gene have been identified, but the full-length nature of some of these variants has not been determined. [provided by RefSeq, Jul 2008]. Publication Note: This RefSeq record includes a subset of the publications that are available for this gene. Please see the Gene record to access additional publications. ##Evidence-Data-START## Transcript exon combination :: BC001154.1.[ECO:0000332] RNAseq introns :: single sample supports all introns ERS025081, ERS025082 [ECO:0000348] ##Evidence-Data-END## |
| 170 | PIK3C3 | exonic | 5289 | phosphatidylinositol 3-kinase catalytic subunit type 3 | N/A |
| 171 | PIP5K1B | exonic | 8395 | phosphatidylinositol 4-phosphate 5 kinase type-1 beta isoform 2 | N/A |
| 172 | PLA2G6 | exonic | 8398 | 85/88 kDa calcium-independent phospholipase A2 | The protein encoded by this gene is an A2 phospholipase, a class of enzyme that catalyzes the release of fatty acids from phospholipids. The |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | isoform a | encoded protein may play a role in phospholipid remodelling, arachidonic acid release, leukotriene and prostaglandin synthesis, fas-mediated apoptosis, and transmembrane ion flux in glucose-stimulated B-cells. Several transcript variants encoding multiple isoforms have been described, but the full-length nature of only three of them have been determined to date. [provided by RefSeq, Dec 2010]. Transcript Variant: This variant (1) represents the longest transcript and encodes the longer isoform (a). Isoform a is membrane-bound while isoform b is found in the cytoplasm. Publication Note: This RefSeq record includes a subset of the publications that are available for this gene. Please see the Gene record to access additional publications. ##Evidence-Data-START## Transcript exon combination :: AL080187.1, BC036742.1 [ECO:0000332] RNAseq introns :: single sample supports all introns ERS025084 [ECO:0000348] ##Evidence-Data-END## |
| 173 | PNPLA 7 | exoni c | 375775 | patatin-like phospholipase domain-containing protein 7 isoform a DNA-directed RNA polymerase III subunit PRC3 | Human patatin-like phospholipases, such as PNPLA7, have been implicated in regulation of adipocyte differentiation and have been induced by metabolic stimuli (Wilson et al., 2006 [PubMed 16799181]).[supplied by OMIM, Jun 2008]. Transcript Variant: This variant (1) represents the longer transcript and encodes the longer isoform (a). ilitEvidence-Data-START## RNAseq introns mixed/partial sample support ER5025081, ERS025082 [ECO:0000350] ##Evidence-Data-END## |
| 174 | POLR3 C | exoni c | 10623 | DNA-directed RNA polymerase III submit RPC3 | N/A |
| 175 | POLR3 GL | exoni c | 84265 | DNA-directed RNA polymerase III submit RPC7-like | N/A |
| 176 | POTEF | exoni c | 728378 | POTE ankyrin domain family member F | N/a |
| 177 | PPAD C1B | exoni c | 84513 | Phosphatidate phosphatase PPAPDC1B isoform 1 | N/A |
| 178 | PRCP | exoni c | 5547 | lysosomal Pro-X carboxypeptidase isoform 1 preproprotein | The protein encoded by this gene is a lysosomal prolylcarboxypeptidase, which cleaves C-terminal amino acids linked to proline in peptides such as angiotension II, III and des-Arg9-bradykinin. The cleavage occurs at acidic pH, but the enzyme |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | activity is retained with some substrates at neutral pH. This enzyme has been shown to be an activator of the cell matrix-associated prekallikrein. The importance of angiotension II, one of the substrates of this enzyme, in regulating blood pressure and electrolyte balance suggests that this gene may be related to essential hypertension. Alternatively spliced transcript variants encoding distinct isoforms have been observed. [provided by RefSeq, Jul 2008). Transcript Variant: This variant (1) lacks an alternate in-frame exon compared to variant 2. The resulting isoform (1) has the same N- and C-termini but is shorter compared to isoform 2. Publication Note: This RefSeq record includes a subset of the publications that are available for this gene. Please see the Gene record to access additional publications. fitlEvidence-Data-START## Transcript exon combination :: BC001500.2, L13977.1 [ECO:0000332] RNAseq introns :: single sample supports all introns ER5025084, ERS025088 [ECO:0000348] ##Evidence-Data-END## |
| 179 | PRKA A1 | exoni c | 5562 | 5'-AMP-activated protein kinase catalytic subunit alpha-1 isoform 1 | The protein encoded by this gene belongs to the ser/thr protein kinase family. It IS the catalytic subunit of the 5'-prime-AMP-activated protein kinase (AMPK). AMPK is a cellular energy sensor conserved in all eukaryotic cells. The kinase activity of AMPK is activated by the stimuli that increase the cellular AMP/ATP ratio. AMPK regulates the activities of a number of key metabolic enzymes through phosphorylation. It protects cells from stresses that cause ATP depletion by switching off ATP-consuming biosynthetic pathways. Alternatively spliced transcript variants encoding distinct isoforms have been observed. [provided by RefSeq, Jul 2008]. Transcript Variant: This variant (1) appears to represent the more predominantly expressed transcript. It lacks an in-frame coding exon compared to variant 2. The resulting isoform (1) lacks an internal segment, as compared to isoform 2. Publication Note: This RefSeq record includes a subset of the publications that are available for this gene. Please see the Gene record to access additional publications. ##Evidence-Data-START## Transcript exon combination :: 8C037303.2, AB022017.1 [ECO:0000332] RNAseq introns :: single sample supports all introns ERS025084, ERS025088 [ECO:0000348] ##Evidence-Data-END## |
| 180 | PRKA CG | exoni c | 5568 | cAMP-dependent protein kinase | Cyclic AMP-dependent protein kinase (PKA) consists of two catalytic subunits and a regulatory |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | catalytic subunit gamma | subunit dimer. This gene encodes the gamma form of its catalytic subunit. The gene is intronless and is thought to be a retrotransposon derived from the gene for the alpha form of the PKA catalytic subunit. [provided by RefSeq, Jul 2008]. Publication Note: This RefSeq record includes a subset of the publications that are available for this gene. Please see the Gene record to access additional publications. ##Evidence-Data-START## Transcript is intronless BC039888.1 [ECO:0000345] ##Evidence-Data-END## |
| 181 | PRKA G2 | intron ic | 51422 | 5'-AMP-activated protein kinase subunit gamma-2 isoform a | AMP-activated protein kinase (AMPK) is a heterotrimeric protein composed of a catalytic alpha subunit, a noncatalytic beta subunit, and a noncatalytic regulatory gamma subunit. Various forms of each of these subunits exist, encoded by different genes. AMPK is an important energy-sensing enzyme that monitors cellular energy status and functions by inactivating key enzymes involved in regulating de novo biosynthesis of fatty acid and cholesterol. This gene is a member of the AMPK gamma subunit family and encodes a protein with four cystathionine beta-synthase domains. Mutations in this gene have been associated with ventricular pre-excitation (Wolff-Parkinson-White syndrome), progressive conduction system disease and cardiac hypertrophy. Alternate transcriptional splice variants, encoding different isoforms, have been characterized. [provided by RefSeq, Jul 2008]. Transcript Variant: This variant (a) represents the longest transcript and encodes the longest isoform (a, also referred to as PRKAG2-a). Publication Note: This RefSeq record includes a subset of the publications that are available for this gene. Please see the Gene record to access additional publications. ##Evidence-Data-START## Transcript exon combination :: AI249976.1 [ECO:0000332] RNAseq introns :: mixed/partial sample support ERS025081, ERS025082 [ECO:0000350] ##Evidence-Data-END## |
| 182 | PRKA R2B | intron ic | 5577 | cAM P-dependent protein kinase type II-beta regulatory subunit | cAMP is a signaling molecule important for a variety of cellular functions. cAMP exerts its effects by activating the cAMP-dependent protein kinase, which transduces the signal through phosphorylation of different target proteins. The inactive kinase holoenzyme is a tetramer composed of two regulatory and two catalytic subunits. CAMP causes the dissociation of the inactive holoenzyme into a dimer of regulatory subunits bound to four cAMP and two free monomeric catalytic subunits. Four different regulatory subunits and three |

| Gene Number (GN) | RefSeq Gene Symbol | Exon_overlap | NCBI_Gene_ID | Gene_Description | RefSeq_Summary |
|---|---|---|---|---|---|
| | | | | | catalytic subunits have been identified in humans. The protein encoded by this gene is one of the regulatory subunits. This subunit can be phosphorylated by the activated catalytic subunit. This subunit has been shown to interact with and suppress the transcriptional activity of the cAMP responsive element binding protein 1 (CREB1) in activated T cells. Knockout studies in mice suggest that this subunit may play an important role in regulating energy balance and adiposity. The studies also suggest that this subunit may mediate the gene induction and cataleptic behavior induced by haloperidol. [provided by RefSeq, Jul 2008]. Publication Note: This RefSeq record includes a subset of the publications that are available for this gene. Please see the Gene record to access additional publications. ##Evidence-Data-START## Transcript exon combination :: BC075800.1, AK291441.1[ECO:0000332] RNAseq introns single sample supports all introns ERS025081, ERS025082 [ECO:0000348] ##Evidence-Data-END## |
| 183 | PSAP | exonic | 5660 | proactivator polypeptide isoform a preproprotein | This gene encodes a highly conserved glycoprotein which is a precursor for 4 cleavage products: saposins A, B, C, and D. Each domain of the precursor protein is approximately 80 amino acid residues long with nearly identical placement of cysteine residues and glycosylation sites. Saposins A-D localize primarily to the lysosomal compartment where they facilitate the catabolism of glycosphingolipids with short oligosaccharide groups. The precursor protein exists both as a secretory protein and as an integral membrane protein and has neurotrophic activities. Mutations in this gene have been associated with Gaucher disease, Tay-Sachs disease, and metachromatic leukodystrophy. Alternative splicing results in multiple transcript variants encoding different isoforms. [provided by RefSeq, Jul 2008]. Transcript Variant: This variant (1) lacks an exon in the coding region, compared to variant 2, resulting in a shorter protein (isoform a), compared to isoform b. Publication Note: This RefSeq record includes a subset of the publications that are available for this gene. Please see the Gene record to access additional publications. ##Evidence Data-START## Transcript exon combination :: BC007612.1, J03077.1[ECO:0000332] RNAseq introns :: mixed/partial sample support ERS025081, ERS025082 [ECO:0000350]##Evidence-Data-END## |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| 184 | PSEN1 | exonic | 5663 | presenilin-1 isoform 1-463 | Alzheimer's disease (AD) patients with an inherited form of the disease carry mutations in the presenilin proteins (PSEN1; PSEN2) or in the amyloid precursor protein (APP). These disease-linked mutations result in increased production of the longer form of amyloid-beta (main component of amyloid deposits found in AD brains). Presenilins are postulated to regulate APP processing through their effects on gamma-secretase, an enzyme that cleaves APP. Also, it is thought that the presenilins are involved in the cleavage of the Notch receptor, such that they either directly regulate gamma-secretase activity or themselves are protease enzymes. Several alternatively spliced transcript variants encoding different isoforms have been identified for this gene, the full-length nature of only some have been determined. [provided by RefSeq, Aug 2008]. Transcript Variant: This variant (2) uses an alternative donor splice site at one of the coding exons compared to transcript variant 1. It maintains the same reading frame, and encodes a shorter isoform (1-463) missing a'4 as peptide compared to isoform 1-467. Publication Note: This RefSeq record includes a subset of the publications that are available for this gene. Please see the Gene record to access additional publications. ##Evidence• Data-START## Transcript exon combination :: 8C011729.2 [ECO:0000332] RNAseq introns :: single sample supports all introns ERS025081, ERS025082[ECO:0000348] ##Evidence-Data-END## |
| 185 | PSPC1 | exonic | 55269 | a nucleolar protein that localizes to punctate subnuclear structures that occur close to splicing speckles, known as paraspeckles. These paraspeckles are composed of RNA-protein structures that include a non-coding RNA, NEAT1/Men epsilon/beta, and the Drosophila Behavior Human Splicing family of proteins, which include the product | This gene encodes a nucleolar protein that localizes to punctate subnuclear structures that occur close to splicing speckles, known as paraspeckles. These paraspeckles are composed of RNA-protein structures that include a non-coding RNA, NEAT1/Men epsilon/beta, and the Drosophila Behavior Human Splicing family of proteins, which include the product of this gene and the P54NRB/NONO and PSF/SFPQ proteins. Paraspeckles may function in the control of gene expression via an RNA nuclear retention mechanism. The protein encoded by this gene is found in paraspeckles in transcriptionally active cells, but it localizes to unique cap structures at the nucleolar periphery when RNA polymerase II transcription is inhibited, or during telophase. Alternative splicing of this gene results in multiple transcript variants. A related pseudogene, which is also located on chromosome 13, has been identified. [provided by RefSeq, Aug 2011]. Transcript |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | of this gene and the P54NRB/NONO and PSF/SFPQ proteins. | Variant: This variant (2, also known as PSP1-beta) contains alternate exon structure at its 3' end, compared to variant 1. This variant is represented as non-coding because the use of the supported translational start codon, as used in variant 1, renders the transcript a candidate for nonsense-mediated mRNA decay (NMD). Publication Note: This RefSeq record includes a subset of the publications that are available for this gene. Please see the Gene record to access additional publications. ##Evidence-Data-START## RNAseq introns :: single sample supports all introns ERS025084, ERS025098 [ECO:0000348] ##Evidence-Data-END## |
| 186 | PTPRR | exonic | 5801 | encoded by this gene is a member of the protein tyrosine phosphatase (PTP) family. PTPs are known to be signaling molecules that regulate a variety of cellular processes including cell growth, differentiation, mitotic cycle, oncogenic transformation. This PTP possesses an extracellular region, a single transmembrane region, and a single intracellular catalytic domain, and thus represents a receptor-type PTP. | The protein encoded by this gene is a member of the protein tyrosine phosphatase (PTP) family. PTPs are known to be signaling molecules that regulate a variety of cellular processes including cell growth, differentiation, mitotic cycle, and oncogenic transformation. This PTP possesses an extracellular region, a single transmembrane region, and a single intracellular and catalytic domain, and thus represents a receptor-type PTP. Silencing of this gene has been associated with colorectal cancer. Multiple transcript variants encoding different isoforms have been found for this gene. This gene shares a symbol (PTPRO) with another gene, protein tyrosine phosphatase, receptor type, Q (GeneID 374462), which is also located on chromosome 12. [provided by RefSeq, May 2011]. Transcript Variant: This variant (5) has multiple differences, compared to variant 1. This variant is represented as non-coding because the use of the 5'-most expected translational start codon, as used in variant 2, renders the transcript a candidate for nonsense-mediated mRNA decay (NMD). Publication Note: This RefSeq record includes a subset of the publications that are available for this gene. Please see the Gene record to access additional publications. ##Evidence-Data-START## Transcript exon combination :: 8C072386.1 [ECO:0000332] ##Evidence-Data-END## |
| 187 | PTPRT | intronic | 11122 | receptor-type tyrosine-protein phosphatase T isoform 1 precursor | The protein encoded by this gene is a member of the protein tyrosine phosphatase (PTP) family. PTPs are known to be signaling molecules that • regulate a variety of cellular processes including cell growth, differentiation, mitotic cycle, and oncogenic transformation. This PTP possesses an extracellular region, a single transmembrane region, and two tandem intracellular catalytic domains, and thus |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | represents a receptor-type PTP. The extracellular region contains a meprin-A5 antigen-PTP (MAM) domain, Ig-like and fibronectin type III-like repeats. The protein domain structure and the expression pattern of the mouse counterpart of this PTP suggest its roles in both signal transduction and cellular adhesion in the central nervous system. Two alternatively spliced transcript variants of this gene, which encode distinct proteins, have been reported. [provided by RefSeq, Jul 2008]. Transcript Variant: This variant (1) encodes the longer isoform (1). Publication Note: This RefSeq record includes a subset of the publications that are available for this gene. Please see the Gene record to access additional publications. ##Evidence-Data-START## RNAseq introns :: mixed/partial sample support ERS025081, ERS025082 [ECO:0000350].##Evidence-Data-END## |
| 188 | RAB27 A | intron ic | 5873 | ras-related protein Rab-27A | The protein encoded by this gene belongs to the small GTPase superfamily, Rab family. The protein is membrane-bound and may be involved in protein transport and small GTPase mediated signal transduction. Mutations in this gene are associated with Griscelli syndrome type 2. Alternative splicing occurs at this locus and four transcript variants encoding the same protein have been identified. [provided by RefSeq, Jul 2008]. Transcript Variant: This variant (1) represents the longest transcript. Variants 1, 2, 3 and 4 encode the same isoform. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: U38654.3, BM557278.1 [ECO:0000332] RNAseq introns :: single sample supports all introns ERS025081, ERS025082 NCO:0000348J ##Evidence-Data-END## |
| 189 | RAB30 | exoni c | 27314 | ras-related protein Rab-30 | N/A |
| 190 | RARG | exoni c | 5916 | retinoic acid receptor gamma isoform 1 | This gene encodes a retinoic acid receptor that belongs to the nuclear hormone receptor family. Retinoic acid receptors (RARs) act as ligand-dependent transcriptional regulators. When bound to ligands, RARs activate transcription by binding as heterodimers to the retinoic acid response |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | elements (RARE) found in the promoter regions of the target genes. In their unbound form, RARs repress transcription of their target genes. RARs are involved in various biological processes, including limb bud development, skeletal growth, and matrix homeostasis. Alternatively spliced transcript variants encoding different isoforms have been fo.und for this gene. [provided by RefSeq, Aug 2011]. Transcript Variant: This variant (1) encodes the longest isoform (1). Publication Note: This RefSeq record includes a subset of the publications that are available for this gene. Please see the Gene record to access additional publications. ##Evidence-Data-START## Transcript exon combination :: BC072462.1, AK290588.1 [ECO:0000332] RNAseq introns mixed/partial sample support ERS025081, ERS025082 [ECO:0000350] ##Evidence-Data-END## |
| 191 | RASL12 | exonic | 51285 | ras-like protein family member 12 | N/A |
| 192 | RBM8A | exonic | 9939 | RNA-binding protein 8A | This gene encodes a protein with a conserved RNA-binding motif. The protein is found predominantly in the nucleus, although it is also present in the cytoplasm. It is preferentially associated with mRNAs produced by splicing, including both nuclear mRNAs and newly exported cytoplasmic mRNAs. It is thought that the protein remains associated with spliced mRNAs as a tag to indicate where introns had been present, thus coupling pre- and post-mRNA splicing events. Previously, it was thought that two genes encode this protein, RBM8A and RBM8B; it is now thought that the RBM8B locus is a pseudogene. There are two alternate translation start codons with this gene, which result in two forms of the protein. An allele mutation and a low-frequency noncoding single-nucleotide polymorphism (SNP) in this gene cause thrombocytopenia-absent radius (TAR) syndrome. (provided by RefSeq, Jul 2013). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: AK075009.1, AF127761.1 (ECO:00003321 RNAseq introns single sample supports all introns ERS025081, |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | ERS025082 [ECO:0000348] ##Evidence-Data-END## |
| 193 | RCAN 1 | exoni c | 1827 | calcipressin-1 isoform a | The protein encoded by this gene interacts with calcineurin A and inhibits calcineurin-dependent signaling pathways, possibly affecting central nervous system development. This gene is located in the minimal candidate region for the Down syndrome phenotype, and is overexpressed in the brain of Down syndrome fetuses. Chronic overexpression of this gene may lead to neurofibrillary tangles such as those associated with Alzheimer disease. Three transcript variants encoding three different isoforms have been found for this gene. [provided by RefSeq, Jul 2008]. Transcript Variant: This variant (1) represents the longest transcript and encodes the longest isoform (a). Publication Note: This RefSeq record includes a subset of the publications that are available for this gene. Please see the.Gene record to access additional publications. ##Evidence-Data-START## Transcript exon combination :: BC002864.2, AY325903.1 [ECO:0000332] RNAseq introns :: single sample supports all introns ERS025082, ERS025083 [ECO:0000348] ##Evidence-Data END## |
| 194 | RCC1 | exoni c | 1104 | N/A | N/A |
| 195 | RCOR 1 | exoni c | 23186 | REST corepressor 1 | This gene encodes a protein that is well-conserved, downregulated at birth, and with a specific role in determining neural cell differentiation. The encoded protein binds to the C-terminal domain of REST (repressor element-1 silencing transcription.factor). [provided by RefSeq, Aug 2011]. Publication Note: This RefSeq record includes a subset of the publications that are available for this gene. Please see the Gene record to access additional publications. ##Evidence• Data-START## Transcript exon combination :: D31888.1, AF155595.1 [ECO:0000332] RNAseq introns :: single sample supports all introns ERS025081, ERS025083 [ECO:0000348] ##Evidence-Data-END## |
| 196 | RGS13 | exoni c | 603 | regulator of G-protein signaling 13 | The protein encoded by this gene is a member of the regulator of G protein signaling (RGS) family. RGS family members share similarity with S. cerevisiae SST2 and C. elegans egl-10 proteins, which contain a characteristic conserved RGS domain. RGS proteins accelerate GTPase activity of G protein alpha-subunits, thereby driving G protein into their inactive GDP-bound form, thus negatively regulating G protein signaling. RGS proteins have |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | been implicated in the fine tuning of a variety of cellular events in response to G protein-coupled receptor activation. The biological function of this gene, however, is unknown. Two transcript variants encoding the same isoform exist. [provided by RefSeq, Jul 2008]. Transcript Variant: This variant (1) represents the longer transcript. ##Evidence-Data-START## Transcript exon combination :: BC056866.1, AF030107.1 [ECO:0000332] RNAseq introns mixed/partial sample support ERS025083, ERS025084 [ECO:0000350] ##Evidence-Data-END## |
| 197 | RIMBP 3 | exoni c | 85376 | RIMS-binding protein 3A | N/A |
| 198 | RNAS EH2B | exoni c | 79621 | ribonuclease H2 subunit B isoform 1 | RNase H2 is composed of a single catalytic subunit (A) and two non-catalytic subunits (B and C) and specifically degrades the RNA of RNA:DNA hybrids. The protein encoded by this gene is the non-catalytic B subunit of RNase H2, which is thought to play a role in DNA replication. Multiple transcript variants encoding different isoforms have been found for this gene. Defects in this gene are a cause of Aicardi-Goutieres syndrome type 2 (AGS2). [provided by RefSeq, Nov 2008]. Transcript Variant: This,variant (1) represents the shorter transcript but encodes the longer isoform (1). ##Evidence-Data-START## Transcript exon combination :: BC036744.1, AY764036.1 [ECO:0000332] RNAseq introns :: single sample supports all introns ERS025081, ERS025082 [ECO:0000348] ##Evidence-Data-END## |
| 199 | RNAS EH2B-AS1 | exoni c | 1008742 55 | N/A | N/A |
| 200 | RNF11 5 | exoni c | 27246 | E3 ubiquitin protein ligase RNF115 | N/A |
| 201 | RNF13 3 | exoni c | 168433 | E3 ubiquitin protein ligase RNF133 precursor | The protein encoded by this gene contains a RING finger domain, a motif present in a variety of functionally distinct proteins and known to be involved in protein-protein and protein-DNA interactions. This gene has no intron. [provided by RefSeq, Jul 2008]. ##Evidence-Data-START## Transcript is intronless AF447589.1 [ECO:0000345] ##Evidence-Data-END## |
| 202 | RNF14 8 | exoni c | 378925 | RING finger protein 148 precursor | N/A |
| 203 | RPL37 | exoni c | 6167 | 60S ribosomal protein L37 | Ribosomes, the organelles that catalyze protein synthesis, consist of a small 40S subunit and a large 60S subunit. Together these subunits are composed |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | of 4 RNA species and approximately 80 structurally distinct proteins. This gene encodes a ribosomal protein that is a component of the 60S subunit. The protein belongs to the L37E family of ribosomal proteins. It is located in the cytoplasm. The protein contains a C2C2-type zinc finger-like motif. As is typical for genes encoding ribosomal proteins, there are multiple processed pseudogenes of this gene dispersed through the genome. [provided by RefSeq, Jul 2008]. Publication Note: This RefSeq record includes a subset of the publications that are available for this gene. Please see the Gene record to access additional publications. ##Evidence-Data-START## Transcript exon combination :: BC067790.1, 8X647123.1 [ECO:0000332] RNAseq introns single sample supports all introns ERS025084, ERS025088 [ECO:0000348] ##Evidence-Data-END## |
| 204 | RTN4 | both | 57142 | reticulon-4 isoform A | This gene belongs to the family of reticulon encoding genes. Reticulons are associated with the endoplasmic reticulum, and are involved in neuroendocrine secretion or in membrane trafficking in neuroendocrine cells. The product of this gene is a potent neurite outgrowth inhibitor which may also help block the regeneration of the central nervous system in higher vertebrates. Alternatively spliced transcript variants derived both from differential splicing and differential promoter usage and encoding different isoforms have been identified. [provided by RefSeq, Jul 2008]. Transcript Variant: This variant (1), also known as Nogo-A and RTN-XL, represents the longest transcript, and encodes the longest isoform (A). Publication Note: This RefSeq record includes a subset of the publications that are available for this gene. Please see the Gene record to access additional publications. ##Evidence• Data-START## Transcript exon combination :: BC150182.1, AB040462.1 [ECO:0000332] RNAseq introns :: single sample supports all introns ERS025084, ERS025088 [ECO:0000348] ##Evidence-Data-END## |
| 205 | RTN4R | exonic | 65078 | reticulon-4 receptor precursor | This gene encodes the receptor for reticulon 4, oligodendrocyte myelin glycoprotein and myelin-associated glycoprotein. This receptor mediates axonal growth inhibition and may play a role in regulating axonal regeneration and plasticity in the adult central nervous system. [provided by RefSeq, Jul 2008]. Publication Note: This RefSeq record includes a subset of the publications that are available for this gene. Please see the Gene record |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | to access additional publications. ##Evidence-Data-START## Transcript exon combination :: AL834449.1, CR456360.1 [ECO:0000332] RNAseq introns single sample supports all introns ERS025085, ERS025086 [ECO:0000348] ##Evidence-Data-END## |
| 206 | S100A7 | exonic | 6278 | protein S100-A7 | The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. S100 genes include at least 13 members which are located as a cluster on chromosome 1q21. This protein differs from the other S100 proteins of known structure in its lack of calcium binding ability in one EF-hand at the N-terminus. This protein is markedly over-expressed in the skin lesions of psoriatic patients, but is excluded as a candidate gene for familial psoriasis susceptibility. The exact function of this protein is not known. [provided by RefSeq, Jul 2008]. Publication Note: This RefSeq record includes a subset of the publications that are available for this gene. Please see the Gene record to access additional publications. ##Evidence-Data-START## Transcript exon combination :: CR747128.1, BC034687.1 [ECO:0000332] RNAseq introns single sample supports all introns ERS025081, ERS025084 [ECO:0000348] ##Evidence-Data-END## |
| 207 | S100A7A | exonic | 338324 | protein S100-A7A protein S100-A7 | N/A |
| 208 | S100A7L2 | exonic | 645922 | like 2 | N/A |
| 209 | S100A8 | exonic | 6279 | protein S100-A8 | The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. S100 genes include at least 13 members which are located as a cluster on chromosome 1q21. This protein may function in the inhibition of casein kinase and as a cytokine. Altered expression of this protein is associated with the disease cystic fibrosis. [provided by RefSeq, Jul 2008]. Publication Note: This RefSeq record includes a subset of the publications that are available for this gene. Please see the Gene record to access additional publications. ##Evidence-Data- |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | START## Transcript exon combination :: BU935536.1, AV757679.1 [ECO:0000332] RNAseq introns single sample supports all introns ERS025084, ERS025088 [ECO:0000348] ##Evidence-Data END## |
| 210 | S100A 9 | exoni c | 6280 | protein S100-A9 | The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. S100 genes include at least 13 members which are located as a cluster on chromosome 1q21..This protein may function in the inhibition of casein kinase and altered expression of this protein is associated with the disease cystic fibrosis. [provided by RefSeq, Jul 2008]. Publication Note: This RefSeq record includes a subset of the publications that are available for this gene. Please see the Gene record to access additional publications. ##Evidence. Data-START## Transcript exon combination :: BP227476.1, DA620137.1 [ECO:0000332] RNAseq introns :: single sample supports all introns ERS025081, ERS025082 [ECO:0000348] ##Evidence-Data-END## |
| 211 | S100Al 2 | exoni c | 6283 | protein S100-Al2 | The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. S100 genes include at least 13 members which are located as a cluster on chromosome 1q21. This protein is proposed to be involved in specific calcium-dependent signal transduction pathways and its regulatory effect on cytoskeletal components may modulate various neutrophil activities. [provided by RefSeq, Jul 2008]. Publication Note: This RefSeq record includes a subset of the publications that are available for this gene. Please see the Gene record to access additional publications. ##Evidence-Data-START## Transcript exon combination :: D83664.1, BC070294.1 [ECO:0000332] RNAseq introns single sample supports all introns ERS025081, ERS025082 [ECO:0000348] ##Evidence-Data-END## |
| 212 | SAG | exoni c | 6295 | S-arrestin | Members of arrestin/beta-arrestin protein family are thought to participate in agonist-mediated desensitization of G-protein-coupled receptors and |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | cause specific dampening of cellular responses to stimuli such as hormones, neurotransmitters, or sensory signals. S-arrestin, also known as S-antigen, is a major soluble photoreceptor protein that is involved in desensitization of the photoactivated transduction cascade. It is expressed in the retina and the pineal gland and inhibits coupling of rhodopsin to transducin in vitro. Additionally, S-arrestin is highly antigenic, and is capable of inducing experimental autoimmune uveoretinitis. Mutations in this gene have been associated with Oguchi disease, a rare autosomal recessive form of night blindness. [provided by RefSeq, Jul 2008]. Publication Note: This RefSeq record includes a subset of the publications that are available for this gene. Please see the Gene record to access additional publications. |
| 213 | SCAR B1 | intron ic | 949 | scavenger receptor class B member 1 isoform 1 | The protein encoded by this gene is a plasma membrane receptor for high density lipoprotein cholesterol (HDL). The encoded protein mediates cholesterol transfer to and from HDL. In addition, this protein is a receptor for hepatitis C virus glycoprotein E2. Two transcript variants encoding different isoforms have been found for this gene.(provided by RefSeq, Mar 2011]. Transcript Variant: This variant (1) represents the longer transcript and encodes the longer isoform (1). Publication Note: This RefSeq record includes a subset of the publications that are available for this gene. Please see the Gene record to access additional publications. ##Evidence-Data-START## Transcript exon combination :: BC080647.1, Z22555.1 [ECO:0000332] RNAseq introns :: single sample supports all introns ERS025084 [ECO:0000348] ##Evidence-Data END## |
| 214 | SCAR B2 | exoni c | 950 | lysosome membrane protein 2 isoform 1 precursor | The protein encoded by this gene is a type III glycoprotein that is located primarily in limiting membranes of lysosomes and endosomes. Earlier studies in mice and rat suggested that this protein may participate in membrane transportation and the reorganization of endosomal/lysosomal compartment. The protein deficiency in mice was reported to impair cell membrane transport processes and cause pelvic junction obstruction, deafness, and • peripheral neuropathy. Further studies in human showed that this protein is a ubiquitously expressed protein and that it is involved in the pathogenesis of HFMD (hand, foot, and mouth disease) caused by enterovirus-71 and possibly by coxsackievirus A16. Mutations in this |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | gene caused an autosomal recessive progressive myoclonic epilepsy-4 (EPM4), also known as action myoclonus-renal failure syndrome (AMRF). Alternatively spliced transcript variants encoding different isoforms have been found for this gene.[provided by RefSeq, Feb 2011]. Transcript Variant: This variant (1) encodes the longer isoform (1). Sequence Note: This RefSeq record was created from transcript and genomic sequence data to make the sequence consistent with the 'reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: D12676.1, BC021892.1 [ECO:0000332] RNAseq introns :: single sample supports all introns ERS025084 [ECO:0000348] ##Evidence-Data-END## |
| 215 | SCARF2 | exonic | 91179 | scavenger receptor class F member 2 isoform 1 precursor | The protein encoded by this gene is similar to SCARF1/SREC-1, a scavenger receptor protein that mediates the binding and degradation of acetylated low density lipoprotein (Ac-LDL). This protein has only little activity of internalizing modified low density lipoproteins (LDL), but it can interact with SCARF1 through its extracellular domain. The association of this protein with SCARF1 is suppressed by the presence of scavenger ligands. Alternatively spliced transcript variants encoding distinct isoforms have been reported. [provided by RefSeq, Jul 2008]. Transcript Variant: This variant (1) encodes the longer isoform (1). ##Evidence-Data-START## Transcript exon combination :: AF522196.1 [ECO:0000332] RNAseq introns :: mixed/partial sample support ERS025081, ERS025082 [ECO:0.000350] ##Evidence-Data-END## |
| 216 | SCG5 | exonic | 6447 | neuroendocrine protein 7B2 isoform 1 precursor | N/A |
| 217 | SCGB3A2 | exonic | 117156 | secretoglobin family 3A member2 precursor | The protein encoded by this gene is a secreted lung surfactant protein and a downstream target of thyroid transcription factor. A single nucleotide polymorphism in the promoter of this gene results in susceptibility to asthma.[provided by RefSeq, Mar 2010]. Publication Note: This RefSeq record includes a subset of the publications that are available for this gene. Please see the Gene record to access additional publications. ##Evidence-Data- |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | START## Transcript exon combination :: BC024232.1, AF439545.1 [ECO:0000332] RNAseq introns :: single sample supports all introns ERS025084, ERS025088 [ECO:0000348] ##Evidence-Data-END## |
| 218 | SEC61A2 | exonic | 55176 | encoded by this gene has similarity to a mouse protein which suggests a role in the insertion of secretory and membrane polypeptides into the endoplasmic reticulum. It may also be required for the assembly of membrane and secretory proteins. Alternative splicing results in multiple transcript variants. [provided by RefSeq, Dec 2008]. Transcript Variant: This variant (4) contains alternate internal and 3' exons, compared to variant 1. This | The protein encoded by this gene has similarity to a mouse protein which suggests a role in the insertion of secretory and membrane polypeptides into the endoplasmic reticulum. It may also be required for the assembly of membrane and secretory proteins. Alternative splicing results in multiple transcript variants. [provided by RefSeq, Dec 2008]. Transcript Variant: This variant (4) contains alternate internal and 3' exons, compared to variant 1. This variant is represented as non-coding because the use of the 5'-most expected translational start codon, as used in variant 1, renders the transcript a candidate for nonsense-mediated mRNA decay (NMD). ##Evidence-Data- START## RNAseq introns :: mixed/partial sample support ERS025082, ERS025083 [ECO:0000350] ##Evidence-Data-END## |
| 219 | SGCZ | both | 137868 | zeta-sarcoglycan | The zeta-sarcoglycan gene measures over 465 kb and localizes to 8p22. This protein is part of the sarcoglycan complex, a group of 6 proteins. The sarcoglycans are all N-glycosylated transmembrane proteins with a short intra-cellular domain, a single transmembrane region and a large extra-cellular domain containing a carboxyl-terminal cluster with several conserved cysteine residues. The sarcoglycan complex is part of the dystrophin-associated glycoprotein complex (DGC), which bridges the inner cytoskeleton and the extra-cellular matrix. [provided by RefSeq, Jul 2008]. ##Evidence-Data-START## Transcript exon combination :: AY502063.1 [ECO:0000332] RNAseq introns mixed/partial sample support ERS025082, ERS025086 [ECO:0000350] ##Evidence-Data-END## |
| 220 | SLC2A11 | exonic | 66035 | solute carrier family 2, glucose transporter member 11 isoform a | SLC2A11 belongs to a family of plasma membrane proteins that mediate facilitated transport of sugars across the membrane by facilitative diffusion (Sasaki et al., 2001 [PubMed 11741323]).[supplied |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | by OMIM, Mar 2008]. ##Evidence-Data-START## Transcript exon combination :: AF443201.1, AK314502.1 (ECO:0000332] ##Evidence-Data-END## |
| 221 | SLC13A5 | exonic | 284111 | solute carrier family 13 member 5 isoform a | SLC13A5 is a tricarboxylate plasma transporter with a preference for citrate.[supplied by OMIM, Apr 2004]. Transcript Variant: This variant (1) represents the longer transcript and encodes the longer isoform (a). ##Evidence-Data-START## Transcript exon combination :: AK172785.1, BC104795.1 [ECO:0000332] RNAseq introns :: single sample supports all introns ERS025084 [ECO:0000348] ##Evidence-Data-END## |
| 222 | SLC25A1 | exonic | 6576 | tricarboxylate transporter (also called citrate transport protein, or CTP) is responsible for the movement of citrate across the mitochondrial inner membrane (Kaplan et al., 1993 [PubMed 8514800]).[supplied by OMIM, Jan2011]. Transcript Variant: This variant (2) has an alternate 5' exon, compared to variant 1. This variant is represented as non-coding due to the presence of an upstream ORF that is predicted to | The mitochondrial tricarboxylate transporter (also called citrate transport protein, or CTP) is responsible for the movement of citrate across the mitochondrial inner membrane (Kaplan et al., 1993 [PubMed 8514800]).[supplied by OMIM, Jan 2011]. Transcript Variant: This variant (2) has an alternate 5' exon, compared to variant 1. This variant is represented as non-coding due to the presence of an upstream ORF that is predicted to interfere with translation of the longest in-frame ORF. Translation of the upstream ORF renders the transcript a candidate for nonsense-mediated mRNA decay (NMD). Publication Note: This RefSeq record includes a subset of the publications that are available for this gene. Please see the Gene record to access additional publications. ##Evidence-Data-START## RNAseq introns :: single sample supports all introns ERS025088 [ECO:0000348] ##Evidence-Data- END## ##RefSeq-Attributes-START## gene product(s) localized to mito.:: reported by MitoCarta ##RefSeq-Attributes-END## |
| 223 | SLC30A6 | exonic | 55676 | zinc transporter 6 isoform 1 | Zinc functions as a cofactor for numerous enzymes, nuclear factors, and hormones and as an intra- and intercellular signal ion. Members of the zinc transporter (ZNT)/SLC30 subfamily of the cation diffusion facilitator family, such as SLC30A6, permit cellular efflux of zinc (Seve et al., 2004 [PubMed 15154973]).[supplied by OMIM, Mar 2008]. Transcript Variant: This variant (1) represents the longest transcript and it encodes the longest protein (isoform 1). ##Evidence-Data-START## Transcript exon combination :: BC066903.1 [ECO:0000332] RNAseq introns :: mixed/partial sample support ERS025081, ERS025083 [ECO:0000350] ##Evidence-Data- |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | END## |
| 224 | SLC51 B | exoni c | 123264 | organic solute transporter subunit beta | N/A |
| 225 | SMAR CB1 | exoni c | 6598 | SWI/SNF-related matrix-associated actin-dependent regulator of chromatin subfamily B member 1 isoform a | The protein encoded by this gene is part of a complex that relieves repressive chromatin structures, allowing the transcriptional machinery to access its targets more effectively. The encoded nuclear protein may also bind to and enhance the DNA joining activity of HIV-1 integrase. This gene has been found to be a tumor suppressor, and mutations in it have been associated with malignant rhabdoid tumors. Two transcript variants encoding different isoforms have been found for this gene. [provided by RefSeq, Jul 2008]. Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: AI011737.1, CR456581.1 [ECO:0000332] RNAseq introns :: single sample supports all introns ERS025081, ERS025082 [ECO:0000348] ##Evidence-Data-END## |
| 226 | SMEK 2 | exoni c | 57223 | serine/threonine-protein phosphatase 4 regulatory subunit 3B isoform 1 | N/A |
| 227 | SMIM1 1 | exoni c | 54065 | small integral membrane protein 11 | N/A |
| 228 | SMPD 4 | exoni c | 55627 | (EC 3.1.4.12), such as SMPD4, catalyze the hydrolysis of membrane sphingomyelin to form phosphorylcholine and ceramide (Krut et al., 2006 [PubMed 16517606]).[supplie d by OMIM, Mar 2008]. Transcript Variant: This variant (5) lacks an alternate internal exon in the 5' | Sphingomyeliriases (EC 3.1.4.12), such as SMPD4, catalyze the hydrolysis of membrane sphingomyelin to form phosphorylcholine and ceramide (Krut et al., 2006 [PubMed 16517606]).[supplied by OMIM, Mar 2008]. Transcript Variant: This variant (5) lacks an alternate internal exon in the 5' region, compared to variant 2. This variant is represented as non-coding because the use of the supported translational start codon, as used in variant 2, renders the transcript a candidate for nonsense-mediated mRNA decay (NMD). ##Evidence-Data-START## RNAseq introns :: mixed/partial sample support ERS025084 [ECO:0000350] ##Evidence-Data-END## |

| Gene Number (GN) | RefSeq Gene Symbol | Exon_overlap | NCBI_Gene_ID | Gene_Description | RefSeq_Summary |
|---|---|---|---|---|---|
| | | | | region, compared to variant 2. This variant is represented as non-coding because the use of the supported translational start codon, as used in | |
| 229 | SNHG3 | exonic | 8420 | N/A | N/A |
| 230 | SNORD72 | exonic | 619564 | N/A | N/A |
| 231 | SP4 | exonic | 6671 | transcription factor Sp4 | N/A |
| 232 | SPAST | exonic | 6683 | spastin isoform 1 | This gene encodes a member of the AAA (ATPases associated with a variety of cellular activities) protein family. Members of this protein family share an ATPase domain and have roles in diverse cellular processes including membrane trafficking, intracellular motility, organelle biogenesis, protein folding, and proteolysis. The encoded ATPase may be involved in the assembly or function of nuclear protein complexes. Two transcript variants encoding distinct isoforms have been identified for this gene. Other alternative splice variants have been described but their full length sequences have not been determined. Mutations associated with this gene cause the most frequent form of autosomal dominant spastic paraplegia 4. [provided by RefSeq, Jul 2008]. Transcript Variant: This variant (1) represents the longer transcript, and encodes the longer isoform (1). Publication Note: This RefSeq record includes a subset of the publications that are available for this gene. Please see the Gene record to access additional publications. ##Evidence-Data-START## Transcript exon combination :: AI246001.1 [ECO:0000332] RNAseq introns :: single sample supports all introns ERS025082, ERS025083 [ECO:0000348] ##Evidence Data-END## |
| 233 | SPCS2 | exonic | 9789 | signal peptidase complex subunit 2 | N/A |
| 234 | SPG21 | exonic | 51324 | maspardin isoform | The protein encoded by this gene binds to the hydrophobic C-terminal amino acids of CD4 which are involved in repression of T cell activation. The interaction with CD4 is mediated by the noncatalytic alpha/beta hydrolase fold domain of this protein. It is thus proposed that this gene product modulates the stimulatory activity Of CD4. Mutations in this gene are associated with |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | autosomal recessive spastic paraplegia 21 (SPG21), also known as mast syndrome. At least three different transcript variants encoding two different isoforms have been found for this gene. [provided by RefSeq, Aug 2013]. Transcript Variant: This variant (1) represents the longest transcript and encodes the longer isoform (a). Variants 1 and 2 both encode isoform a. ##Evidence-Data-START## Transcript exon combination :: BC000244.1, AK172849.1 [ECO:0000332] RNAseq introns :: single sample supports all introns ERS025084 [ECO:0000348] ##Evidence-Data-END## |
| 235 | SPINK 1 | exoni c | 6690 | pancreatic secretory trypsin inhibitor precursor | The protein encoded by this gene is a trypsin inhibitor, which is secreted from pancreatic acinar cells into pancreatic juice. It is thought to function in the prevention of trypsin-catalyzed premature activation of zymogens within the pancreas and the pancreatic duct. Mutations in this gene are associated with hereditary pancreatitis and tropical calcific pancreatitis. [provided by RefSeq, Oct 2008]. Publication Note: This RefSeq record includes a subset of the publications that are available for this gene. Please see the Gene record to access additional publications. ##Evidence-Data-START## Transcript exon combination :: BX108904.1, CK905024.1 [ECO:0000332] RNAseq introns :: single sample supports all introns ERS025084, ERS025088 [ECO:0000348] ##Evidence-Data-END## |
| 236 | SPOC K1 | exoni c | 6695 | testican-1 precursor | This gene encodes the protein core of a seminal plasma proteoglycan containing chondroitin- and heparan-sulfate chains. The protein's function is unknown, although similarity to thyropin-type cysteine protease-inhibitors suggests its function may be related to protease inhibition. [provided by RefSeq, Jul 2008]. Publication Note: This RefSeq record includes a subset of the publications that are available for this gene. Please see the Gene record to access additional publications. ##Evidence-Data-START## Transcript exon combination :: BC030691.2, AF231124.1 [ECO:0000332] RNAseq introns mixed/partial sample support ERS025081, ERS025082 [ECO:0000350] ##Evidence-Data-END## |
| 237 | SRD5A 2 | exoni c | 6716 | 3-oxo-5-alpha-steroid 4-dehydrogenase 2 | This gene encodes a microsomal protein expressed at high levels in androgen-sensitive tissues such as the prostate. The encoded protein is active at acidic pH and is sensitive to the 4-azasteroid inhibitor finasteride. Deficiencies in this gene can result in male pseudohermaphroditism, specifically pseudovaginal perineoscrotal hypospadias (PPSH). |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | [provided by RefSeq, Jul 2008]. Publication Note: This RefSeq record includes a subset of the publications that are available for this gene. Please see the Gene record to access additional publications. ##Evidence-Data-START## Transcript exon combination :: M74047.1, BC112252.1 [ECO:0000332] RNAseq introns :: single sample supports all introns ERS025084, ERS025097 [ECO:0000348] ##Evidence-Data-END## |
| 238 | STEAP 1 | exoni c | 26872 | metalloreductase STEAP1 | This gene is predominantly expressed in prostate tissue, and is found to be upregulated in multiple cancer cell lines. The gene product is predicted to be a six-transmembrane protein, and was shown to be a cell surface antigen significantly expressed at cell-cell junctions. [provided by RefSeq, Jul 2008]. Publication Note: This RefSeq record includes a subset of the publications that are available for this gene. Please see the Gene record to access additional publications. ##Evidence-Data-START## Transcript exon combination :: AF186249.1, 8C011802.2 [ECO:0000332] RNAseq introns :: single sample supports all introns ERS025081, ERS025083 [ECO:0000348] ##Evidence-Data-END## |
| 239 | STEAP 2 | exoni c | 261729 | metalloreductase STEAP2 isoform a | This gene is a member of the STEAP family and encodes a multi-pass membrane protein that localizes to the Golgi complex, the plasma membrane, and the vesicular tubular structures in the cytosol. A highly similar protein in mouse has both ferrireductase and cupric reductase activity, and stimulates the cellular uptake of both iron and copper in vitro. Increased transcriptional expression of the human gene is associated with prostate cancer progression. Alternate transcriptional splice variants, encoding different isoforms, have been characterized. [provided by RefSeq, Jul 2008]. Transcript Variant: This variant (1) represents the longest transcript and encodes the longest isoform (a). Variants 1, 2 and 4 encode the same isoform. ##Evidence-Data-START## Transcript exon combination :: AF455138.1 [ECO:0000332] RNAseq introns :: single sample supports all introns ERS025083, ERS025084 [ECO:0000348] ##Evidence-Data-END## |
| 240 | STK4 | exoni c | 6789 | serine/threonine-protein kinase 4 | The protein encoded by this gene is a cytoplasmic kinase that is structurally similar to the yeast Ste20p kinase, which acts upstream of the stress-induced mitogen-activated protein kinase cascade. The encoded protein can phosphorylate myelin basic |

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | protein and undergoes autophosphorylation. A caspase-cleaved fragment of the encoded protein has been shown to be capable of phosphorylating histone H2B. The particular phosphorylation catalyzed by this protein has been correlated with apoptosis, and it's possible that this protein induces the chromatin condensation observed in this process. [provided by RefSeq, Jul 2008]. Publication Note: This RefSeq record includes a subset of the publications that are available for this gene. Please see the Gene record to access additional publications. ##Evidence-Data-START## Transcript exon combination :: U60207.1, U18297.1 [ECO:0000332] RNAseq introns :: single sample supports all introns ERS025081, ERS025082 [ECO:0000348] ##Evidence-Data-END## |
| 241 | STK4-AS1 | exonic | 100505826 | N/A | N/A |
| 242 | SUMF1 | exonic | 285362 | sulfatase-modifying factor 1 isoform 1 precursor | This gene encodes an enzyme that catalyzes the hydrolysis of sulfate esters by oxidizing a cysteine residue in the substrate sulfatase to an active site 3-oxoalanine residue, which is also known as C-alpha-formylglycine. Mutations in this gene cause multiple sulfatase deficiency, a lysosomal storage disorder. Alternative splicing results in multiple transcript variants. [provided by RefSeq, Sep 2009]. Transcript Variant: This variant (1) represents the longest transcript and encodes the longest isoform (1). Publication Note: This RefSeq record includes a subset of the publications that are available for this gene. Please see the Gene record to access additional publications. ##Evidence-Data-START## Transcript exon combination :: BC110862.1, AK075459.1; BC110862.1 [ECO:0000332] RNAseq introns :: single sample supports all introns ERS025081, ERS025082 [ECO:0000348]##Evidence-Data-END## |
| 243 | SUPT3H | intronic | 8464 | transcription initiation protein SPT3 homolog isoform 1 | N/A |
| 244 | SYNJ1 | exonic | 8867 | synaptojanin-1 isoform a | This gene encodes a phosphoinositide phosphatase that regulates levels of membrane phosphatidylinositol-4,5-bisphosphate. As such, expression of this enzyme may affect synaptic transmission and membrane trafficking. Multiple transcript variants encoding different isoforms have been found for this gene. [provided by RefSeq, Sep 2011]. Transcript Variant: This variant (1) encodes |

Figure 10A (Continued)

| Figure 10A | | | | | |
|---|---|---|---|---|---|
| Gene Number (GN) | RefSeq Gene Symbol | Exon_overlap | NCBI_Gene_ID | Gene_Description | RefSeq_Summary |
| | | | | | the longest isoform (a). Publication Note: This RefSeq record includes a subset of the publications that are available for this gene. Please see the Gene record to access additional publications. ##Evidence-Data-START## Transcript exon combination :: AF009040.1 [ECO:0000332] RNAseq introns :: single sample supports all introns ERS025088 [ECO:0000348] ##Evidence-Data-END## |
| 245 | TBX10 | exonic | 347853 | T-box transcription factor TBX10 T-complex protein | This gene encodes a member of the T-box family of transcription factors. These transcription factors share a DNA-binding domain called the T-box, and play a role in several developmental processes including early embryonic cell fate and organogenesis. The encoded protein is a member of the T-box 1 subfamily. Mutations in this gene are thought to be a cause of isolated cleft lip with or without cleft palate. [provided by RefSeq, Nov 2010]. ##Evidence-Data-START## Transcript exon combination :: AY229977.1, BC113485.1 [ECO:0000332] RNAseq introns mixed/partial sample support ERS025094 [ECO:0000350] ##Evidence-Data-END## |
| 246 | TCP10L | exonic | 140290 | 10A homolog 2 | N/A |
| 247 | TECPR2 | exonic | 9895 | tectonin beta-propeller repeat-containing protein 2 isoform 1 | N/A |
| 248 | TJP2 | exonic | 9414 | tight junction protein ZO-2 isoform 1 | This gene encodes a zonula occluden that is a member of the membrane-associated guanylate kinase homolog family. The encoded protein functions as a component of the tight junction barrier in epithelial and endothelial cells and is necessary for proper assembly of tight junctions. Mutations in this gene have been identified in patients with hypercholanemia, and genomic duplication of a 270 kb region including this gene causes autosomal dominant deafness-51. Alternatively spliced transcripts encoding multiple isoforms have been observed for this gene. [provided by RefSeq, Nov 2011]. Transcript Variant: This variant (1) encodes isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | to access additional publications. ##Evidence-Data-START## Transcript exon combination :: BC027592.1, L27476.1 [ECO:0000332] RNAseq introns :: single sample supports all introns ERS025081, ERS025082 [ECO:0000348] OEvidence Data-END## |
| 249 | TMEM 27 | exoni c | 57393 | collectrin precursor | This gene encodes a type 1 transmembrane protein that is important for trafficking amino acid transporters to the apical brush border of proximal tubules. The encoded protein binds to amino acid transporters and regulates their expression on the plasma membrane. It also plays a role in controlling insulin exocytosis by regulating formation of the SNARE (soluble N-ethylmaleimide-sensitive-factor attachment protein receptor) complex in pancreatic beta cells. The extracellular domain of the encoded protein may be cleaved and shed from the plasma membrane specifically in pancreatic beta cells. (provided by RefSeq, Jun 2013]. Publication Note: This RefSeq record includes a subset of the publications that are available for this gene. Please see the Gene record to access additional publications. ##Evidence-Data-START## Transcript exon combination :: BC014317.1, BC015099.1 [ECO:0000332] RNAseq introns :: single sample supports all introns ERS025084, ERS025088[ECO:0000348] ##Evidence-Data-END## |
| 250 | TMEM 87B | exoni c | 84910 | transmembrane protein 87B precursor | N/A |
| 251 | TMEM 191B | exoni c | 728229 | transmembrane protein 191B | N/A |
| 252 | TMEM 252 | exoni c | 169693 | transmembrane protein 252 | N/A |
| 253 | TOMM 34 | exoni c | 10953 | mitochondrial import receptor subunit T0M34 | The protein encoded by this gene is involved in the import of precursor proteins into mitochondria. The encoded protein has a chaperone-like activity, binding the mature portion of unfolded proteins and aiding their import into mitochondria. This protein, which is found in the cytoplasm and sometimes associated with the outer mitochondrial membrane, has a weak ATPase activity and contains 6 TPR repeats. [provided by RefSeq, Jul 2008). Publication Note: This RefSeq record includes a subset of the publications that are available for this gene. Please see the Gene record to access additional publications. MIRefSeqzAttributes-START## gene product(s) localized to mito. :: reported by MitoCarta ##RefSeq-Attributes-END## |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | ##Evidence-Data-START## Transcript exon combination :: BC007423.2, AB085681.1 [ECO:0000332] RNAseq introns :: single sample supports all introns ERS025084[ECO:0000348]##Evidence-Data-END## |
| 254 | TRAPP C2L | exoni c | 51693 | trafficking protein particle complex subunit 2-like protein | N/A |
| 255 | TRIAP 1 | exoni c | 51499 | TP53-regulated inhibitor of apoptosis 1 | N/A |
| 256 | TUB | exoni c | 7275 | tubby protein homolog isoform a | This gene encodes a member of the Tubby family of bipartite transcription factors. The encoded protein may play a role in obesity and sensorineural degradation. The crystal structure has been determined for a similar protein in mouse, and it functions as a membrane-bound transcription regulator that translocates to the nucleus in response to phosphoinositide hydrolysis. Two transcript variants encoding distinct isoforms have been identified for this gene. [provided by RefSeq, Jul 2008]. Transcript Variant: This variant (1) represents the lbnger transcript, and encodes the longer isoform (a). Publication Note: This RefSeq record includes a subset of the publications that are available for this gene. Please see the Gene record to access additional publications. ##Evidence-Data-START## Transcript exon combination U82467.1, BC075031.2 [ECO:0000332] RNAseq introns mixed/partial sample support ERS025088 [ECO:0000350] ##Evidence-Data-END## |
| 257 | TXNIP | exoni c | 10628 | thioredoxin-interacting protein | N/A |
| 258 | UNC13 C | both | 440279 | protein unc-13 homolog C | N/A |
| 259 | WIPI2 | exoni c | 26100 | WD repeat domain phosphoinositide-interacting protein 2 isoform a | WD40 repeat proteins are key components of many essential biologic functions. They regulate the assembly of multiprotein complexes by presenting a beta-propeller platform for simultaneous and reversible protein-protein interactions. Members of the WIPI subfamily of WD40 repeat proteins, such as WIPI2, have a 7-bladed propeller structure and contain a conserved motif for interaction with phospholipids (Proikas-Cezanne et al., 2004 [PubMed 15602573]).(supplied by OMIM, Mar 2008]. Transcript Variant: This variant (1) encodes the longest isoform (a). ##Evidence-Data-START## Transcript exon combination :: |

Figure 10A (Continued)

| Figure 10A | | | | | |
|---|---|---|---|---|---|
| Gene Number (GN) | RefSeq Gene Symbol | Exon _overl ap | NCBI_ Gene_I D | Gene_Description | RefSeq_Summary |
| | | | | | AL080155.1, AK023041.1 [ECO:0000332] RNAseq introns :: single sample supports all introns ERS025082, ERS025084 [ECO:0000348] ##Evidence-Data-END## |
| 260 | XDH | exoni c | 7498 | xanthine dehydrogenase/oxi dase | Xanthine dehydrogenase belongs to the group of molybdenum-containing hydroxylases involved in the oxidative metabolism of purines. The enzyme is a homodimer. Xanthine dehydrogenase can be converted to xanthine oxidase by reversible sulfhydryl oxidation or by irreversible proteolytic modification. Defects in xanthine dehydrogenase cause xanthinuria, may contribute to adult respiratory stress syndrome, and may potentiate influenza infection through an oxygen metabolite-dependent mechanism. [provided by RefSeq, Jul 2008]. Publication Note: This RefSeq record includes a subset of the publications that are available for this gene. Please see the Gene record to access additional publications. ##Evidence-Data-START## Transcript exon combination :: D11456.2, U39487.1 [ECO:0000332] RNAseq introns :: single sample supports all introns ERS025097 [ECO:0000348] ##Evidence-Data-END## |
| 261 | XRRA 1 | exoni c | 143570 | X-ray radiation resistance-associated protein 1 isoform 1 | N/A |
| 262 | YIPF4 | exoni c | 84272 | protein YIPF4 | N/A |
| 263 | YWHA B | exoni c | 7529 | 14-3-3 protein beta/alpha | This gene encodes a protein belonging to the 14-3-3 family of proteins, members of which mediate signal transduction by binding to phosphoserine-containing proteins. This highly conserved protein family is found in both plants and mammals. The encoded protein has been shown to interact with RAF1 and CDC25 phosphatases, suggesting that it may play a role in linking mitogenic signaling and the cell cycle machinery. Two transcript variants, which encode the same protein, have been identified for this gene. [provided by RefSeq, Jul 2008]. Transcript Variant: This variant (1) represents the longer transcript. Variants 1 and 2 both encode the same protein. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please |

| Gene Number (GN) | RefSeq Gene Symbol | Exon_overlap | NCBI_Gene_ID | Gene_Description | RefSeq_Summary |
|---|---|---|---|---|---|
| | | | | | see the Gene record to access additional publications. ##Evidence-Data-START## Transcript exon combination :: X57346.1, AK292717.1 [ECO:0000332] RNAseq introns :: single sample supports all introns ERS025081, ERS025082 [ECO:0000348] ##Evidence Data-END## |
| 264 | YY1AP1 | exonic | 55249 | YY1-associated protein 1 isoform | The encoded gene product presumably interacts with YY1 protein; however, its exact function is not known. Alternative splicing results in multiple transcript variants encoding different isoforms. [provided by RefSeq, Jul 2008] Transcript Variant: This variant (1) has an alternate 5' sequence and an additional exon in the 5' region, resulting in a downstream AUG start codon, as compared to variant 10. The resulting isoform (1) has a shorter N-terminus, as compared to isoform 6. Variants 1, 6 and 7 encode the same isoform 1. ##Evidence-Data-START## Transcript exon combination :: BC001655.2 [ECO:0000332] RNAseq introns :: mixed/partial sample support ERS025081, ERS025082 [ECO:0000350) ##Evidence-Data-END## |
| 265 | ZNF74 | exonic | 7625 | N/A | N/A |
| 266 | ZNF740 | exonic | 283337 | zinc finger protein 740 | N/A |
| 267 | ZNF774 | exonic | 342132 | zinc finger protein 774 | N/A |
| 268 | ZNF839 | exonic | 55778 | zinc finger protein 839 isoform 1 | N/A |
| 269 | ZRSR2 | exonic | 8233 | U2 small nuclear ribonucleoprotein auxiliary factor 35 kDa subunit-related protein 2 | This gene encodes an essential splicing factor. The encoded protein associates with the U2 auxiliary factor heterodimer, which is required for the recognition of a functional 3' splice site in pre-mRNA splicing, and may play a role in network interactions during spliceosome assembly. [provided by RefSeq, Jul 2008]. ##Evidence-Data-START## Transcript exon combination :: BC113454.1, D49677.1 [ECO:0000332] RNAseq introns :: single sample supports all introns ERS025081, ERS025083 (ECO:0000348) ##Evidence-Data-END## |

Figure 10A (Continued)

| Figure 10B | | | | |
|---|---|---|---|---|
| Ref Seq Gene Symbol(s) | Exon overlap | NCBI Gene ID | Gene Description | RefSeq Summmary |
| A2M | Exonic | 2 | alpha-2-macroglobulin precursor | Alpha-2-macroglobulin is a protease inhibitor and cytokine transporter. It inhibits many proteases, including trypsin, thrombin and collagenase. A2M is implicated in Alzheimer disease (AD) due to its ability to mediate the clearance and degradation of A-beta, the major component of beta-amyloid deposits. [provided by RefSeq, Jul 2008]. |
| ABCC6 | Exonic | 368 | multidrug resistance-associated protein 6 isoform 1 | The protein encoded by this gene is a member of the superfamily of ATP-binding cassette (ABC) transporters. ABC proteins transport various molecules across extra- and intra-cellular membranes. ABC genes are divided into seven distinct subfamilies (ABC1, MDR/TAP, MRP, ALD, OABP, GCN20, White). The encoded protein, a member of the MRP subfamily, is involved in multi-drug resistance. Mutations in this gene cause pseudoxanthoma elasticum. Alternatively spliced transcript variants that encode different proteins have been described for this gene. [provided by RefSeq, Jul 2008]. Transcript Variant: This variant (1) represents the longer transcript and it encodes the longer protein (isoform 1). |
| ACSM2A | Exonic | 123876 | acyl-coenzyme A synthetase ACSM2A, mitochondrial | N/A |
| ADAM6 | Exonic | 8755 | N/A | N/A |
| ADRA1A | Intronic | 148 | alpha-1A adrenergic receptor isoform 4 | Alpha-1-adrenergic receptors (alpha-1-ARs) are members of the G protein-coupled receptor superfamily. They activate mitogenic responses and regulate growth and proliferation of many cells. There are 3 alpha-1-AR subtypes: alpha-1A, -1B and -1D, all of which signal through the Gq/11 family of G-proteins and different subtypes show different patterns of activation. This gene encodes alpha-1A-adrenergic receptor. Alternative splicing of this gene generates four transcript variants, which encode four different isoforms with distinct C-termini but having similar ligand binding properties. [provided by RefSeq, Jul 2008]. Transcript Variant: This variant (4) includes an alternate 3' terminal exon, compared to variant 3. It encodes isoform 4, which has a longer and distinct C-terminus, compared to isoform 3. |
| AGBL1 | Exonic | 1236 | cytosolic carboxypeptidase | N/A |

Figure 10B

| Figure 10B | | | | |
|---|---|---|---|---|
| Ref Seq Gene Symbol(s) | Exon overlap | NCBI Gene ID | Gene Description | RefSeq Summmary |
| | nic | 24 | 4 | |
| Al M1 | Exonic | 202 | absent in melanoma 1 protein | N/A |
| AL DH 7A1 | Exonic | 501 | alpha-aminoadipic semialdehyde dehydrogenase isoform 3 | The protein encoded by this gene is a member of subfamily 7 in the aldehyde dehydrogenase gene family. These enzymes are thought to play a major role in the detoxification of aldehydes generated by alcohol metabolism and lipid peroxidation. This particular member has homology to a previously described protein from the green garden pea, the 26g pea turgor protein. It is also involved in lysine catabolism that is known to occur in the mitochondrial matrix. Recent reports show that this protein is found both in the cytosol and the mitochondria, and the two forms likely arise from the use of alternative translation initiation sites. An additional variant encoding a different isoform has also been found for this gene. Mutations in this gene are associated with pyridoxine-dependent epilepsy. Several related pseudogenes have also been identified. [provided by RefSeq, Jan 2011]. Transcript Variant: This variant (2) is missing two in-frame coding exons compared to variant 1, resulting in a shorter isoform (3) lacking an internal protein segment compared to isoform 1. Sequence Note: This Refseq, containing three potential in-frame translation initiation codons (all with weak Kozak signals), is annotated with a CDS starting from the upstream start codon (at nt 112-114). While this variant has transcript support, the localization and/or function of this isoform is not known. Translation from the downstream AUGs (at nt 193-195 and 277-279) may occur by leaky scanning. This RefSeq record was created from transcript and genomic sequence data to make the sequence consistent with the reference genome assembly. The extent of this transcript is supported by transcript alignments. |
| AN GP T1 | Intronic | 284 | angiopoietin-1 isoform 1 precursor | Angiopoietins are proteins with important roles in vascular development and angiogenesis. All angiopoietins bind with similar affinity to an endothelial cell-specific tyrosine-protein kinase receptor. The protein encoded by this gene is a secreted glycoprotein that activates the receptor by inducing its tyrosine phosphorylation. It plays a critical role in mediating reciprocal interactions between the endothelium and surrounding matrix and mesenchyme and inhibits endothelial permeability. The protein also contributes to blood vessel maturation and stability, and may be |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | | involved in early development of the heart. Alternative splicing results in multiple transcript variants encoding distinct isoforms.[provided by RefSeq, Dec 2010]. Transcript Variant: This variant (1) represents the longer transcript and encodes the longer isoform (1). |
| ANKS1B | Intronic | 56899 | ankyrin repeat and sterile alpha motif domain-containing protein 1B isoform 1 | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (12) differs in the 5' UTR and coding region compared to variant 1. The resulting isoform (l) has a shorter and distinct N-terminus compared to isoform a. Publication Note: This RefSeq record includes a subset of the publications that are available for this gene. Please see the Gene record to access additional publications. |
| ARHGAP15 | Intronic | 55843 | rho GTPase-activating protein 15 | RHO GTPases (see ARHA; MIM 165390) regulate diverse biologic processes, and their activity is regulated by RHO GTPase-activating proteins (GAPs), such as ARHGAP15 (Seoh et al., 2003 [PubMed 12650940]).[supplied by OMIM, Mar 2008]. |
| ARHGEF38 | Exonic | 54848 | rho guanine nucleotide exchange factor 38 isoform 1 | N/A |
| ARL15 | Both | 54622 | ADP-ribosylation factor-like protein 15 | N/A |
| ARMC9 | Both | 80210 | lisH domain-containing protein ARMC9 | N/A |
| ATP11A | Exonic | 23250 | probable phospholipid-transporting ATPase IH isoform a | The protein encoded by this gene is an integral membrane ATPase. The encoded protein is probably phosphorylated in its intermediate state and likely drives the transport of ions such as calcium across membranes. Two transcript variants encoding different isoforms have been found for this gene. [provided by RefSeq, Jul 2008]. Transcript Variant: This variant (1) represents the longer transcript and encodes isoform a. Sequence Note: This RefSeq record was created from transcript and genomic sequence data because no |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | single transcript was available for the full length of the gene. The extent of this transcript is supported by transcript alignments. |
| AUTS2 | Both | 26053 | autism susceptibility gene 2 protein isoform 3 | N/A |
| BAZ2B | Intronic | 29994 | bromodomain adjacent to zinc finger domain protein 2B | N/A |
| BCKDHB | Intronic | 594 | 2-oxoisovalerate dehydrogenase subunit beta, mitochondrial precursor | Branched-chain keto acid dehydrogenase is a multienzyme complex associated with the inner membrane of mitochondria, and functions in the catabolism of branched-chain amino acids. The complex consists of multiple copies of 3 components: branched-chain alpha-keto acid decarboxylase (E1), lipoamide acyltransferase (E2) and lipoamide dehydrogenase (E3). This gene encodes the E1 beta subunit, and mutations therein have been associated with maple syrup urine disease (MSUD), type 1B, a disease characterized by a maple syrup odor to the urine in addition to mental and physical retardation, and feeding problems. Alternative splicing at this locus results in transcript variants with different 3' non-coding regions, but encoding the same isoform. [provided by RefSeq, Jul 2008]. Transcript Variant: This variant (2) is missing a segment in the 3' UTR compared to transcript variant 1, and thus has a shorter 3' UTR. Both variants 1 and 2 encode the same protein. |
| BHMT2 | Exonic | 23743 | betaine--homocysteine S-methyltransferase 2 isoform 2 | Homocysteine is a sulfur-containing amino acid that plays a crucial role in methylation reactions. Transfer of the methyl group from betaine to homocysteine creates methionine, which donates the methyl group to methylate DNA, proteins, lipids, and other intracellular metabolites. The protein encoded by this gene is one of two methyl transferases that can catalyze the transfer of the methyl group from betaine to homocysteine. Anomalies in homocysteine metabolism have been implicated in disorders ranging from vascular disease to neural tube birth defects such as spina bifida. Alternatively spliced transcript variants encoding different isoforms have been found for this gene. [provided by RefSeq, May 2010]. Transcript Variant: This variant (2) lacks an in-frame exon in the CDS, as compared to variant 1. The resulting isoform (2) lacks an internal segment, as compared to isoform 1. Sequence Note: This RefSeq record was created from transcript and genomic sequence data to make the sequence consistent with the reference genome |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | | assembly. The genomic coordinates used for the transcript record were based on transcript alignments. Publication Note: This RefSeq record includes a subset of the publications that are available for this gene. Please see the Gene record to access additional publications. |
| C11orf54 | Exonic | 28970 | ester hydrolase C11orf54 | N/A |
| C6orf99 | Exonic | 100130967 | putative uncharacterized protein C6orf99 | N/A |
| C7orf60 | Exonic | 154743 | UPF0532 protein C7orf60 | N/A |
| CA10 | Intronic | 56934 | carbonic anhydrase-related protein 10 precursor | This gene encodes a protein that belongs to the carbonic anhydrase family of zinc metalloenzymes, which catalyze the reversible hydration of carbon dioxide in various biological processes. The protein encoded by this gene is an acatalytic member of the alpha-carbonic anhydrase subgroup, and it is thought to play a role in the central nervous system, especially in brain development. Multiple transcript variants encoding the same protein have been found for this gene. [provided by RefSeq, Jul 2008]. Transcript Variant: This variant (2) differs in the 5' UTR compared to variant 1. Variants 1, 2 and 3 encode the same protein. |
| CARD8 | Exonic | 22900 | caspase recruitment domain-containing protein 8 isoform b | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (2) differs in the 5' UTR and lacks an alternate in-frame exon in the 5' coding region, compared to variant 1. This results in a shorter protein (isoform b), compared |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | | to isoform a. Variants 2 and 3 encode the same isoform (b). Sequence Note: This RefSeq record was created from transcript and genomic sequence data to make the sequence consistent with the reference genome assembly. The genomic coordinates used for the transcript record were based on transcript alignments. |
| CCDC66 | Intronic | 285331 | coiled-coil domain-containing protein 66 isoform 1 | N/A |
| CDH19 | Exonic | 28513 | cadherin-19 preproprotein | This gene is a type II classical cadherin from the cadherin superfamily and one of three cadherin 7-like genes located in a cluster on chromosome 18. The encoded membrane protein is a calcium dependent cell-cell adhesion glycoprotein comprised of five extracellular cadherin repeats, a transmembrane region and a highly conserved cytoplasmic tail. Type II (atypical) cadherins are defined based on their lack of a HAV cell adhesion recognition sequence specific to type I cadherins. Since disturbance of intracellular adhesion is a prerequisite for invasion and metastasis of tumor cells, cadherins are considered prime candidates for tumor suppressor genes. [provided by RefSeq, Jul 2008]. |
| CDKAL1 | Exonic | 54901 | CDK5 regulatory subunit-associated protein 1-like 1 | The protein encoded by this gene is a member of the methylthiotransferase family. The function of this gene is not known. Genome-wide association studies have linked single nucleotide polymorphisms in an intron of this gene with susceptibilty to type 2 diabetes. [provided by RefSeq, May 2010]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CLSTN1 | Intronic | 22883 | calsyntenin-1 isoform 1 precursor | N/A |
| COL28A1 | Exonic | 340267 | collagen alpha-1(XXVIII) chain precursor | COL28A1 belongs to a class of collagens containing von Willebrand factor (VWF; MIM 613160) type A (VWFA) domains (Veit et al., 2006 [PubMed 16330543]).[supplied by OMIM, Nov 2010]. |
| COL4A | Exo | 1284 | collagen alpha-2(IV) chain | This gene encodes one of the six subunits of type IV collagen, the major structural component of basement membranes. The C- |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| 2 | nic | | preproprotein | terminal portion of the protein, known as canstatin, is an inhibitor of angiogenesis and tumor growth. Like the other members of the type IV collagen gene family, this gene is organized in a head-to-head conformation with another type IV collagen gene so that each gene pair shares a common promoter. [provided by RefSeq, Jul 2008]. |
| COMMD10 | Both | 51397 | COMM domain-containing protein 10 | N/A |
| CRNKL1 | Both | 51340 | crooked neck-like protein 1 | The crooked neck (crn) gene of Drosophila is essential for embryogenesis and is thought to be involved in cell cycle progression and pre-mRNA splicing. This gene is similar in sequence to crn and encodes a protein which can localize to pre-mRNA splicing complexes in the nucleus. The encoded protein, which contains many tetratricopeptide repeats, is required for pre-mRNA splicing. [provided by RefSeq, Jul 2008]. |
| CSMD1 | Intronic | 64478 | CUB and sushi domain-containing protein 1 precursor | N/A |
| CTU1 | Exonic | 90353 | cytoplasmic tRNA 2-thiolation protein 1 | N/A |
| CYP2A6 | Exonic | 1548 | cytochrome P450 2A6 precursor | This gene, CYP2A6, encodes a member of the cytochrome P450 superfamily of enzymes. The cytochrome P450 proteins are monooxygenases which catalyze many reactions involved in drug metabolism and synthesis of cholesterol, steroids and other lipids. This protein localizes to the endoplasmic reticulum and its expression is induced by phenobarbital. The enzyme is known to hydroxylate coumarin, and also metabolizes nicotine, aflatoxin B1, nitrosamines, and some pharmaceuticals. Individuals with certain allelic variants are said to have a poor metabolizer phenotype, meaning they do not efficiently metabolize coumarin or nicotine. This gene is part of a large cluster of cytochrome P450 genes from the CYP2A, CYP2B and CYP2F subfamilies on chromosome 19q. The gene was formerly referred to as CYP2A3; however, it has been renamed CYP2A6. [provided by RefSeq, Jul 2008]. |
| DSCAM | Exonic | 1826 | Down syndrome cell adhesion molecule isoform CHD2-42 | N/A |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | precursor | |
| EGFEM1P | Both | 93556 | N/A | N/A |
| EHD4 | Intronic | 30844 | EH domain-containing protein 4 | N/A |
| EML1 | Exonic | 2009 | echinoderm microtubule-associated protein-like 1 isoform a | Human echinoderm microtubule-associated protein-like is a strong candidate for the Usher syndrome type 1A gene. Usher syndromes (USHs) are a group of genetic disorders consisting of congenital deafness, retinitis pigmentosa, and vestibular dysfunction of variable onset and severity depending on the genetic type. The disease process in USHs involves the entire brain and is not limited to the posterior fossa or auditory and visual systems. The USHs are catagorized as type I (USH1A, USH1B, USH1C, USH1D, USH1E and USH1F), type II (USH2A and USH2B) and type III (USH3). The type I is the most severe form. Gene loci responsible for these three types are all mapped. Two transcript variants encoding different isoforms have been found for this gene. [provided by RefSeq, Jul 2008]. Transcript Variant: This variant (1) represents the longer transcript and encodes the longer isoform (a). |
| EML6 | Both | 400954 | echinoderm microtubule-associated protein-like 6 | N/A |
| ENPP2 | Intronic | 5168 | N/A | The protein encoded by this gene functions as both a phosphodiesterase, which cleaves phosphodiester bonds at the 5' end of oligonucleotides, and a phospholipase, which catalyzes production of lysophosphatidic acid (LPA) in extracellular fluids. LPA evokes growth factor-like responses including stimulation of cell proliferation and chemotaxis. This gene product stimulates the motility of tumor cells and has angiogenic properties, and its expression is upregulated in several kinds of carcinomas. The gene product is secreted and further processed to make the biologically active form. Several alternatively spliced transcript variants encoding different isoforms have been identified. [provided by RefSeq, Aug 2008]. Transcript Variant: This variant (4) uses an alternate 5'-most exon compared to variant 1. This variant is represented as non-coding due to the presence of an upstream ORF that is predicted to interfere with translation of the longest ORF; |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | translation of the upstream ORF renders the transcript a candidate for nonsense-mediated mRNA decay (NMD). Publication Note: This RefSeq record includes a subset of the publications that are available for this gene. Please see the Gene record to access additional publications. |
| EPAS1 | Intronic | 2034 | endothelial PAS domain-containing protein 1 | This gene encodes a transcription factor involved in the induction of genes regulated by oxygen, which is induced as oxygen levels fall. The encoded protein contains a basic-helix-loop-helix domain protein dimerization domain as well as a domain found in proteins in signal transduction pathways which respond to oxygen levels. Mutations in this gene are associated with erythrocytosis familial type 4. [provided by RefSeq, Nov 2009]. |
| EYS | Intronic | 346007 | protein eyes shut homolog isoform 2 | The product of this gene contains multiple epidermal growth factor (EGF)-like and LamG domains. The protein is expressed in the photoreceptor layer of the retina, and the gene is mutated in autosomal recessive retinitis pigmentosa. Multiple transcript variants encoding different isoforms have been found for this gene. [provided by RefSeq, Dec 2008]. Transcript Variant: This variant (2) uses an alternate exon and 3' UTR, compared to variant 1. The resulting isoform (2) has a substantially shorter and unique C-terminus, compared to isoform 1. |
| FGGY | Both | 55277 | FGGY carbohydrate kinase domain-containing protein isoform a | This gene encodes a member of the FGGY kinase family which acts as a phosphotransferase. Some GWAS studies have found an association with amyotrophic lateral sclerosis patients, yet other GWAS studies have not found any association. [provided by RefSeq, Sep 2011]. |
| FLJ39080 | Intronic | 441355 | N/A | N/A |
| FSCB | Exonic | 84075 | fibrous sheath CABYR-binding protein | N/A |
| FZD5 | Exonic | 7855 | frizzled-5 precursor | Members of the 'frizzled' gene family encode 7-transmembrane domain proteins that are receptors for Wnt signaling proteins. The FZD5 protein is believed to be the receptor for the Wnt5A ligand. [provided by RefSeq, Jul 2008]. |
| GMDS | Intronic | 2762 | GDP-mannose 4,6 dehydratase | GDP-mannose 4,6-dehydratase (GMD; EC 4.2.1.47) catalyzes the conversion of GDP-mannose to GDP-4-keto-6-deoxymannose, the first step in the synthesis of GDP-fucose from GDP-mannose, using NADP+ as a cofactor. The second and third steps of the pathway |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | are catalyzed by a single enzyme, GDP-keto-6-deoxymannose 3,5-epimerase, 4-reductase, designated FX in humans (MIM 137020).[supplied by OMIM, Aug 2009]. |
| GNPNAT1 | Intronic | 64841 | glucosamine 6-phosphate N-acetyltransferase | N/A |
| GRIK2 | Intronic | 2898 | glutamate receptor, ionotropic kainate 2 isoform 3 precursor | Glutamate receptors are the predominant excitatory neurotransmitter receptors in the mammalian brain and are activated in a variety of normal neurophysiologic processes. This gene product belongs to the kainate family of glutamate receptors, which are composed of four subunits and function as ligand-activated ion channels. The subunit encoded by this gene is subject to RNA editing at multiple sites within the first and second transmembrane domains, which is thought to alter the structure and function of the receptor complex. Alternatively spliced transcript variants encoding different isoforms have also been described for this gene. Mutations in this gene have been associated with autosomal recessive mental retardation. [provided by RefSeq, Jul 2008]. Transcript Variant: This variant (3) contains an additional exon in the 3' coding region, compared to transcript variant 1. The resulting isoform (3) is shorter and has a distinct C-terminus compared to isoform 1. RNA editing changes Ile567Val, Tyr571Cys and Gln621Arg. Sequence Note: This RefSeq record was created from transcript and genomic sequence data to make the sequence consistent with the reference genome assembly. The genomic coordinates used for the transcript record were based on transcript alignments. |
| GSN | Intronic | 2934 | gelsolin isoform a precursor | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (1) represents the longest isoform (a). |
| HBG1 | Exonic | 3047 | hemoglobin subunit gamma-1 | The gamma globin genes (HBG1 and HBG2) are normally expressed in the fetal liver, spleen and bone marrow. Two gamma chains together with two alpha chains constitute fetal hemoglobin (HbF) which is normally replaced by adult hemoglobin (HbA) at birth. In some beta-thalassemias and related conditions, gamma chain production continues into adulthood. The two types of |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | gamma chains differ at residue 136 where glycine is found in the G-gamma product (HBG2) and alanine is found in the A-gamma product (HBG1). The former is predominant at birth. The order of the genes in the beta-globin cluster is: 5'-epsilon -- gamma-G -- gamma-A -- delta -- beta--3'. [provided by RefSeq, Jul 2008]. |
| HLA-DPA1 | Exonic | 3113 | HLA class II histocompatibility antigen, DP alpha 1 chain precursor | HLA-DPA1 belongs to the HLA class II alpha chain paralogues. This class II molecule is a heterodimer consisting of an alpha (DPA) and a beta (DPB) chain, both anchored in the membrane. It plays a central role in the immune system by presenting peptides derived from extracellular proteins. Class II molecules are expressed in antigen presenting cells (APC: B lymphocytes, dendritic cells, macrophages). The alpha chain is approximately 33-35 kDa and its gene contains 5 exons. Exon one encodes the leader peptide, exons 2 and 3 encode the two extracellular domains, exon 4 encodes the transmembrane domain and the cytoplasmic tail. Within the DP molecule both the alpha chain and the beta chain contain the polymorphisms specifying the peptide binding specificities, resulting in up to 4 different molecules. [provided by RefSeq, Jul 2008]. Transcript Variant: This variant (3) differs in the 5' UTR compared to variant 1. Variants 1, 2 and 3 encode the same protein. |
| HLA-DPB1 | Exonic | 3115 | HLA class II histocompatibility antigen, DP beta 1 chain precursor | HLA-DPB belongs to the HLA class II beta chain paralogues. This class II molecule is a heterodimer consisting of an alpha (DPA) and a beta chain (DPB), both anchored in the membrane. It plays a central role in the immune system by presenting peptides derived from extracellular proteins. Class II molecules are expressed in antigen presenting cells (APC: B lymphocytes, dendritic cells, macrophages). The beta chain is approximately 26-28 kDa and its gene contains 6 exons. Exon one encodes the leader peptide, exons 2 and 3 encode the two extracellular domains, exon 4 encodes the transmembrane domain and exon 5 encodes the cytoplasmic tail. Within the DP molecule both the alpha chain and the beta chain contain the polymorphisms specifying the peptide binding specificities, resulting in up to 4 different molecules. [provided by RefSeq, Jul 2008]. Sequence Note: This RefSeq record was created from transcript and genomic sequence data to make the sequence consistent with the reference genome assembly. The genomic coordinates used for the transcript record were based on transcript alignments. |
| HMGB3 | Both | 3149 | high mobility group protein B3 | HMGB3 belongs to the high mobility group (HMG) protein superfamily. Like HMG1 (MIM 163905) and HMG2 (MIM 163906), HMGB3 contains DNA-binding HMG box domains and |

| Figure 10B | | | | |
|---|---|---|---|---|
| Ref Seq Gene Symbol(s) | Exon overlap | NCBI Gene ID | Gene Description | RefSeq Summmary |
| | | | | is classified into the HMG box subfamily. Members of the HMG box subfamily are thought to play a fundamental role in DNA replication, nucleosome assembly and transcription (Wilke et al., 1997 [PubMed 9370291]; Nemeth et al., 2006 [PubMed 16945912]).[supplied by OMIM, Mar 2008]. |
| IQCA1 | Both | 79781 | IQ and AAA domain-containing protein 1 | N/A |
| KCNQ5 | Intronic | 56479 | potassium voltage-gated channel subfamily KQT member 5 isoform 5 | This gene is a member of the KCNQ potassium channel gene family that is differentially expressed in subregions of the brain and in skeletal muscle. The protein encoded by this gene yields currents that activate slowly with depolarization and can form heteromeric channels with the protein encoded by the KCNQ3 gene. Currents expressed from this protein have voltage dependences and inhibitor sensitivities in common with M-currents. They are also inhibited by M1 muscarinic receptor activation. Multiple transcript variants encoding different isoforms have been found for this gene. [provided by RefSeq, May 2009]. Transcript Variant: This variant (5) lacks three alternate in-frame exons in the central coding region, compared to variant 4. The resulting isoform (5) lacks an internal segment, compared to isoform 4. Sequence Note: This RefSeq record was created from transcript and genomic sequence data to make the sequence consistent with the reference genome assembly. The genomic coordinates used for the transcript record were based on transcript alignments. |
| KIAA1324 | Intronic | 57535 | UPF0577 protein KIAA1324 precursor | N/A |
| LOC100132832 | Exonic | 100132832 | N/A | N/A |
| LOC100294145 | Exonic | 100294145 | N/A | N/A |
| LOC28 | Exo | 2831 | N/A | N/A |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| 3194 | nic | 94 | | |
| LOC28507 4 | Exonic | 28 50 74 | N/A | N/A |
| LOC44 245 9 | Both | 44 24 59 | N/A | N/A |
| LOC72 985 2 | Both | 72 98 52 | N/A | N/A |
| LRRC69 | Intronic | 10 01 30 74 2 | leucine-rich repeat-containing protein 69 | N/A |
| LSM14A | Intronic | 26 06 5 | protein LSM14 homolog A isoform a | Sm-like proteins were identified in a variety of organisms based on sequence homology with the Sm protein family (see SNRPD2; 601061). Sm-like proteins contain the Sm sequence motif, which consists of 2 regions separated by a linker of variable length that folds as a loop. The Sm-like proteins are thought to form a stable heteromer present in tri-snRNP particles, which are important for pre-mRNA splicing.[supplied by OMIM, Mar 2008]. Transcript Variant: This variant (1) represents the longer transcript and encodes isoform a. While isoforms a and b are of the same length, their C-termini are different. Sequence Note: This RefSeq record was created from transcript and genomic sequence data because no single transcript was available for the full length of the gene. The extent of this transcript is supported by transcript alignments. |
| MACROD2 | Intronic | 14 07 33 | MACRO domain-containing protein 2 isoform 1 | N/A |
| MAN2A1 | Intronic | 41 24 | alpha-mannosidase 2 | This gene encodes a protein which is a member of family 38 of the glycosyl hydrolases. The protein is located in the Golgi and catalyzes the final hydrolytic step in the asparagine-linked oligosaccharide (N-glycan) maturation pathway. Mutations in the mouse homolog of this gene have been shown to cause a systemic autoimmune disease similar to human systemic lupus |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | erythematosus. [provided by RefSeq, Jul 2008]. |
| MANEA | Intronic | 79694 | glycoprotein endo-alpha-1,2-mannosidase | N-glycosylation of proteins is initiated in the endoplasmic reticulum (ER) by the transfer of the preassembled oligosaccharide glucose-3-mannose-9-N-acetylglucosamine-2 from dolichyl pyrophosphate to acceptor sites on the target protein by an oligosaccharyltransferase complex. This core oligosaccharide is sequentially processed by several ER glycosidases and by an endomannosidase (E.C. 3.2.1.130), such as MANEA, in the Golgi. MANEA catalyzes the release of mono-, di-, and triglucosylmannose oligosaccharides by cleaving the alpha-1,2-mannosidic bond that links them to high-mannose glycans (Hamilton et al., 2005 [PubMed 15677381]).[supplied by OMIM, Sep 2008]. |
| MAP4 | Intronic | 4134 | microtubule-associated protein 4 isoform 4 | The protein encoded by this gene is a major non-neuronal microtubule-associated protein. This protein contains a domain similar to the microtubule-binding domains of neuronal microtubule-associated protein (MAP2) and microtubule-associated protein tau (MAPT/TAU). This protein promotes microtubule assembly, and has been shown to counteract destabilization of interphase microtubule catastrophe promotion. Cyclin B was found to interact with this protein, which targets cell division cycle 2 (CDC2) kinase to microtubules. The phosphorylation of this protein affects microtubule properties and cell cycle progression. Multiple transcript variants encoding different isoforms have been found for this gene. [provided by RefSeq, Aug 2008]. Transcript Variant: This variant (4) lacks an alternate exon and uses an alternate splice site in the 3' coding region, compared to variant 1. The resulting protein (isoform 4) has a shorter and distinct C-terminus, compared to isoform 1. |
| MBD3L2 | Exonic | 125997 | methyl-CpG-binding domain protein 3-like 2 | This gene encodes a protein that is related to methyl-CpG-binding proteins but lacks the methyl-CpG binding domain. The protein has been found in germ cell tumors and some somatic tissues. [provided by RefSeq, Jul 2008]. |
| MBD3L3 | Exonic | 653657 | putative methyl-CpG-binding domain protein 3-like 3 | N/A |
| MBD3L4 | Exonic | 653656 | putative methyl-CpG-binding domain protein 3-like 4 | This gene encodes a member of a family of proteins that are related to methyl-CpG-binding proteins but lack the methyl-CpG binding domain. There is no definitive support for transcription of this locus, and the transcript structure is inferred from other family members. [provided by RefSeq, Aug 2009]. Sequence Note: The |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | | RefSeq transcript and protein were derived from genomic sequence to make the sequence consistent with the reference genome assembly. The genomic coordinates used for the transcript record were based on alignments. |
| MBD3L5 | Exonic | 284428 | putative methyl-CpG-binding domain protein 3-like 5 | N/A |
| MGRN1 | Intronic | 23295 | E3 ubiquitin-protein ligase MGRN1 isoform 4 | Mahogunin (MGRN1) is a C3HC4 RING-containing protein with E3 ubiquitin ligase activity in vitro.[supplied by OMIM, Apr 2004]. Transcript Variant: This variant (4) lacks an alternate in-frame exon and uses an alternate splice junction at the 5' end of the last exon compared to variant 1. The resulting isoform (4) is shorter and has a distinct C-terminus compared to isoform 1. Sequence Note: This RefSeq record was created from transcript and genomic sequence data to make the sequence consistent with the reference genome assembly. The genomic coordinates used for the transcript record were based on transcript alignments. |
| MIR3179-1 | Exonic | 100422960 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3179-2 | Exonic | 100422288 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | 6 | | polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3179-3 | Exonic | 100423006 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3180-1 | Exonic | 100422870 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non- |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | | coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3180-2 | Exonic | 100422956 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3180-3 | Exonic | 100422836 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem- |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR4266 | Exonic | 100423027 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR548C | Intronic | 693129 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| | | | | and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR548T | Intronic | 100422849 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MIR548Z | Intronic | 100500856 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MOB2 | Intronic | 81532 | mps one binder kinase activator-like 2 isoform 1 | N/A |
| MYLK4 | Intronic | 340156 | myosin light chain kinase family member 4 | N/A |
| MYO1E | Intronic | 4643 | myosin-Ie | N/A |
| MYOC | Both | 4653 | myocilin precursor | MYOC encodes the protein myocilin, which is believed to have a role in cytoskeletal function. MYOC is expressed in many ocular tissues, including the trabecular meshwork, and was revealed to be the trabecular meshwork glucocorticoid-inducible response protein (TIGR). The trabecular meshwork is a specialized eye tissue essential in regulating intraocular pressure, and mutations in MYOC have been identified as the cause of hereditary juvenile-onset open-angle glaucoma. [provided by RefSeq, Jul 2008]. |
| NELL1 | Intronic | 4745 | protein kinase C-binding protein NELL1 isoform 2 precursor | This gene encodes a cytoplasmic protein that contains epidermal growth factor (EGF)-like repeats. The encoded heterotrimeric protein may be involved in cell growth regulation and differentiation. A similar protein in rodents is involved in craniosynostosis. Two transcript variants encoding different isoforms have been found for this gene. [provided by RefSeq, Jan 2009]. Transcript Variant: This variant (2) lacks an alternate in-frame exon compared to variant 1. The resulting isoform (2) has the same N- and C-termini but is shorter compared to isoform 1. Publication Note: This RefSeq record includes a subset of the publications that are available for this gene. Please see the Gene record to access additional publications. |
| NF1 | Intr | 4763 | neurofibromin isoform 3 | This gene product appears to function as a negative regulator of the ras signal transduction pathway. Mutations in this gene have |

| RefSeq Gene Symbol(s) | Exon overlap | NCBI Gene ID | Gene Description | RefSeq Summmary |
|---|---|---|---|---|
| | onic | | | been linked to neurofibromatosis type 1, juvenile myelomonocytic leukemia and Watson syndrome. The mRNA for this gene is subject to RNA editing (CGA>UGA->Arg1306Term) resulting in premature translation termination. Alternatively spliced transcript variants encoding different isoforms have also been described for this gene. [provided by RefSeq, Jul 2008]. Transcript Variant: This variant (3) lacks multiple 3' exons and has an alternate 3' end, as compared to variant 1. The resulting isoform (3) has a much shorter and different C-terminus, and lacks ras-GTPase activating domain and SEC14 domain, compared to isoform 1. |
| NME5 | Intronic | 8382 | nucleoside diphosphate kinase homolog 5 | N/A |
| NOMO3 | Exonic | 408050 | nodal modulator 3 precursor | This gene encodes a protein originally thought to be related to the collagenase gene family. This gene is one of three highly similar genes in a duplicated region on the short arm of chromosome 16. These three genes encode closely related proteins that may have the same function. The protein encoded by one of these genes has been identified as part of a protein complex that participates in the Nodal signaling pathway during vertebrate development. Mutations in ABCC6, which is located nearby, rather than mutations in this gene are associated with pseudoxanthoma elasticum. [provided by RefSeq, Jul 2008]. |
| NPFFR2 | Intronic | 10886 | neuropeptide FF receptor 2 isoform 2 | This gene encodes a member of a subfamily of G-protein-coupled neuropeptide receptors. This protein is activated by the neuropeptides A-18-amide (NPAF) and F-8-amide (NPFF) and may function in pain modulation and regulation of the opioid system. Alternative splicing results in multiple transcript variants. [provided by RefSeq, Jan 2009]. Transcript Variant: This variant (2) contains an alternate exon in the 5' UTR that causes translation initiation at a downstream AUG, and results an isoform (2) with a shorter N-terminus compared to isoform 1. |
| NRXN1 | Intronic | 9378 | neurexin-1-beta isoform beta precursor | Neurexins function in the vertebrate nervous system as cell adhesion molecules and receptors. Two neurexin genes are among the largest known in human (NRXN1 and NRXN3). By using alternate promoters, splice sites and exons, predictions of hundreds or even thousands of distinct mRNAs have been made. Most transcripts use the upstream promoter and encode alpha-neurexin isoforms; fewer transcripts are produced from the downstream promoter and encode beta-neurexin isoforms. Alpha-neurexins contain epidermal growth factor-like (EGF-like) sequences and |

| Figure 10B | | | | |
|---|---|---|---|---|
| Ref Seq Gene Symbol(s) | Exon overlap | NCBI Gene ID | Gene Description | RefSeq Summmary |
| | | | | laminin G domains, and they interact with neurexophilins. Beta-neurexins lack EGF-like sequences and contain fewer laminin G domains than alpha-neurexins. The RefSeq Project has decided to create only a few representative transcript variants of the multitude that are possible. [provided by RefSeq, Oct 2008]. Transcript Variant: This variant (beta) represents a beta neurexin transcript. It is transcribed from a downstream promoter, includes a different segment for its 5' UTR and 5' coding region, and lacks most of the 5' exons present in alpha transcripts, as compared to variant alpha2. The resulting protein (isoform beta) has a shorter and distinct N-terminus when it is compared to isoform alpha2. Sequence Note: The RefSeq transcript and protein were derived from transcript and genomic sequence to make the sequence consistent with the reference genome assembly. The genomic coordinates used for the transcript record were based on alignments. |
| NUBPL | Intronic | 80224 | iron-sulfur protein NUBPL isoform 2 | This gene encodes a member of the Mrp/NBP35 ATP-binding proteins family. The encoded protein is required for the assembly of the respiratory chain NADH dehydrogenase (complex I), an oligomeric enzymatic complex located in the inner mitochondrial membrane. The respiratory complex I consists of 45 subunits and 8 iron-sulfur (Fe/S) clusters. This protein is an Fe/S protein that plays a critical role in the assembly of respiratory complex I, likely by transferring Fe/S into the Fe/S-containing complex I subunits. Mutations in this gene cause mitochondrial complex I deficiency. Alternatively spliced transcript variants encoding distinct isoforms have been identified.[provided by RefSeq, Jan 2011]. Transcript Variant: This variant (2) lacks two exons from the 5' end and has an alternate 5' exon, as compared to variant 1. The resulting isoform (2) has a shorter N-terminus, as compared to isoform 1. Sequence Note: This RefSeq record was created from transcript and genomic sequence data to make the sequence consistent with the reference genome assembly. The genomic coordinates used for the transcript record were based on transcript alignments. |
| ODZ2 | Intronic | 57451 | teneurin-2 | N/A |
| OGT | Exonic | 8473 | UDP-N-acetylglucosamine--peptide N-acetylglucosaminyltransferase 110 | This gene encodes a glycosyltransferase that catalyzes the addition of a single N-acetylglucosamine in O-glycosidic linkage to serine or threonine residues. Since both phosphorylation and glycosylation compete for similar serine or threonine residues, the two processes may compete for sites, or they may alter the |

| Ref Seq Gene Symbol(s) | Exon overlap | NCBI Gene ID | Gene Description | RefSeq Summmary |
|---|---|---|---|---|
| | | | kDa subunit isoform 2 | substrate specificity of nearby sites by steric or electrostatic effects. The protein contains multiple tetratricopeptide repeats that are required for optimal recognition of substrates. Alternatively spliced transcript variants encoding distinct isoforms have been found for this gene. [provided by RefSeq, Oct 2009]. Transcript Variant: This variant (2) uses an alternate in-frame splice site in the 5' coding region compared to variant 1. This results in a shorter protein (isoform 2) compared to isoform 1. |
| OR2T29 | Exonic | 343563 | olfactory receptor 2T29 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, Jul 2008]. Sequence Note: The RefSeq transcript and protein were derived from genomic sequence to make the sequence consistent with the reference genome assembly. The genomic coordinates used for the transcript record were based on homologous alignments. |
| OXR1 | Intronic | 55074 | oxidation resistance protein 1 isoform 2 | N/A |
| PALM2 | Intronic | 114299 | paralemmin-2 isoform a | N/A |
| PALM2-AKAP2 | Intronic | 445815 | PALM2-AKAP2 protein isoform 2 | PALM2-AKAP2 mRNAs are naturally occurring read-through products of the neighboring PALM2 and AKAP2 genes. The significance of these read-through mRNAs and the function the resulting fusion protein products have not yet been determined. Alternative splicing of this gene results in several transcript variants encoding different isoforms, but the full-length nature of some of these variants has not been defined. [provided by RefSeq, Oct 2010]. Transcript Variant: This variant (2) lacks an in-frame exon near the 3' coding region compared to variant 1. It encodes a shorter isoform (2) but has identical N- and C-termini to isoform 1. |
| PAP | In | 64 | PAP-associated | N/A |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| D5 | tronic | 282 | domain-containing protein 5 isoform b | |
| PARD3B | Intronic | 117583 | partitioning defective 3 homolog B isoform a | N/A |
| PARK2 | Both | 5071 | E3 ubiquitin-protein ligase parkin isoform 3 | The precise function of this gene is unknown; however, the encoded protein is a component of a multiprotein E3 ubiquitin ligase complex that mediates the targeting of substrate proteins for proteasomal degradation. Mutations in this gene are known to cause Parkinson disease and autosomal recessive juvenile Parkinson disease. Alternative splicing of this gene produces multiple transcript variants encoding distinct isoforms. Additional splice variants of this gene have been described but currently lack transcript support. [provided by RefSeq, Jul 2008]. Transcript Variant: Transcript variant 3 lacks exons 3 to 5 present in the full-length transcript variant 1. Sequence Note: This RefSeq record was created from transcript and genomic sequence data because no single transcript was available for the full length of the gene. The extent of this transcript is supported by transcript alignments. |
| PCSK2 | Intronic | 5126 | neuroendocrine convertase 2 isoform 2 preproprotein | This gene encodes a member of the subtilisin-like proprotein convertase family. These enzymes process latent precursor proteins into their biologically active products. The encoded protein plays a critical role in hormone biosynthesis by processing a variety of prohormones including proinsulin, proopiomelanocortin and proluteinizing-hormone-releasing hormone. Single nucleotide polymorphisms in this gene may increase susceptibility to myocardial infarction and type 2 diabetes. This gene may also play a role in tumor development and progression. Alternatively spliced transcript variants encoding multiple isoforms have been observed for this gene. [provided by RefSeq, Jan 2011]. Transcript Variant: This variant (2) lacks an exon in the 5' coding region, but maintains the reading frame, compared to variant 1. The encoded isoform (2) is shorter than isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| PG | In | 10 | plasma glutamate | N/A |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| CP | tronic | 404 | carboxypeptidase precursor | |
| PHC2 | Both | 1912 | polyhomeotic-like protein 2 isoform b | In Drosophila melanogaster, the 'Polycomb' group (PcG) of genes are part of a cellular memory system that is responsible for the stable inheritance of gene activity. PcG proteins form a large multimeric, chromatin-associated protein complex. The protein encoded by this gene has homology to the Drosophila PcG protein 'polyhomeotic' (Ph) and is known to heterodimerize with EDR1 and colocalize with BMI1 in interphase nuclei of human cells. The specific function in human cells has not yet been determined. Two transcript variants encoding different isoforms have been found for this gene. [provided by RefSeq, Jul 2008]. Transcript Variant: This variant (2) differs in the 5' UTR and coding region compared to variant 1. The resulting isoform (b) has a shorter N-terminus compared to isoform a. |
| PHF17 | Exonic | 79960 | protein Jade-1 short isoform | N/A |
| PKD1P1 | Exonic | 339044 | N/A | N/A |
| PPFIA2 | Intronic | 8499 | N/A | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (8) is represented as non-coding due to the presence of an upstream ORF that is predicted to interfere with translation of the longest ORF; translation of the upstream ORF renders the transcript a candidate for nonsense-mediated mRNA decay (NMD). |

Figure 10B (Continued)

| Figure 10B | | | | |
|---|---|---|---|---|
| RefSeq Gene Symbol(s) | Exon overlap | NCBI Gene ID | Gene Description | RefSeq Summmary |
| PRKCB | Intronic | 5579 | protein kinase C beta type isoform 1 | Protein kinase C (PKC) is a family of serine- and threonine-specific protein kinases that can be activated by calcium and second messenger diacylglycerol. PKC family members phosphorylate a wide variety of protein targets and are known to be involved in diverse cellular signaling pathways. PKC family members also serve as major receptors for phorbol esters, a class of tumor promoters. Each member of the PKC family has a specific expression profile and is believed to play a distinct role in cells. The protein encoded by this gene is one of the PKC family members. This protein kinase has been reported to be involved in many different cellular functions, such as B cell activation, apoptosis induction, endothelial cell proliferation, and intestinal sugar absorption. Studies in mice also suggest that this kinase may also regulate neuronal functions and correlate fear-induced conflict behavior after stress. Alternatively spliced transcript variants encoding distinct isoforms have been reported. [provided by RefSeq, Jul 2008]. Transcript Variant: This variant (1) uses an alternate splice junction at the 5' end of the last exon compared to variant 2. The resulting isoform (1) has a distinct and shorter C-terminus compared to isoform 2. Sequence Note: This RefSeq record was created from transcript and genomic sequence data because no single transcript was available for the full length of the gene. The extent of this transcript is supported by transcript alignments. |
| PRSS35 | Intronic | 167681 | inactive serine protease 35 precursor | N/A |
| PTGIS | Exonic | 5740 | prostacyclin synthase precursor | This gene encodes a member of the cytochrome P450 superfamily of enzymes. The cytochrome P450 proteins are monooxygenases which catalyze many reactions involved in drug metabolism and synthesis of cholesterol, steroids and other lipids. However, this protein is considered a member of the cytochrome P450 superfamily on the basis of sequence similarity rather than functional similarity. This endoplasmic reticulum membrane protein catalyzes the conversion of prostglandin H2 to prostacyclin (prostaglandin I2), a potent vasodilator and inhibitor of platelet aggregation. An imbalance of prostacyclin and its physiological antagonist thromboxane A2 contribute to the development of myocardial infarction, stroke, and atherosclerosis. [provided by RefSeq, Jul 2008]. |
| RG | B | 23 | ral guanine | N/A |

| Figure 10B | | | | |
|---|---|---|---|---|
| Ref Seq Gene Symbol(s) | Exon overlap | NCBI Gene ID | Gene Description | RefSeq Summmary |
| L1 | oth | 179 | nucleotide dissociation stimulator-like 1 | |
| RGPD1 | Intronic | 400966 | RANBP2-like and GRIP domain-containing protein 1/2 | N/A |
| RPS6KA2 | Intronic | 6196 | ribosomal protein S6 kinase alpha-2 isoform b | This gene encodes a member of the RSK (ribosomal S6 kinase) family of serine/threonine kinases. This kinase contains 2 non-identical kinase catalytic domains and phosphorylates various substrates, including members of the mitogen-activated kinase (MAPK) signalling pathway. The activity of this protein has been implicated in controlling cell growth and differentiation. Alternate transcriptional splice variants, encoding different isoforms, have been characterized. [provided by RefSeq, Jul 2008]. Transcript Variant: This variant (2) differs in the 5' UTR and has multiple coding region differences, compared to variant 1. These differences result in translation initiation at an upstream ATG and an isoform (b) with a distinct N-terminus compared to isoform a. |
| RYR2 | Intronic | 6262 | ryanodine receptor 2 | This gene encodes a ryanodine receptor found in cardiac muscle sarcoplasmic reticulum. The encoded protein is one of the components of a calcium channel, composed of a tetramer of the ryanodine receptor proteins and a tetramer of FK506 binding protein 1B proteins, that supplies calcium to cardiac muscle. Mutations in this gene are associated with stress-induced polymorphic ventricular tachycardia and arrhythmogenic right ventricular dysplasia. [provided by RefSeq, Jul 2008]. Publication Note: This RefSeq record includes a subset of the publications that are available for this gene. Please see the Gene record to access additional publications. |
| SAGE1 | Exonic | 55511 | sarcoma antigen 1 | This gene belongs to a class of genes that are activated in tumors. These genes are expressed in tumors of different histologic types but not in normal tissues, except for spermatogenic cells and, for some, placenta. The proteins encoded by these genes appear to be strictly tumor specific, and hence may be excellent sources of antigens for cancer immunotherapy. This gene is expressed in sarcomas. [provided by RefSeq, Jul 2008]. |
| SDK1 | Intronic | 221935 | protein sidekick-1 | N/A |
| SH3 | In | 64 | endophilin-A3 | N/A |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| GL3 | tronic | 57 | | |
| SH3RF3 | Exonic | 344558 | SH3 domain-containing RING finger protein 3 precursor | N/A |
| SLC2A9 | Intronic | 56606 | solute carrier family 2, facilitated glucose transporter member 9 isoform 2 | This gene encodes a member of the SLC2A facilitative glucose transporter family. Members of this family play a significant role in maintaining glucose homeostasis. The encoded protein may play a role in the development and survival of chondrocytes in cartilage matrices. Two transcript variants encoding distinct isoforms have been identified for this gene. [provided by RefSeq, Jul 2008]. Transcript Variant: This variant (2), also known as GLUT9deltaN, contains alternate in-frame segments in the 5' UTR and coding region and uses a different start codon, compared to variant 1. Isoform 2 has a shorter N-terminus, compared to isoform 1. |
| SLC43A2 | Both | 124935 | large neutral amino acids transporter small subunit 4 | System L amino acid transporters, such as SLC43A2, mediate sodium-independent transport of bulky neutral amino acids across cell membranes (Bodoy et al., 2005 [PubMed 15659399]).[supplied by OMIM, Mar 2008]. |
| SNRPN | Exonic | 6638 | small nuclear ribonucleoprotein-associated protein N | The protein encoded by this gene is one polypeptide of a small nuclear ribonucleoprotein complex and belongs to the snRNP SMB/SMN family. The protein plays a role in pre-mRNA processing, possibly tissue-specific alternative splicing events. Although individual snRNPs are believed to recognize specific nucleic acid sequences through RNA-RNA base pairing, the specific role of this family member is unknown. The protein arises from a bicistronic transcript that also encodes a protein identified as the SNRPN upstream reading frame (SNURF). Multiple transcription initiation sites have been identified and extensive alternative splicing occurs in the 5' untranslated region. Additional splice variants have been described but sequences for the complete transcripts have not been determined. The 5' UTR of this gene has been identified as an imprinting center. Alternative splicing or deletion caused by a translocation event in this paternally-expressed region is responsible for Angelman syndrome or Prader-Willi syndrome due to parental imprint switch failure. [provided by RefSeq, Jul 2008]. Transcript Variant: This variant (5) lacks exon 1 but utilizes upstream, non-coding exons u1B' (downstream alternative splice donor site for u1B), u2 and u4. Alternative splicing takes place only in the 5' UTR, resulting in variants that all |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | share exons 2-10, encoding identical proteins. |
| SNTG1 | Intronic | 54212 | gamma-1-syntrophin | The protein encoded by this gene is a member of the syntrophin family. Syntrophins are cytoplasmic peripheral membrane proteins that typically contain 2 pleckstrin homology (PH) domains, a PDZ domain that bisects the first PH domain, and a C-terminal domain that mediates dystrophin binding. This gene is specifically expressed in the brain. Transcript variants for this gene have been described, but their full-length nature has not been determined. [provided by RefSeq, Jul 2008]. |
| SPECC1 | Exonic | 92521 | cytospin-B isoform 1 | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (6) contains an alternate 5' terminal non-coding exon compared to variant 1. Variants 1 and 6 encode the same isoform (1). |
| SYNJ2BP | Intronic | 55333 | synaptojanin-2-binding protein | N/A |
| SYNJ2BP-COX16 | Intronic | 100529257 | SYNJ2BP-COX16 protein isoform 3 | This locus represents naturally occurring read-through transcription between the neighboring SYNJ2BP (synaptojanin 2 binding protein) and COX16 (COX16 cytochrome c oxidase assembly homolog (S. cerevisiae)) genes on chromosome 14. The read-through transcript produces a fusion protein that shares sequence identity with each individual gene product. Alternate splicing results in multiple transcript variants that encode different isoforms. [provided by RefSeq, Feb 2011]. Transcript Variant: This variant (3) lacks an in-frame exon in the coding region, compared to variant 1. The encoded isoform (3) is shorter than isoform 1. Sequence Note: This RefSeq record was created from transcript and genomic sequence data to make the sequence consistent with the reference genome assembly. The genomic coordinates used for the transcript record were based on transcript alignments. |
| TCEA3 | Exonic | 6920 | transcription elongation factor A protein 3 | N/A |
| TM | In | 55 | trimethyllysine | This gene encodes the protein trimethyllysine dioxygenase which |

| RefSeq Gene Symbol(s) | Exon overlap | NCBI Gene ID | Gene Description | RefSeq Summmary |
|---|---|---|---|---|
| LHE | tronic | 217 | dioxygenase, mitochondrial isoform 2 precursor | is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants.[provided by RefSeq, May 2010]. Transcript Variant: This variant (2) differs in the 3' UTR and coding region differences, compared to variant 1. The resulting protein (isoform 2) has a distinct C-terminus and is shorter than isoform 1. |
| TNIK | Intronic | 23043 | TRAF2 and NCK-interacting protein kinase isoform 8 | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (8) lacks three in-frame exons in the middle portion of the coding region compared to variant 1. This results in a shorter protein (isoform 8) compared to isoform 1. |
| TRAP1 | Both | 10131 | heat shock protein 75 kDa, mitochondrial precursor | HSP90 proteins are highly conserved molecular chaperones that have key roles in signal transduction, protein folding, protein degradation, and morphologic evolution. HSP90 proteins normally associate with other cochaperones and play important roles in folding newly synthesized proteins or stabilizing and refolding denatured proteins after stress. TRAP1 is a mitochondrial HSP90 protein. Other HSP90 proteins are found in cytosol (see HSP90AA1; MIM 140571) and endoplasmic reticulum (HSP90B1; MIM 191175) (Chen et al., 2005 [PubMed 16269234]).[supplied by OMIM, Aug 2008]. |
| TRPM7 | Exonic | 54822 | transient receptor potential cation channel subfamily M member 7 | The protein encoded by this gene is both an ion channel and a serine/threonine protein kinase. The kinase activity is essential for the ion channel function, which serves to increase intracellular calcium levels and to help regulate magnesium ion homeostasis. Defects in this gene are a cause of amyotrophic lateral sclerosis-parkinsonism/dementia complex of Guam.[provided by RefSeq, May 2010]. Sequence Note: This RefSeq record was created from transcript and genomic sequence data to make the sequence consistent with the reference genome assembly. The genomic coordinates used for the transcript record were based on transcript alignments. |
| VPS13B | Exonic | 157680 | vacuolar protein sorting-associated protein 13B isoform 5 | This gene encodes a potential transmembrane protein that may function in vesicle-mediated transport and sorting of proteins within the cell. This protein may play a role in the development and the function of the eye, hematological system, and central nervous |

Figure 10B (Continued)

| Figure 10B | | | | |
|---|---|---|---|---|
| Ref Seq Gene Symbol(s) | Exon overlap | NCBI Gene ID | Gene Description | RefSeq Summmary |
| | | | | system. Mutations in this gene have been associated with Cohen syndrome. Multiple splice variants encoding distinct isoforms have been identified for this gene. [provided by RefSeq, Jul 2008]. Transcript Variant: This variant (5) encodes the longest isoform (5). Publication Note: This RefSeq record includes a subset of the publications that are available for this gene. Please see the Gene record to access additional publications. |
| WNK1 | Intronic | 65125 | serine/threonine-protein kinase WNK1 isoform 3 | This gene encodes a member of the WNK subfamily of serine/threonine protein kinases. The encoded protein may be a key regulator of blood pressure by controlling the transport of sodium and chloride ions. Mutations in this gene have been associated with pseudohypoaldosteronism type II and hereditary sensory neuropathy type II. Alternatively spliced transcript variants encoding different isoforms have been described but the full-length nature of all of them has yet to be determined.[provided by RefSeq, May 2010]. Transcript Variant: This variant (3) has multiple differences in the coding region but maintains the reading frame compared to variant 1. This variant represents the exon combination of the brain and spinal cord variant described in Figure 2F of PubMed ID 18521183. This variant encodes isoform 3, which is longer than isoform 1. Sequence Note: This RefSeq record was created from transcript and genomic sequence data to make the sequence consistent with the reference genome assembly. The genomic coordinates used for the transcript record were based on transcript alignments. The combination of alternatively spliced exons within the coding region is inferred based on experimental evidence reported in Figures 2F and 3 from PubMed ID 18521183. |
| XYLT1 | Intronic | 64131 | xylosyltransferase 1 precursor | This locus encodes a xylosyltransferase enzyme. The encoded protein catalyzes transfer of UDP-xylose to serine residues of an acceptor protein substrate. This transfer reaction is necessary for biosynthesis of glycosaminoglycan chains. Mutations in this gene have been associated with increased severity of pseudoxanthoma elasticum.[provided by RefSeq, Nov 2009]. |
| ZFP14 | Intronic | 57677 | zinc finger protein 14 homolog | N/A |
| ZMAT5 | Exonic | 55954 | zinc finger matrin-type protein 5 | N/A |
| ZN | In | 23 | zinc finger protein | The protein encoded by this gene is a nuclear protein that belongs |

| RefSeq Gene Symbol(s) | Exon overlap | NCBI Gene ID | Gene Description | RefSeq Summmary |
|---|---|---|---|---|
| F423 | tronic | 090 | 423 | to the family of Kruppel-like C2H2 zinc finger proteins. It functions as a DNA-binding transcription factor by using distinct zinc fingers in different signaling pathways. Thus, it is thought that this gene may have multiple roles in signal transduction during development. [provided by RefSeq, Jul 2008]. |
| ZNF484 | Intronic | 83744 | zinc finger protein 484 isoform a | N/A |
| ZNF804B | Intronic | 219578 | zinc finger protein 804B | N/A |

| RefSeq Gene Symbol | CNV Gene Region | NCBI Gene ID | Gene Biology Curation | Gene Annotation |
|---|---|---|---|---|
| ACTG1P4 | exonic | 648740 | No gene information | actin, gamma 1 pseudogene 4 (ACTG1P4) |
| ACYP2 | both | 98 | Acylphosphatase can hydrolyze the phosphoenzyme intermediate of different membrane pumps, particularly the Ca2+/Mg2+-ATPase from sarcoplasmic reticulum of skeletal muscle | Acylphosphatase can hydrolyze the phosphoenzyme intermediate of different membrane pumps, particularly the Ca2+/Mg2+-ATPase from sarcoplasmic reticulum of skeletal muscle |
| ADAMTS20 | intronic | 80070 | ADAM metallopeptidase with thrombospondin type 1 motif, 20, not much gene information but PD-specific CNVs also found in ADAMTS3, which has neurological links | ADAM metallopeptidase with thrombospondin type 1 motif, 20, not much gene information but PD-specific CNVs also found in ADAMTS3, which has neurological links |
| ADAMTS3 | intronic | 9508 | ADAM metallopeptidase with thrombospondin type 1 motif, 3; limited gene information but AD link for ADAMTS4, see PMID 10961658: ADAMTS-4 (a disintegrin and metalloproteinase with thrombospondin motifs) is transcriptionally induced in beta-amyloid treated rat astrocytes; but PD-specific CNVs also found in ADAMTS20 | ADAM metallopeptidase with thrombospondin type 1 motif, 3; limited gene information but AD link for ADAMTS4, see PMID 10961658: ADAMTS-4 (a disintegrin and metalloproteinase with thrombospondin motifs) is transcriptionally induced in beta-amyloid treated rat astrocytes; but PD-specific CNVs also found in ADAMTS20 |
| ADK | intronic | 132 | adenosine kinase and is drug target; neuro link, see PMID 21427729: Adenosine kinase determines the degree of brain injury after ischemic stroke in mice; epilepsy, PMID 21275977: Adenosine kinase as a target for therapeutic antisense strategies in epilepsy; see also PMIDs 21764782, 21401494, 21315743 (schiz); and PD link for PMID 18404497: Neuroprotection by adenosine in the brain: From A(1) receptor activation to A (2A) receptor blockade AND PMID 17942368: Adenosine as a neuromodulator in neurological diseases | adenosine kinase and is drug target; neuro link, see PMID 21427729: Adenosine kinase determines the degree of brain injury after ischemic stroke in mice; epilepsy, PMID 21275977: Adenosine kinase as a target for therapeutic antisense strategies in epilepsy; see also PMIDs 21764782, 21401494, 21315743 (schiz); and PD link for PMID 18404497: Neuroprotection by adenosine in the brain: From A(1) receptor activation to A (2A) receptor blockade AND PMID 17942368: Adenosine as a neuromodulator in neurological diseases |
| AHI1 | exon | 548 | See also KIF7; some AHI1 mutations | See also KIF7; some AHI1 mutations |

Figure 10C

| Figure 10C |||||
|---|---|---|---|---|
| RefSeq Gene Symbol | CNV Gene Region | NCBI Gene ID | Gene Biology Curation | Gene Annotation |
| | ic | 06 | cause Joubert syndrome (OMIM 608894, 608629), which can cause several abnormalities/symptoms, including the neurological symptoms hypotonia, ataxia, delayed walking and motor movement; mouse model for potential depression phenotype, see PMID 20956301: Neuronal Abelson helper integration site-1 (Ahi1) deficiency in mice alters TrkB signaling with a depressive phenotype; AHI1 TrkB link, see PMID 21192928: Chronic deprivation of TrkB signaling leads to selective late-onset nigrostriatal dopaminergic degeneration; see also PMID 21562748: The TrkB-Positive Dopaminergic Neurons are Less Sensitive to MPTP Insult in the Substantia Nigra of Adult C57/BL Mice | cause Joubert syndrome (OMIM 608894, 608629), which can cause several abnormalities/symptoms, including the neurological symptoms hypotonia, ataxia, delayed walking and motor movement; mouse model for potential depression phenotype, see PMID 20956301: Neuronal Abelson helper integration site-1 (Ahi1) deficiency in mice alters TrkB signaling with a depressive phenotype; AHI1 TrkB link, see PMID 21192928: Chronic deprivation of TrkB signaling leads to selective late-onset nigrostriatal dopaminergic degeneration; see also PMID 21562748: The TrkB-Positive Dopaminergic Neurons are Less Sensitive to MPTP Insult in the Substantia Nigra of Adult C57/BL Mice |
| AKR1B15 | exonic | 441282 | aldo-keto reductase family 1, member B15; limited gene information (PMID 21276782) but link to AD and PD for another gene family member (PMID 19013440 ): Role of human aldo-keto-reductase AKR1B10 in the protection against toxic aldehydes | aldo-keto reductase family 1, member B15; limited gene information (PMID 21276782) but link to AD and PD for another gene family member (PMID 19013440 ): Role of human aldo-keto-reductase AKR1B10 in the protection against toxic aldehydes |
| ALDH1A3 | exonic | 220 | PD link, 24 PubMed refs for "alcohol dehydrogenase AND parkinson's", e.g., see PMID 19388687: Products of oxidative stress inhibit aldehyde oxidation and reduction pathways in dopamine catabolism yielding elevated levels of a reactive intermediate and PMID 14678778: ALDH1 mRNA: presence in human dopamine neurons and decreases in substantia nigra in Parkinson's disease and in the ventral tegmental area in schizophrenia | PD link, 24 PubMed refs for "alcohol dehydrogenase AND parkinson's", e.g., see PMID 19388687: Products of oxidative stress inhibit aldehyde oxidation and reduction pathways in dopamine catabolism yielding elevated levels of a reactive intermediate and PMID 14678778: ALDH1 mRNA: presence in human dopamine neurons and decreases in substantia nigra in Parkinson's disease and in the ventral tegmental area in schizophrenia |
| ALLC | intronic | 55821 | Allantoicase participates in the uric acid degradation pathway. Its | Allantoicase participates in the uric acid degradation pathway. Its enzymatic |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | enzymatic activity, like that of urate oxidase (MIM 191540), was lost during vertebrate evolution.[ | activity, like that of urate oxidase (MIM 191540), was lost during vertebrate evolution.[ |
| AMY1A | exonic | 276 | | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the salivary gland. Alternative splicing results in multiple transcript variants encoding the same protein. [provided by RefSeq, Jul 2008]. Transcript Variant: This variant (2) differs in the 5' UTR, compared to variant 1. Variants 1 and 2 encode the same protein. Publication Note: This RefSeq record includes a subset of the publications that are available for this gene. Please see the Gene record to access additional publications. ##RefSeq-Attributes-START## Transcript_exon_combination_evidence :: AK292341.1 [ECO:0000332] ##RefSeq-Attributes-END## |
| | | | alpha-amylase 1 precursor | |
| AMY1B | exonic | 277 | alpha-amylase 1 precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the salivary gland. [provided by RefSeq, Jul 2008]. ##RefSeq-Attributes-START## CDS_exon_combination_evidence :: |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | | BC069347.1 [ECO:0000331] ##RefSeq-Attributes-END## |
| AMY1C | exonic | 278 | alpha-amylase 1 precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the salivary gland. [provided by RefSeq, Jul 2008]. ##RefSeq-Attributes-START## Transcript_exon_combination_evidence :: BC132995.1, BC063129.1 [ECO:0000332] ##RefSeq-Attributes-END## |
| AMY2A | exonic | 279 | pancreatic alpha-amylase precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the pancreas. [provided by RefSeq, Jul 2008]. Publication Note: This RefSeq record includes a subset of the publications that are available for this gene. Please see the Gene record to access additional publications. ##RefSeq-Attributes-START## Transcript_exon_combination_evidence :: BC007060.1, M28443.1 [ECO:0000332] ##RefSeq-Attributes-END## |
| AMY2B | both | 280 | Aceview lists this complex region as a single gene (RNPC3andAMY2B); 1,4-alpha-D-glucan glucanohydrolase | Aceview lists this complex region as a single gene (RNPC3andAMY2B); 1,4-alpha-D-glucan glucanohydrolase 2B |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| | | | 2B | |
| ANKRD16 | exonic | 54522 | ankyrin repeats; ankyrin repeats mediate protein-protein interactions in very diverse families of proteins. The number of ANK repeats in a protein can range from 2 to over 20 | ankyrin repeats; ankyrin repeats mediate protein-protein interactions in very diverse families of proteins. The number of ANK repeats in a protein can range from 2 to over 20 |
| ANKRD20A2 | exonic | 441430 | ankyrin repeat domain-containing protein 20A2 | ankyrin repeat domain 20 family, member A2 (ANKRD20A2) |
| ANKRD20A3 | exonic | 441425 | ankyrin repeat domain-containing protein 20A3 | ankyrin repeat domain 20 family, member A3 (ANKRD20A3) |
| AQP7P3 | exonic | 441432 | No gene information | aquaporin 7 pseudogene 3 (AQP7P3) |
| ATP12A | exonic | 479 | ATPase, H+/K+ transporting, nongastric, alpha polypeptide; via AceView in oxid. phos. pathway (KEGG_00190), which has several NDUFs including NDUFA4L2, which contains PD-specific CNV; PD-specific CNV in 1 PD patient also impacts an ncRNA (ENST00000402733) and gallus gallus has read through transcript from ATP12A across this region; see also mouse model (Wobbler) demonstrating progesterone protection in spinal cord neurodegeneration (PMID 12650717) | ATPase, H+/K+ transporting, nongastric, alpha polypeptide; via AceView in oxid. phos. pathway (KEGG_00190), which has several NDUFs including NDUFA4L2, which contains PD-specific CNV; PD-specific CNV in 1 PD patient also impacts an ncRNA (ENST00000402733) and gallus gallus has read through transcript from ATP12A across this region; see also mouse model (Wobbler) demonstrating progesterone protection in spinal cord neurodegeneration (PMID 12650717) |
| ATRNL1 | intronic | 26033 | Neuro link, such as PMID 18064672, abstract Atrn null mutant mice have a pleiotropic phenotype including dark fur, juvenile-onset spongiform neurodegeneration, hypomyelination, tremor, and reduced body weight and adiposity, implicating ATRN in numerous biological processes. | Neuro link, such as PMID 18064672, abstract Atrn null mutant mice have a pleiotropic phenotype including dark fur, juvenile-onset spongiform neurodegeneration, hypomyelination, tremor, and reduced body weight and adiposity, implicating ATRN in numerous biological processes. |
| B3GALNT2 | exonic | 148789 | No gene information | No gene information |
| BAIAP2L1 | intronic | 55971 | BAI1-associated protein 2-like 1; related genes have neurological or PD link, BAI1 see PMID 21706404 and for BAIAP3 see PMID 21514331: Regulation of the Bcas1 and Baiap3 transcripts in the subthalamic nucleus | BAI1-associated protein 2-like 1; related genes have neurological or PD link, BAI1 see PMID 21706404 and for BAIAP3 see PMID 21514331: Regulation of the Bcas1 and Baiap3 transcripts in the subthalamic nucleus in |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
| --- | --- | --- | --- | --- |
| | | | in mice recovering from MPTP toxicity | mice recovering from MPTP toxicity |
| BCOR | intronic | 54880 | BCL6 corepressor; see OMIM 300485, gene mutations causes oculofaciocardiodental syndrome and may cause microphthalmia-2 | BCL6 corepressor; see OMIM 300485, gene mutations causes oculofaciocardiodental syndrome and may cause microphthalmia-2 |
| BDH2 | exonic | 56898 | No gene information | No gene information |
| BICC1 | both | 80114 | bicaudal C homolog 1, polycystic kidney disease protein (PMID 20219263) but AD association link too (PMID 16385451); possible homology to bicaudal D in worm, PMID 21205795: C. elegans bicd-1, homolog of the Drosophila dynein accessory factor Bicaudal D, regulates the branching of PVD sensory neuron dendrites. | bicaudal C homolog 1, polycystic kidney disease protein (PMID 20219263) but AD association link too (PMID 16385451); possible homology to bicaudal D in worm, PMID 21205795: C. elegans bicd-1, homolog of the Drosophila dynein accessory factor Bicaudal D, regulates the branching of PVD sensory neuron dendrites. |
| BLVRA | exonic | 644 | Possible cellular aging link and NIH grant 1K08NS057824-01A1 indicate neuro link: CELL SIGNALING AND CYTOPROTECTIVE ROLES OF BILIVERDIN REDUCTASE; for PD link, see PMID 9239525: Increased plasma bilirubin in Parkinson patients on L-dopa: evidence against the free radical hypothesis?; see also PMID 21099244; for AD link, see PMID 21483094 | Possible cellular aging link and NIH grant 1K08NS057824-01A1 indicate neuro link: CELL SIGNALING AND CYTOPROTECTIVE ROLES OF BILIVERDIN REDUCTASE; for PD link, see PMID 9239525: Increased plasma bilirubin in Parkinson patients on L-dopa: evidence against the free radical hypothesis?; see also PMID 21099244; for AD link, see PMID 21483094 |
| BOLL | exonic | 66037 | Loss of this gene function results in the absence of sperm in semen (azoospermia). Histological studies demonstrated that the primary defect is at the meiotic G2/M transition. | Loss of this gene function results in the absence of sperm in semen (azoospermia). Histological studies demonstrated that the primary defect is at the meiotic G2/M transition. |
| BREA2 | exonic | 286076 | breast cancer estrogen-induced apoptosis 2; no gene information | breast cancer estrogen-induced apoptosis 2; no gene information |
| C11orf49 | intronic | 79096 | Limited gene information | Limited gene information |
| C16orf74 | exonic | 404550 | No gene information | No gene information |
| C20orf26 | both | 26074 | No gene information | No gene information |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| C4orf19 | exonic | 55286 | No gene information | No gene information |
| CACNA1B | exonic | 774 | Gene encodes a Cav2.2 Ca2+ channel and has link to PD, seem PMID 18094105: D2-like dopamine receptors modulate SKCa channel function in subthalamic nucleus neurons through inhibition of Cav2.2 channels; potential drug target, see PMID 19199960 | Gene encodes a Cav2.2 Ca2+ channel and has link to PD, seem PMID 18094105: D2-like dopamine receptors modulate SKCa channel function in subthalamic nucleus neurons through inhibition of Cav2.2 channels; potential drug target, see PMID 19199960 |
| CACNA2D1 | intronic | 781 | calcium channel, voltage-dependent, alpha 2/delta subunit 1; see PMID review 20579869: A new look at calcium channel √é¬±2√é¬¥ subunits | calcium channel, voltage-dependent, alpha 2/delta subunit 1; see PMID review 20579869: A new look at calcium channel √é¬±2√é¬¥ subunits |
| CALML6 | exonic | 163688 | PMID 15621662; expressed in prostate, thymus, heart, skeleton muscle, bone marrow and ovary | PMID 15621662; expressed in prostate, thymus, heart, skeleton muscle, bone marrow and ovary |
| CAMKMT | exonic | 79823 | This gene encodes a class I protein methyltransferase that acts in the formation of trimethyllysine in calmodulin. The protein contains a AdoMet-binding motif and may play a role in calcium-dependent signaling. | This gene encodes a class I protein methyltransferase that acts in the formation of trimethyllysine in calmodulin. The protein contains a AdoMet-binding motif and may play a role in calcium-dependent signaling. |
| CAMTA1 | intronic | 23261 | Regulated by RBFOX1 in mouse (PMID 21623373); PD-specific CNVs also found in RBFOX1 | Regulated by RBFOX1 in mouse (PMID 21623373); PD-specific CNVs also found in RBFOX1 |
| CCDC166 | exonic | 100130274 | coiled-coil domain containing 121-like; no gene information | coiled-coil domain containing 121-like; no gene information |
| CDH13 | intronic | 1012 | cadherin 13, H-cadherin, UCSC summary: This protein acts as a negative regulator of axon growth during neural differentiation. | cadherin 13, H-cadherin, UCSC summary: This protein acts as a negative regulator of axon growth during neural differentiation. |
| CENPE | exonic | 1062 | Centrosome-associated protein E is a kinesin-like motor protein that accumulates in the G2 phase of the cell cycle. Unlike other centrosome-associated proteins, it is not present during interphase and first appears at the centromere region of chromosomes during prometaphase. CENPE is proposed to be one of the motors responsible for mammalian | Centrosome-associated protein E is a kinesin-like motor protein that accumulates in the G2 phase of the cell cycle. Unlike other centrosome-associated proteins, it is not present during interphase and first appears at the centromere region of chromosomes during prometaphase. CENPE is proposed to be one of the motors responsible for mammalian |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| | | | chromosome movement and/or spindle elongation. | chromosome movement and/or spindle elongation. |
| CERK | exonic | 64781 | Hypothesis for role in PD, see PMID 19021754: Emerging pathways in genetic Parkinson's disease: Potential role of ceramide metabolism in Lewy body disease; CERK converts ceramide to ceramide 1-phosphate (C1P) and is a drug target; see also PMID 21111813 review on CERK and C1P biology: Ceramide kinase: the first decade; CERK link to PD analogous to link between PD and Gaucher√¢‚Ç",Ñ¢s disease, which is caused by GBA mutations. GBA's protein product is glucocerebrosidase, which catalyses the breakdown of the glycolipidglucosylceramide to ceramide and glucose. CERK's protein product catalyzes the next step in this metabolic pathway, converting ceramide to C1P. Multiple USPTO applications for CERK as a drug target, such as 20090081692 and 20090170914; link to JNK pathway, see PMID 19778898: JNK and ceramide kinase govern the biogenesis of lipid droplets through activation of group IVA phospholipase A2 | Hypothesis for role in PD, see PMID 19021754: Emerging pathways in genetic Parkinson's disease: Potential role of ceramide metabolism in Lewy body disease; CERK converts ceramide to ceramide 1-phosphate (C1P) and is a drug target; see also PMID 21111813 review on CERK and C1P biology: Ceramide kinase: the first decade; CERK link to PD analogous to link between PD and Gaucher√¢‚Ç",Ñ¢s disease, which is caused by GBA mutations. GBA's protein product is glucocerebrosidase, which catalyses the breakdown of the glycolipidglucosylceramide to ceramide and glucose. CERK's protein product catalyzes the next step in this metabolic pathway, converting ceramide to C1P. Multiple USPTO applications for CERK as a drug target, such as 20090081692 and 20090170914; link to JNK pathway, see PMID 19778898: JNK and ceramide kinase govern the biogenesis of lipid droplets through activation of group IVA phospholipase A2 |
| CFH | exonic | 3075 | PMID 15920296, Complement protein isoforms in CSF as possible biomarkers for neurodegenerative disease; PMID 16516157, Complement C3c and related protein biomarkers in amyotrophic lateral sclerosis and Parkinson's disease; see also US patent application 20090275046, Complement factor H protein as a biomarker of Parkinson's disease; PMID 21435440, Complement 3 and factor h in human cerebrospinal fluid in Parkinson's | PMID 15920296, Complement protein isoforms in CSF as possible biomarkers for neurodegenerative disease; PMID 16516157, Complement C3c and related protein biomarkers in amyotrophic lateral sclerosis and Parkinson's disease; see also US patent application 20090275046, Complement factor H protein as a biomarker of Parkinson's disease; PMID 21435440, Complement 3 and factor h in human cerebrospinal fluid in Parkinson's disease, Alzheimer's disease, and |

Figure 10C (Continued)

| Figure 10C | | | | |
|---|---|---|---|---|
| RefSeq Gene Symbol | CNV Gene Region | NCBI Gene ID | Gene Biology Curation | Gene Annotation |
| | | | disease, Alzheimer's disease, and multiple-system atrophy. 07Sep: PMID 15920296, Complement protein isoforms in CSF as possible biomarkers for neurodegenerative disease; PMID 16516157, Complement C3c and related protein biomarkers in amyotrophic lateral sclerosis and Parkinson's disease (see also their patent appl United States Patent Application 20090275046, Complement factor H protein as a biomarker of Parkinson's disease); PMID 21435440, Complement 3 and factor h in human cerebrospinal fluid in Parkinson's disease, Alzheimer's disease, and multiple-system atrophy; CNVs in this region also associated with atypical hemolytic uremic syndrome (PMID 19861685) | multiple-system atrophy. 07Sep: PMID 15920296, Complement protein isoforms in CSF as possible biomarkers for neurodegenerative disease; PMID 16516157, Complement C3c and related protein biomarkers in amyotrophic lateral sclerosis and Parkinson's disease (see also their patent appl United States Patent Application 20090275046, Complement factor H protein as a biomarker of Parkinson's disease); PMID 21435440, Complement 3 and factor h in human cerebrospinal fluid in Parkinson's disease, Alzheimer's disease, and multiple-system atrophy; CNVs in this region also associated with atypical hemolytic uremic syndrome (PMID 19861685) |
| CFHR1 | exonic | 3078 | complement factor H-related protein 1 precursor | This gene encodes a secreted protein belonging to the complement factor H protein family. It binds to Pseudomonas aeruginosa elongation factor Tuf together with plasminogen, which is proteolytically activated. It is proposed that Tuf acts as a virulence factor by acquiring host proteins to the pathogen surface, controlling complement, and facilitating tissue invasion. Mutations in this gene are associated with an increased risk of atypical hemolytic-uremic syndrome. [provided by RefSeq, Oct 2009]. Publication Note: This RefSeq record includes a subset of the publications that are available for this gene. Please see the Gene record to access additional publications. ##RefSeq-Attributes-START## Transcript_exon_combination_evidence :: BC107771.1, M65292.1 [ECO:0000332] ##RefSeq-Attributes-END## |

Figure 10C (Continued)

| Figure 10C ||||||
|---|---|---|---|---|
| RefSeq Gene Symbol | CNV Gene Region | NCBI Gene ID | Gene Biology Curation | Gene Annotation |
| CFHR3 | exonic | 10878 | complement factor H-related protein 3 isoform 2 precursor | The protein encoded by this gene is a secreted protein, which belongs to the complement factor H-related protein family. It binds to heparin, and may be involved in complement regulation. Mutations in this gene are associated with decreased risk of age-related macular degeneration, and with an increased risk of atypical hemolytic-uremic syndrome. Alternatively spliced transcript variants encoding different isoforms have been found for this gene. [provided by RefSeq, Oct 2011]. Transcript Variant: This variant (2) is missing an in-frame coding exon compared to variant 1, resulting in a shorter isoform (2) lacking an internal protein segment compared to isoform 1. Publication Note: This RefSeq record includes a subset of the publications that are available for this gene. Please see the Gene record to access additional publications. ##RefSeq-Attributes-START## Transcript_exon_combination_evidence :: AK298459.1 [ECO:0000332] ##RefSeq-Attributes-END## |
| CFHR4 | exonic | 10877 | complement factor H-related protein 4 isoform 2 precursor | This gene is a member of the complement factor H (CFH) gene family, and encodes one of the 5 CFH-related (CFHR) proteins. These 5 genes are closely linked to the CFH gene on chromosome 1q31-q32. The CFHRs are secreted plasma proteins synthesized primarily by the hepatocytes, and composed of highly-related short consensus repeats (SCRs). This protein enhances the cofactor activity of CFH, and is involved in complement regulation. It can associate with lipoproteins and may play a role in lipid metabolism. Alternatively spliced transcript variants encoding different |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | | isoforms (varying in the number of SCRs) have been described for this gene. [provided by RefSeq, Jan 2011]. Transcript Variant: This variant (1) represents the longest transcript and encodes the longest isoform (1, also known as FHR-4A). Publication Note: This RefSeq record includes a subset of the publications that are available for this gene. Please see the Gene record to access additional publications. ##RefSeq-Attributes-START## Transcript_exon_combination_evidence :: AJ640130.2 [ECO:0000332] ##RefSeq-Attributes-END## |
| CISD2 | exonic | 493856 | The protein encoded by this gene is a zinc finger protein that localizes to the endoplasmic reticulum. The encoded protein binds an iron/sulfur cluster and may be involved in calcium homeostasis. Defects in this gene are a cause of Wolfram syndrome 2. | The protein encoded by this gene is a zinc finger protein that localizes to the endoplasmic reticulum. The encoded protein binds an iron/sulfur cluster and may be involved in calcium homeostasis. Defects in this gene are a cause of Wolfram syndrome 2. |
| CNBD1 | intronic | 168975 | cyclic nucleotide binding domain containing 1; limited gene information | cyclic nucleotide binding domain containing 1; limited gene information |
| CNST | exonic | 163882 | PD link, CNST is a binding partner of connexins, which are associated with neuropathies and linked to PD (SNCA binds to connexin-32, connexin-43); several connexin biology refs (PMIDs 19864490, 15852376, 16720574, 17337120, 19232380, 20824494) | PD link, CNST is a binding partner of connexins, which are associated with neuropathies and linked to PD (SNCA binds to connexin-32, connexin-43); several connexin biology refs (PMIDs 19864490, 15852376, 16720574, 17337120, 19232380, 20824494) |
| CNTNAP2 | intronic | 26047 | neuropsychiatric link, see PMID 21827697: Expanding the clinical spectrum associated with defects in CNTNAP2 and NRXN1; cortical dysplasia-focal epilepsy syndrome (OMIM 610042), symptoms include "During infancy, all patients had mild gross motor delay and subtle limitations in motor skills." | neuropsychiatric link, see PMID 21827697: Expanding the clinical spectrum associated with defects in CNTNAP2 and NRXN1; cortical dysplasia-focal epilepsy syndrome (OMIM 610042), symptoms include "During infancy, all patients had mild gross motor delay and subtle limitations in motor skills." |

Figure 10C (Continued)

| \multicolumn{5}{|c|}{Figure 10C} |
| --- | --- | --- | --- | --- |
| RefSeq Gene Symbol | CNV Gene Region | NCBI Gene ID | Gene Biology Curation | Gene Annotation |
| CNTNAP3 | exonic | 79937 | Gene alias CASPR3 (PMID 12093160); RefSeq summary: The protein encoded by this gene belongs to the NCP family of cell-recognition molecules. This family represents a distinct subgroup of the neurexins. NCP proteins mediate neuron-glial interactions in vertebrates and glial-glial contact in invertebrates. The protein encoded by this gene may play a role in cell recognition within the nervous system. | Gene alias CASPR3 (PMID 12093160); RefSeq summary: The protein encoded by this gene belongs to the NCP family of cell-recognition molecules. This family represents a distinct subgroup of the neurexins. NCP proteins mediate neuron-glial interactions in vertebrates and glial-glial contact in invertebrates. The protein encoded by this gene may play a role in cell recognition within the nervous system. |
| CNTNAP3B | exonic | 728577 | contactin-associated protein-like 3B precursor | contactin associated protein-like 3B (CNTNAP3B) |
| COL24A1 | exonic | 255631 | Limited gene information | Limited gene information |
| CORIN | exonic | 10699 | The encoded protein converts pro-atrial natriuretic peptide to biologically active atrial natriuretic peptide, a cardiac hormone that regulates blood volume and pressure. This protein may also function as a pro-brain-type natriuretic peptide convertase; PMID 21606375: ES cell-derived renewable and functional midbrain dopaminergic progenitors, from abstract "Here, we show that such authentic mDA NPs can be efficiently isolated from differentiated ES cells (ESCs) using a FACS method combining two markers, Otx2 and Corin"; CORIN gene cited in US patent application 20070128168 | The encoded protein converts pro-atrial natriuretic peptide to biologically active atrial natriuretic peptide, a cardiac hormone that regulates blood volume and pressure. This protein may also function as a pro-brain-type natriuretic peptide convertase; PMID 21606375: ES cell-derived renewable and functional midbrain dopaminergic progenitors, from abstract "Here, we show that such authentic mDA NPs can be efficiently isolated from differentiated ES cells (ESCs) using a FACS method combining two markers, Otx2 and Corin"; CORIN gene cited in US patent application 20070128168 |
| CRB1 | intronic | 23418 | Leber congenital amaurosis, retinal dystropy, see OMIM 600105 | Leber congenital amaurosis, retinal dystropy, see OMIM 600105 |
| CREBRF | exonic | 153222 | No gene information | No gene information |
| CRNKL1 | both | 51340 | crooked neck-like protein 1 | The crooked neck (crn) gene of Drosophila is essential for embryogenesis and is thought to be involved in cell cycle progression and pre-mRNA splicing. This gene is similar in sequence to crn and encodes a |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | | protein which can localize to pre-mRNA splicing complexes in the nucleus. The encoded protein, which contains many tetratricopeptide repeats, is required for pre-mRNA splicing. [provided by RefSeq, Jul 2008]. ##RefSeq-Attributes-START## Transcript_exon_combination_evidence :: AF318303.1 [ECO:0000332] ##RefSeq-Attributes-END## |
| CRY1 | intronic | 1407 | circadian rhythm (OMIM 601933) | circadian rhythm (OMIM 601933) |
| CTSE | exonic | 1510 | Protein product is a neuroprotease, this class of enzymes is potential drug target for AD, PD, and Huntington (PMID 16626168): Neuroproteases in peptide neurotransmission and neurodegenerative diseases: applications to drug discovery research. | Protein product is a neuroprotease, this class of enzymes is potential drug target for AD, PD, and Huntington (PMID 16626168): Neuroproteases in peptide neurotransmission and neurodegenerative diseases: applications to drug discovery research. |
| CTSL2 | exonic | 1515 | Gene aliases cathepsin V, CTSV; cathepsin L2; alternate transcript has read through to longer transcript; PMID 21134415: Parkinson's disease involves autophagy and abnormal distribution of cathepsin L; DJ-1 funtions as a cysteine protease according to PMID 20304780: Parkinson disease protein DJ-1 converts from a zymogen to a protease by carboxyl-terminal cleavag; general review, see PMID 16626168: Neuroproteases in peptide neurotransmission and neurodegenerative diseases: applications to drug discovery research | Gene aliases cathepsin V, CTSV; cathepsin L2; alternate transcript has read through to longer transcript; PMID 21134415: Parkinson's disease involves autophagy and abnormal distribution of cathepsin L; DJ-1 funtions as a cysteine protease according to PMID 20304780: Parkinson disease protein DJ-1 converts from a zymogen to a protease by carboxyl-terminal cleavag; general review, see PMID 16626168: Neuroproteases in peptide neurotransmission and neurodegenerative diseases: applications to drug discovery research |
| CUX1 | intronic | 1523 | Neurological link, see PMID 21331220: Intrinsic programs regulating dendrites and synapses in the upper layer neurons of the cortex. | Neurological link, see PMID 21331220: Intrinsic programs regulating dendrites and synapses in the upper layer neurons of the cortex. |
| CYP4F12 | both | 66002 | cytochrome P450, family 4, subfamily F, polypeptide 12; not | cytochrome P450, family 4, subfamily F, polypeptide 12; not much gene |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | much gene information | information |
| DCC | intronic | 1630 | Gene encodes a netrin 1 receptor. The transmembrane protein is a member of the immunoglobulin superfamily of cell adhesion molecules, and mediates axon guidance of neuronal growth cones towards sources of netrin 1 ligand. Some DCC mutations cause congenital mirror movements (PMID 21242494); neurological role (OMIM 120470); role in dopamine circuitry (PMID 21653843): The netrin receptor DCC is required in the pubertal organization of mesocortical dopamine circuitry | Gene encodes a netrin 1 receptor. The transmembrane protein is a member of the immunoglobulin superfamily of cell adhesion molecules, and mediates axon guidance of neuronal growth cones towards sources of netrin 1 ligand. Some DCC mutations cause congenital mirror movements (PMID 21242494); neurological role (OMIM 120470); role in dopamine circuitry (PMID 21653843): The netrin receptor DCC is required in the pubertal organization of mesocortical dopamine circuitry |
| DCTN4 | both | 51164 | dynactin and has copper-dependent binding interactions; neurological link (PMID 20807776 ) and dynactins (e.g., DCTN1) linked to Perry syndrome and ALS (PMIDs 16533145, 18220762, 19506225, 20702129, 21420428 ); also PD link (PMID 17846173); see also http://www.investorvillage.com/smbd.asp?mb=160&mn=422622&pt=msg&mid=9261691 | dynactin and has copper-dependent binding interactions; neurological link (PMID 20807776 ) and dynactins (e.g., DCTN1) linked to Perry syndrome and ALS (PMIDs 16533145, 18220762, 19506225, 20702129, 21420428 ); also PD link (PMID 17846173); see also http://www.investorvillage.com/smbd.asp?mb=160&mn=422622&pt=msg&mid=9261691 |
| DDX11 | both | 1663 | Causes Warsaw breakage syndrome (OMIM 613398) and associated with telomere length (PMID 15520935) | Causes Warsaw breakage syndrome (OMIM 613398) and associated with telomere length (PMID 15520935) |
| DDX11-AS1 | exonic | 100506660 | No gene information | No gene information |
| DGKB | both | 1607 | Many neurological links such as see PMID 18418688, Slowly progressive spinocerebellar ataxia with extrapyramidal signs and mild cognitive impairment (SCA21).; Abstract: Direct sequencing of NDUFA4, PHF14, KIAA0960, ARLA4, ETV1, DGKB, HDAC9, FERD3L, ITGB8, and SP4 genes were performed, but all the direct mutation analyses were negative | Many neurological links such as see PMID 18418688, Slowly progressive spinocerebellar ataxia with extrapyramidal signs and mild cognitive impairment (SCA21).; Abstract: Direct sequencing of NDUFA4, PHF14, KIAA0960, ARLA4, ETV1, DGKB, HDAC9, FERD3L, ITGB8, and SP4 genes were performed, but all the direct mutation analyses were negative excluding pathogenic mutations |

| RefSeq Gene Symbol | CNV Gene Region | NCBI Gene ID | Gene Biology Curation | Gene Annotation |
|---|---|---|---|---|
| | | | excluding pathogenic mutations associated with the disease. Therefore, the gene responsible for SCA21 remains to be identified. | associated with the disease. Therefore, the gene responsible for SCA21 remains to be identified. |
| DLG2 | both | 1740 | Gene alias is PSD-93; linked to schizophrenia, bipolar disorder, epilepsy; neuro links: PMID 20097270: Postsynaptic density-93 deficiency protects cultured cortical neurons from N-methyl-D-aspartate receptor-triggered neurotoxicity; PMID 20398908: Comprehensive copy number variant (CNV) analysis of neuronal pathways genes in psychiatric disorders identifies rare variants within patients; PMID 9786987: Localization of postsynaptic density-93 to dendritic microtubules and interaction with microtubule-associated protein 1A; PMID 10725395: The neuregulin receptor ErbB-4 interacts with PDZ-containing proteins at neuronal synapses; PMID 12070168: Selective binding of synapse-associated protein 97 to GluR-A alpha-amino-5-hydroxy-3-methyl-4-isoxazole propionate receptor subunit is determined by a novel sequence motif; PMID 15304517 characterizes longer transcript; see also KCNJ15 for link to INADL, which is linked to DLG2 | Gene alias is PSD-93; linked to schizophrenia, bipolar disorder, epilepsy; neuro links: PMID 20097270: Postsynaptic density-93 deficiency protects cultured cortical neurons from N-methyl-D-aspartate receptor-triggered neurotoxicity; PMID 20398908: Comprehensive copy number variant (CNV) analysis of neuronal pathways genes in psychiatric disorders identifies rare variants within patients; PMID 9786987: Localization of postsynaptic density-93 to dendritic microtubules and interaction with microtubule-associated protein 1A; PMID 10725395: The neuregulin receptor ErbB-4 interacts with PDZ-containing proteins at neuronal synapses; PMID 12070168: Selective binding of synapse-associated protein 97 to GluR-A alpha-amino-5-hydroxy-3-methyl-4-isoxazole propionate receptor subunit is determined by a novel sequence motif; PMID 15304517 characterizes longer transcript; see also KCNJ15 for link to INADL, which is linked to DLG2 |
| DLG5 | exonic | 9231 | Neurological link; PMID 20436275: Discs large 5 is required for polarization of citron kinase in mitotic neural precursors; PMID 20505324: Discs large 5: a new regulator of Citron kinase localization in developing neocortex | Neurological link; PMID 20436275: Discs large 5 is required for polarization of citron kinase in mitotic neural precursors; PMID 20505324: Discs large 5: a new regulator of Citron kinase localization in developing neocortex |
| DLGAP2 | intronic | 9228 | Gene aliases are DAP2 and SAPAP2; AceView indicates interaction with DLG2, which has PD-specific CNV; | Gene aliases are DAP2 and SAPAP2; AceView indicates interaction with DLG2, which has PD-specific CNV; |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| | | | many neurological references, such as PMID 9694864: A novel multiple PDZ domain-containing molecule interacting with N-methyl-D-aspartate receptors and neuronal cell adhesion proteins | many neurological references, such as PMID 9694864: A novel multiple PDZ domain-containing molecule interacting with N-methyl-D-aspartate receptors and neuronal cell adhesion proteins |
| DNAH 10 | exon ic | 196 385 | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy |
| DNAH 12 | exon ic | 201 625 | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy |
| DNAH 8 | exon ic | 176 9 | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy |
| DNAJ C18 | exon ic | 202 052 | Gene alias is HSP40; protein aggregation, PMID 17984091; 20 citations for PubMed search "hsp40 AND parkinson's"; such as PMID 18711724: DnaJB6 is present in the core of Lewy bodies and is highly up-regulated in parkinsonian astrocytes | Gene alias is HSP40; protein aggregation, PMID 17984091; 20 citations for PubMed search "hsp40 AND parkinson's"; such as PMID 18711724: DnaJB6 is present in the core of Lewy bodies and is highly up-regulated in parkinsonian astrocytes |
| DPP6 | intro nic | 180 4 | Neurological link, ALS candidate; see PMIDs 19676137, 20001489, 20573902, 20685689; also family member DPP10 CNVs appear in multiple PD cases | Neurological link, ALS candidate; see PMIDs 19676137, 20001489, 20573902, 20685689; also family member DPP10 CNVs appear in multiple PD cases |
| DSCR1 | exon | 259 | No gene information | No gene information |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
| --- | --- | --- | --- | --- |
| 0 | ic | 234 | | |
| DSCR4 | exonic | 10281 | The region of chromosome 21 between genes CBR and ERG (CBR-ERG region), which spans 2.5 Mb on 21q22.2, has been defined by analysis of patients with partial trisomy 21. It contributes significantly to the pathogenesis of many characteristics of Down syndrome, including morphological features, hypotonia, and mental retardation. This gene is found in this region and multiple transcripts may exist. It is mainly expressed in the placenta. | The region of chromosome 21 between genes CBR and ERG (CBR-ERG region), which spans 2.5 Mb on 21q22.2, has been defined by analysis of patients with partial trisomy 21. It contributes significantly to the pathogenesis of many characteristics of Down syndrome, including morphological features, hypotonia, and mental retardation. This gene is found in this region and multiple transcripts may exist. It is mainly expressed in the placenta. |
| DSCR8 | exonic | 84677 | No gene information | No gene information |
| EFNA5 | intronic | 1946 | RefSeq gene summary: "Ephrin-A5, a member of the ephrin gene family, prevents axon bundling in cocultures of cortical neurons with astrocytes, a model of late stage nervous system development and differentiation"; see also EPHA3, which has neurological and PD links | RefSeq gene summary: "Ephrin-A5, a member of the ephrin gene family, prevents axon bundling in cocultures of cortical neurons with astrocytes, a model of late stage nervous system development and differentiation"; see also EPHA3, which has neurological and PD links |
| EPHA3 | exonic | 2042 | OMIM 179611; PMID 18403711: Segregation of axial motor and sensory pathways via heterotypic trans-axonal signaling; PMID 21791286: Anatomical Coupling of Sensory and Motor Nerve Trajectory via Axon Tracking; LRRK2 link, PMID 20096956: Transcriptional profile of Parkinson blood mononuclear cells with LRRK2 mutation | OMIM 179611; PMID 18403711: Segregation of axial motor and sensory pathways via heterotypic trans-axonal signaling; PMID 21791286: Anatomical Coupling of Sensory and Motor Nerve Trajectory via Axon Tracking; LRRK2 link, PMID 20096956: Transcriptional profile of Parkinson blood mononuclear cells with LRRK2 mutation |
| ERC2 | exonic | 26059 | Neurological links, such as PMID 21228161: Calcium channels link the muscle-derived synapse organizer laminin √é¬≤2 to Bassoon and CAST/Erc2 to organize presynaptic active zones; PMID 19874790: ELKS2alpha/CAST deletion selectively increases neurotransmitter | Neurological links, such as PMID 21228161: Calcium channels link the muscle-derived synapse organizer laminin √é¬≤2 to Bassoon and CAST/Erc2 to organize presynaptic active zones; PMID 19874790: ELKS2alpha/CAST deletion selectively increases neurotransmitter release at |

Figure 10C (Continued)

| RefSeq Gene Symbol | CNV Gene Region | NCBI Gene ID | Gene Biology Curation | Gene Annotation |
|---|---|---|---|---|
| | | | release at inhibitory synapses | inhibitory synapses |
| ERG | exonic | 2078 | ERG involved in brain development (PMID 1372068); SNCA-ERG interaction detected: http://www.ebi.ac.uk/intact/pages/interactions/interactions.xhtml?query=EBI-2679254 | ERG involved in brain development (PMID 1372068); SNCA-ERG interaction detected: http://www.ebi.ac.uk/intact/pages/interactions/interactions.xhtml?query=EBI-2679254 |
| F7 | exonic | 2155 | coagulation factor VII; OMIM 613878 | coagulation factor VII; OMIM 613878 |
| FABP5P3 | exonic | 220832 | No gene information | fatty acid binding protein 5 pseudogene 3 (FABP5P3) |
| FAM133CP | exonic | 728640 | No gene information | No gene information |
| FAM193A | exonic | 8603 | No gene information | No gene information |
| FAM22A | exonic | 728118 | No gene information | No gene information |
| FAM22D | exonic | 728130 | No gene information | No gene information |
| FAM27C | exonic | 100132948 | No gene information | family with sequence similarity 27, member C (FAM27C) |
| FAM35A | exonic | 54537 | No gene information | No gene information |
| FAM70B | both | 348013 | family with sequence similarity 70, member B; no gene info | family with sequence similarity 70, member B; no gene info |
| FAM74A1 | exonic | 401507 | No gene information | family with sequence similarity 74, member A1 (FAM74A1) |
| FAM74A3 | exonic | 728495 | No gene information | family with sequence similarity 74, member A3 (FAM74A3) |
| FAM75A1 | exonic | 647060 | No gene information | SPATA31 subfamily A, member 1 (SPATA31A1) |
| FAM75A2 | exonic | 642265 | No gene information | SPATA31 subfamily A, member 2 (SPATA31A2) |
| FAM75A3 | exonic | 727830 | No gene information | SPATA31 subfamily A, member 3 (SPATA31A3) |
| FAM75A4 | exonic | 642629 | No gene information | SPATA31 subfamily A, member 4 (SPATA31A4) |
| FAM75A5 | exonic | 727905 | No gene information | SPATA31 subfamily A, member 5 (SPATA31A5) |
| FAM75A6 | exonic | 389730 | No gene information | SPATA31 subfamily A, member 6 (SPATA31A6) |

Figure 10C (Continued)

| Figure 10C ||||||
|---|---|---|---|---|
| RefSeq Gene Symbol | CNV Gene Region | NCBI Gene ID | Gene Biology Curation | Gene Annotation |
| FAM75 A7 | exonic | 261 65 | No gene information | SPATA31 subfamily A, member 7 (SPATA31A7) |
| FAM95 B1 | exonic | 100 133 036 | No gene information | family with sequence similarity 95, member B1 (FAM95B1) |
| FBXO1 8 | both | 848 93 | From RefSeq summary: "The F-box proteins constitute one of the four subunits of ubiquitin protein ligase complex called SCFs (SKP1-cullin-F-box), which function in phosphorylation-dependent ubiquitination."PubMed search "cullin AND parkinson's" yields 12 refs, such as PMID 20082978: Modeling sporadic Parkinson's disease by silencing the ubiquitin E3 ligase component, SKP1A | From RefSeq summary: "The F-box proteins constitute one of the four subunits of ubiquitin protein ligase complex called SCFs (SKP1-cullin-F-box), which function in phosphorylation-dependent ubiquitination."PubMed search "cullin AND parkinson's" yields 12 refs, such as PMID 20082978: Modeling sporadic Parkinson's disease by silencing the ubiquitin E3 ligase component, SKP1A |
| FBXW 11 | both | 232 91 | PMID 18575781: Oxidative stress-induced ubiquitination of RCAN1 mediated by SCFbeta-TrCP ubiquitin ligase; USPTO application 11/914,167 (Lindquist, inventor) | PMID 18575781: Oxidative stress-induced ubiquitination of RCAN1 mediated by SCFbeta-TrCP ubiquitin ligase; USPTO application 11/914,167 (Lindquist, inventor) |
| FGF10 | exonic | 225 5 | Precedence for role of FGFs (22 genes in the family) in variety of diseases including PD (PMID 19621416); OMIM 602115; see PMID 18329286: Localization and fate of Fgf10-expressing cells in the adult mouse brain implicate Fgf10 in control of neurogenesis | Precedence for role of FGFs (22 genes in the family) in variety of diseases including PD (PMID 19621416); OMIM 602115; see PMID 18329286: Localization and fate of Fgf10-expressing cells in the adult mouse brain implicate Fgf10 in control of neurogenesis |
| FGF12 | intronic | 225 7 | Limited gene information; fibroblast growth factors linked to PD pathology, such as PMID 19731552: Neurotrophic support of midbrain dopaminergic neurons | Limited gene information; fibroblast growth factors linked to PD pathology, such as PMID 19731552: Neurotrophic support of midbrain dopaminergic neurons |
| FGL1 | exonic | 226 7 | Fibrinogen-like 1 is a member of the fibrinogen family. This protein is homologous to the carboxy terminus of the fibrinogen beta- and gamma-subunits which contains the four conserved cysteines of fibrinogens and fibrinogen related proteins. However, this protein lacks the | Fibrinogen-like 1 is a member of the fibrinogen family. This protein is homologous to the carboxy terminus of the fibrinogen beta- and gamma-subunits which contains the four conserved cysteines of fibrinogens and fibrinogen related proteins. However, this protein lacks the platelet-binding |

| RefSeq Gene Symbol | CNV Gene Region | NCBI Gene ID | Gene Biology Curation | Gene Annotation |
|---|---|---|---|---|
| | | | platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. | site, cross-linking region and a thrombin-sensitive site which are necessary for fibrin clot formation. This protein may play a role in the development of hepatocellular carcinomas. Four alternatively spliced transcript variants encoding the same protein exist for this gene. |
| FHIT | exonic | 2272 | FHIT is known as a cancer gene but there are neurological links as well (e.g., see PMIDs 21035495 and 21465257); possible cancer-neurological link because purine metabolism of FHIT and analogously MS and lymphoma drug cladribine (http://en.wikipedia.org/wiki/Cladribine); see also PMID 19302482: Protection of midbrain dopaminergic neurons by the end-product of purine metabolism uric acid: potentiation by low-level depolarization | FHIT is known as a cancer gene but there are neurological links as well (e.g., see PMIDs 21035495 and 21465257); possible cancer-neurological link because purine metabolism of FHIT and analogously MS and lymphoma drug cladribine (http://en.wikipedia.org/wiki/Cladribine); see also PMID 19302482: Protection of midbrain dopaminergic neurons by the end-product of purine metabolism uric acid: potentiation by low-level depolarization |
| FLJ33630 | intronic | 644873 | No gene information | No gene information |
| FLJ42393 | exonic | 401105 | No gene information | No gene information |
| FMNL2 | intronic | 114793 | formin-like protein 2; formin-related proteins have been implicated in morphogenesis, cytokinesis, and cell polarity; activated by RAC and it interacts with SRGAP2, which is also found to contain PD-specific CNVs in two or more PD cases, see PMID 21148482: Bi-modal regulation of a formin by srGAP2 | formin-like protein 2; formin-related proteins have been implicated in morphogenesis, cytokinesis, and cell polarity; activated by RAC and it interacts with SRGAP2, which is also found to contain PD-specific CNVs in two or more PD cases, see PMID 21148482: Bi-modal regulation of a formin by srGAP2 |
| FOXD4L2 | exonic | 100036519 | forkhead box D4-like 2 | forkhead box D4-like 2 (FOXD4L2) |
| FOXD4L4 | exonic | 349334 | forkhead box protein D4-like 4 | forkhead box D4-like 4 (FOXD4L4) |
| GABRE | exonic | 2564 | PD link (OMIM 300093), gene located in the candidate regions of 2 different neurological diseases, early- | PD link (OMIM 300093), gene located in the candidate regions of 2 different neurological diseases, early-onset |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | onset parkinsonism, or Waisman syndrome (OMIM 311510), and MRX3 (OMIM 309541), a form of X-linked mental retardation; see also PMID 19625540: Inhibitory transmission in locus coeruleus neurons expressing GABAA receptor epsilon subunit has a number of unique properties; PMID 12633144: Neuronal loss is greater in the locus coeruleus than nucleus basalis and substantia nigra in Alzheimer and Parkinson diseases; potential therapeutic target (PMID 17992687); US patent 5654172; 16 PubMed refs for "GABAA receptor AND Parkinson's", eg, PMID 2851679: GABAA receptor but not muscarinic receptor density was decreased in the brain of patients with Parkinson's disease | parkinsonism, or Waisman syndrome (OMIM 311510), and MRX3 (OMIM 309541), a form of X-linked mental retardation; see also PMID 19625540: Inhibitory transmission in locus coeruleus neurons expressing GABAA receptor epsilon subunit has a number of unique properties; PMID 12633144: Neuronal loss is greater in the locus coeruleus than nucleus basalis and substantia nigra in Alzheimer and Parkinson diseases; potential therapeutic target (PMID 17992687); US patent 5654172; 16 PubMed refs for "GABAA receptor AND Parkinson's", eg, PMID 2851679: GABAA receptor but not muscarinic receptor density was decreased in the brain of patients with Parkinson's disease |
| GADL1 | both | 339896 | Limited gene info, neurological link (PMID 7038682); see also neuro link via protein product (PMIDs 2884126, 1708467, 9497435, 12391091) | Limited gene info, neurological link (PMID 7038682); see also neuro link via protein product (PMIDs 2884126, 1708467, 9497435, 12391091) |
| GALNT13 | intronic | 114805 | Member of the UDP-N-acetyl-alpha-D-galactosamine:polypeptide N-acetylgalactosaminyltransferase (GalNAcT; EC 2.4.1.41) family, which initiate O-linked glycosylation of mucins (see MUC3A, MIM 158371) by the initial transfer of N-acetylgalactosamine (GalNAc) with an alpha-linkage to a serine or threonine residue; limited gene information | Member of the UDP-N-acetyl-alpha-D-galactosamine:polypeptide N-acetylgalactosaminyltransferase (GalNAcT; EC 2.4.1.41) family, which initiate O-linked glycosylation of mucins (see MUC3A, MIM 158371) by the initial transfer of N-acetylgalactosamine (GalNAc) with an alpha-linkage to a serine or threonine residue; limited gene information |
| GAS6 | exonic | 2621 | GAS6 is a ligand of AXL; neurological link for AXL, PMID 21569627: Loss of the receptor tyrosine kinase Axl leads to enhanced inflammation in the CNS and delayed removal of myelin debris during experimental autoimmune | GAS6 is a ligand of AXL; neurological link for AXL, PMID 21569627: Loss of the receptor tyrosine kinase Axl leads to enhanced inflammation in the CNS and delayed removal of myelin debris during experimental autoimmune encephalomyelitis; GAS6 characterized |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | encephalomyelitis; GAS6 characterized as ligand of AXL, PMID 7854420 and AXL is a drug target; GAS6 and AXL also linked to VEGFA (PMID 15507525), oxidative stress (PMID 15958209), AKT signaling (PMID 18346204), osmotic stress (PMID 18673450), AKL mice model has prolonged axonal damage after cuprizone toxicity (PMID 18804096), MS (PMID 19541935), NGF and neuronal differentiation and survival (PMID 19027714) | as ligand of AXL, PMID 7854420 and AXL is a drug target; GAS6 and AXL also linked to VEGFA (PMID 15507525), oxidative stress (PMID 15958209), AKT signaling (PMID 18346204), osmotic stress (PMID 18673450), AKL mice model has prolonged axonal damage after cuprizone toxicity (PMID 18804096), MS (PMID 19541935), NGF and neuronal differentiation and survival (PMID 19027714) |
| GAS6-AS1 | exonic | 650669 | No gene information | GAS6 antisense RNA 1 (GAS6-AS1) |
| GGTLC2 | exonic | 91227 | gamma-glutamyltransferase light chain 2 isoform 1 | Gamma-glutamyltransferase-1 (GGT1; MIM 612346) is a membrane-bound extracellular enzyme that cleaves gamma-glutamyl peptide bonds in glutathione and other peptides and transfers the gamma-glutamyl moiety to acceptors. Autocatalytic cleavage of the GGT1 precursor polypeptide produces a heavy chain and a light chain that associate with each other to form the functional enzyme. Light chain-only GGTs, such as GGTLC2, contain a region corresponding to the GGT1 light chain, but they lack the membrane-anchoring heavy chain region (Heisterkamp et al., 2008 [PubMed 18357469]).[supplied by OMIM, Oct 2008]. ##RefSeq-Attributes-START## Transcript_exon_combination_evidence :: BC069534.1, EL736203.1 [ECO:0000332] ##RefSeq-Attributes-END## |
| GNB1 | exonic | 2782 | Heterotrimeric guanine nucleotide-binding proteins (G proteins), which integrate signals between receptors and effector proteins, are composed of an alpha, a beta, and a gamma | Heterotrimeric guanine nucleotide-binding proteins (G proteins), which integrate signals between receptors and effector proteins, are composed of an alpha, a beta, and a gamma subunit. |

Figure 10C (Continued)

| Figure 10C ||||||
|---|---|---|---|---|
| RefSeq Gene Symbol | CNV Gene Region | NCBI Gene ID | Gene Biology Curation | Gene Annotation |
| | | | subunit. These subunits are encoded by families of related genes. This gene encodes a beta subunit. Beta subunits are important regulators of alpha subunits, as well as of certain signal transduction receptors and effectors. This gene uses alternative polyadenylation signals. | These subunits are encoded by families of related genes. This gene encodes a beta subunit. Beta subunits are important regulators of alpha subunits, as well as of certain signal transduction receptors and effectors. This gene uses alternative polyadenylation signals. |
| GNG12-AS1 | intronic | 100289178 | No gene information | No gene information |
| GNG4 | exonic | 2786 | See PMIDs 7782277, A direct interaction between G-protein beta gamma subunits and the Raf-1 protein kinase, and 17055733, Activation of tyrosine kinase receptor signaling pathway by rasagiline facilitates neurorescue and restoration of nigrostriatal dopamine neurons in post-MPTP-induced parkinsonism (abstract cites role of RAF1 in Trk pathway) | See PMIDs 7782277, A direct interaction between G-protein beta gamma subunits and the Raf-1 protein kinase, and 17055733, Activation of tyrosine kinase receptor signaling pathway by rasagiline facilitates neurorescue and restoration of nigrostriatal dopamine neurons in post-MPTP-induced parkinsonism (abstract cites role of RAF1 in Trk pathway) |
| GPR20 | exonic | 2843 | GPR20 involved in cAMP levels (PMID 18347022), which also has link to PD (PMID 21079735); also, GPR20 overexpression decreases cAMP levels, which some PD drugs can boost (PMID 17100591); cAMP is neuroprotective, PMID 1357186: Cyclic AMP, but not basic FGF, increases the in vitro survival of mesencephalic dopaminergic neurons and protects them from MPP(+)-induced degeneration | GPR20 involved in cAMP levels (PMID 18347022), which also has link to PD (PMID 21079735); also, GPR20 overexpression decreases cAMP levels, which some PD drugs can boost (PMID 17100591); cAMP is neuroprotective, PMID 1357186: Cyclic AMP, but not basic FGF, increases the in vitro survival of mesencephalic dopaminergic neurons and protects them from MPP(+)-induced degeneration |
| GPR98 | intronic | 84059 | Mutations in this gene are associated with Usher syndrome 2 and familial febrile seizures. | Mutations in this gene are associated with Usher syndrome 2 and familial febrile seizures. |
| GRIN2A | intronic | 2903 | Neurological role (OMIM 138253) and GWAS PD link (PMID 21876681) | Neurological role (OMIM 138253) and GWAS PD link (PMID 21876681) |
| GRM5 | intronic | 2915 | glutamate receptor, metabotropic 5; many neurological references and direct PD link, PMID 21103359: | glutamate receptor, metabotropic 5; many neurological references and direct PD link, PMID 21103359: Alterations |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | Alterations in mGluR5 expression and signaling in Lewy body disease and in transgenic models of alpha-synucleinopathy--implications for excitotoxicity. | in mGluR5 expression and signaling in Lewy body disease and in transgenic models of alpha-synucleinopathy--implications for excitotoxicity. |
| GSTTP2 | exonic | 653399 | glutathione S-transferase theta pseudogene 2; limited gene information | glutathione S-transferase theta pseudogene 2; limited gene information |
| HDAC9 | exonic | 9734 | Neurological link, see PMIDs 20525065 and 20525066: Nucleocytoplasmic translocation of HDAC9 regulates gene expression and dendritic growth in developing cortical neurons; HDAC role in GAD expression and potential therapeutic of HDAC inhibitor, PMID 17360583: Histone hyperacetylation induces demethylation of reelin and 67-kDa glutamic acid decarboxylase promoters; PMID 20947501: Histone deacetylase 9 (HDAC9) regulates the functions of the ATDC (TRIM29) protein; HDRP (HDAC9 alt gene name) is neuroprotective, PMID 16611996: Neuroprotection by histone deacetylase-related protein; PMID 15711539: Histone deacetylase 9 couples neuronal activity to muscle chromatin acetylation and gene expression; also HDAC9 link to MEF2, PMID 20197093: MEF-2 regulates activity-dependent spine loss in striatopallidal medium spiny neurons, PMID 21393861: Direct regulation of complex I by mitochondrial MEF2D is disrupted in a mouse model of Parkinson disease and in human patients | Neurological link, see PMIDs 20525065 and 20525066: Nucleocytoplasmic translocation of HDAC9 regulates gene expression and dendritic growth in developing cortical neurons; HDAC role in GAD expression and potential therapeutic of HDAC inhibitor, PMID 17360583: Histone hyperacetylation induces demethylation of reelin and 67-kDa glutamic acid decarboxylase promoters; PMID 20947501: Histone deacetylase 9 (HDAC9) regulates the functions of the ATDC (TRIM29) protein; HDRP (HDAC9 alt gene name) is neuroprotective, PMID 16611996: Neuroprotection by histone deacetylase-related protein; PMID 15711539: Histone deacetylase 9 couples neuronal activity to muscle chromatin acetylation and gene expression; also HDAC9 link to MEF2, PMID 20197093: MEF-2 regulates activity-dependent spine loss in striatopallidal medium spiny neurons, PMID 21393861: Direct regulation of complex I by mitochondrial MEF2D is disrupted in a mouse model of Parkinson disease and in human patients |
| HKR1 | intronic | 284459 | HKR1, GLI-Kruppel zinc finger family member; link to MAPK pathway but most work done in yeast | HKR1, GLI-Kruppel zinc finger family member; link to MAPK pathway but most work done in yeast |
| HTA | exonic | 283902 | No gene information | No gene information |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| HTR1E | exonic | 3354 | 5-hydroxytryptamine (serotonin) receptor 1E ; PubMed citations include psych disorders and migraine but see also: http://onlinelibrary.wiley.com/doi/10.1002/mds.20370/full; Drug target (http://www.freepatentsonline.com/5786155.html) but hard to find specific compounds and animal model (not expressed in rodents but human homolog found in guinea pig), potential role in memory, pain, mental health and PD as other 5-HT receptors are PD drug targets; Synaptic Pharmaceuticals now part of a Danish company: http://www.lundbeckresearch.us/; see also PMIDs 19200348, 21422162 | 5-hydroxytryptamine (serotonin) receptor 1E ; PubMed citations include psych disorders and migraine but see also: http://onlinelibrary.wiley.com/doi/10.1002/mds.20370/full; Drug target (http://www.freepatentsonline.com/5786155.html) but hard to find specific compounds and animal model (not expressed in rodents but human homolog found in guinea pig), potential role in memory, pain, mental health and PD as other 5-HT receptors are PD drug targets; Synaptic Pharmaceuticals now part of a Danish company: http://www.lundbeckresearch.us/; see also PMIDs 19200348, 21422162 |
| IGLL5 | exonic | 100423062 | immunoglobulin lambda-like polypeptide 5 isoform 2 | This gene encodes one of the immunoglobulin lambda-like polypeptides. It is located within the immunoglobulin lambda locus but it does not require somatic rearrangement for expression. The first exon of this gene is unrelated to immunoglobulin variable genes; the second and third exons are the immunoglobulin lambda joining 1 and the immunoglobulin lambda constant 1 gene segments. Alternative splicing results in multiple transcript variants. [provided by RefSeq, May 2010]. Transcript Variant: This variant (1) represents the longer transcript and encodes the longer isoform (1). ##RefSeq-Attributes-START## Transcript_exon_combination_evidence :: AJ318022.1, BG756003.1 [ECO:0000332] ##RefSeq-Attributes-END## |
| IGSF21 | intronic | 84966 | Limited gene information | Limited gene information |
| IKBKB | exon | 355 | PD link: PMID 17314283: Parkin | PD link: PMID 17314283: Parkin |

| RefSeq Gene Symbol | CNV Gene Region | NCBI Gene ID | Gene Biology Curation | Gene Annotation |
|---|---|---|---|---|
| | ic | 1 | mediates neuroprotection through activation of IkappaB kinase/nuclear factor-kappaB signaling; PMID 20190013: Inhibition of IkappaB kinase-beta protects dopamine neurons against lipopolysaccharide-induced neurotoxicity. | mediates neuroprotection through activation of IkappaB kinase/nuclear factor-kappaB signaling; PMID 20190013: Inhibition of IkappaB kinase-beta protects dopamine neurons against lipopolysaccharide-induced neurotoxicity. |
| IL1RAPL1 | both | 11141 | interleukin 1 receptor accessory protein-like 1; neurological link, such as PMID 17502602: IL1-receptor accessory protein-like 1 (IL1RAPL1), a protein involved in cognitive functions, regulates N-type Ca2+-channel and neurite elongation; PMID 21926414: The X-linked intellectual disability protein IL1RAPL1 regulates excitatory synapse formation by binding PTP{delta} and RhoGAP2; IL1RAPL2 also contains PD-specific CNVs | interleukin 1 receptor accessory protein-like 1; neurological link, such as PMID 17502602: IL1-receptor accessory protein-like 1 (IL1RAPL1), a protein involved in cognitive functions, regulates N-type Ca2+-channel and neurite elongation; PMID 21926414: The X-linked intellectual disability protein IL1RAPL1 regulates excitatory synapse formation by binding PTP{delta} and RhoGAP2; IL1RAPL2 also contains PD-specific CNVs |
| IL1RAPL2 | intronic | 26280 | neurological link (PMID 11587848): IL1RAPL2 maps to Xq22 and is specifically expressed in the central nervous system; IL1RAPL1 also contains PD-specific CNVs | neurological link (PMID 11587848): IL1RAPL2 maps to Xq22 and is specifically expressed in the central nervous system; IL1RAPL1 also contains PD-specific CNVs |
| IQCG | exonic | 84223 | IQ domain-containing protein G; limited gene information but neurological link for other IQ domain proteins, see AceView entry: "Some proteins known to contain an IQ motif are listed below: A number of conventional and unconventional myosins. Neuromodulin (GAP-43). This protein is associated with nerve growth. It is a major component of the motile "growth cones" that form the tips of elongating axons. Neurogranin (NG/p17). Acts as a "third messenger" substrate of protein kinase C-mediated molecular cascades during synaptic development and remodeling. Sperm surface protein Sp17. Ras GTPase- | IQ domain-containing protein G; limited gene information but neurological link for other IQ domain proteins, see AceView entry: "Some proteins known to contain an IQ motif are listed below: A number of conventional and unconventional myosins. Neuromodulin (GAP-43). This protein is associated with nerve growth. It is a major component of the motile "growth cones" that form the tips of elongating axons. Neurogranin (NG/p17). Acts as a "third messenger" substrate of protein kinase C-mediated molecular cascades during synaptic development and remodeling. Sperm surface protein Sp17. Ras GTPase-activating-like protein IQGAP1. |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | activating-like protein IQGAP1. IQGAP1 contains 4 IQ motifs." | IQGAP1 contains 4 IQ motifs." |
| ISLR | exonic | 3671 | No gene information | No gene information |
| ISLR2 | exonic | 57611 | No gene information | No gene information |
| ITGAM | exonic | 3684 | Gene alias is MAC-1 and has AD/PD link, PMID 21232086: Microglial MAC1 receptor and PI3K are essential in mediating b-amyloid peptide-induced microglial activation and subsequent neurotoxicity | Gene alias is MAC-1 and has AD/PD link, PMID 21232086: Microglial MAC1 receptor and PI3K are essential in mediating b-amyloid peptide-induced microglial activation and subsequent neurotoxicity |
| JAG2 | exonic | 3714 | Cancer link but also neurological link, such as PMID 20680491: Proliferating neural progenitors in the developing CNS of zebrafish require Jagged2 and Jagged1b. | Cancer link but also neurological link, such as PMID 20680491: Proliferating neural progenitors in the developing CNS of zebrafish require Jagged2 and Jagged1b. |
| KANSL1 | both | 284058 | Link to MAPT locus, see also PMID 11641718 | Link to MAPT locus, see also PMID 11641718 |
| KANSL1-AS1 | exonic | 644246 | No gene information | KANSL1 antisense RNA 1 (KANSL1-AS1) |
| KATNAL2 | exonic | 83473 | katanin p60 subunit A-like 2; no gene information | katanin p60 subunit A-like 2; no gene information |
| KCNA7 | exonic | 3743 | This gene encodes a member of the potassium channel, voltage-gated, shaker-related subfamily. This member contains six membrane-spanning domains with a shaker-type repeat in the fourth segment. The gene is expressed preferentially in skeletal muscle, heart and kidney. It is a candidate gene for inherited cardiac disorders. | This gene encodes a member of the potassium channel, voltage-gated, shaker-related subfamily. This member contains six membrane-spanning domains with a shaker-type repeat in the fourth segment. The gene is expressed preferentially in skeletal muscle, heart and kidney. It is a candidate gene for inherited cardiac disorders. |
| KCNJ15 | exonic | 3772 | Gene aliases IRKK; KIR1.3; KIR4.2; neurlogical link, see PMID 9647694: CIPP [gene alias INADL], a novel multivalent PDZ domain protein, selectively interacts with Kir4.0 family members, NMDA receptor subunits, neurexins, and neuroligins and PMID 15068243: Chromosome 21 KIR channels in brain | Gene aliases IRKK; KIR1.3; KIR4.2; neurlogical link, see PMID 9647694: CIPP [gene alias INADL], a novel multivalent PDZ domain protein, selectively interacts with Kir4.0 family members, NMDA receptor subunits, neurexins, and neuroligins and PMID 15068243: Chromosome 21 KIR channels in brain development; via |

Figure 10C (Continued)

| Figure 10C ||||| 
| RefSeq Gene Symbol | CNV Gene Region | NCBI Gene ID | Gene Biology Curation | Gene Annotation |
| --- | --- | --- | --- | --- |
| | | | development; via AceView on INADL, DLG2 listed as a second interactor, which is also found to harbor a PD-specific CNV | AceView on INADL, DLG2 listed as a second interactor, which is also found to harbor a PD-specific CNV |
| KCNMA1 | exonic | 3778 | Some gene mutations cause paroxysmal dyskinesia (OMIM 600150, see mouse model); KCNMA1 is a BK channel, which are implicated in neurological disorders, see PMID 11060806: Is there a role for potassium channel openers in neuronal ion channel disorders? And PMID 11222629: Oxidative regulation of large conductance calcium-activated potassium channels. | Some gene mutations cause paroxysmal dyskinesia (OMIM 600150, see mouse model); KCNMA1 is a BK channel, which are implicated in neurological disorders, see PMID 11060806: Is there a role for potassium channel openers in neuronal ion channel disorders? And PMID 11222629: Oxidative regulation of large conductance calcium-activated potassium channels. |
| KCNN3 | exonic | 3782 | Link to ataxia and PD (PMIDs 11594924, 18650029), see also PMID 21767612: Spike frequency adaptation is developmentally regulated in substantia nigra pars compacta dopaminergic neurons | Link to ataxia and PD (PMIDs 11594924, 18650029), see also PMID 21767612: Spike frequency adaptation is developmentally regulated in substantia nigra pars compacta dopaminergic neurons |
| KGFLP2 | exonic | 654466 | No gene information | keratinocyte growth factor-like protein 2 (KGFLP2) |
| KIAA1751 | exonic | 85452 | No gene information | No gene information |
| KIF7 | exonic | 374654 | AD/PD link, see PMID 18725959: The actin-binding protein capulet genetically interacts with the microtubule motor kinesin to maintain neuronal dendrite homeostasis and PMID 18845538: Parkin regulates Eg5 [motor protein of kinesin family] expression by Hsp70 ubiquitination-dependent inactivation of c-Jun NH2-terminal kinase; See also AHI1; OMIM phenotypic series includes a Joubert syndrome locus (15q26.1) that includes KIF7 (OMIM 200990); via AceView, link to CENPE and DNAHs | AD/PD link, see PMID 18725959: The actin-binding protein capulet genetically interacts with the microtubule motor kinesin to maintain neuronal dendrite homeostasis and PMID 18845538: Parkin regulates Eg5 [motor protein of kinesin family] expression by Hsp70 ubiquitination-dependent inactivation of c-Jun NH2-terminal kinase; See also AHI1; OMIM phenotypic series includes a Joubert syndrome locus (15q26.1) that includes KIF7 (OMIM 200990); via AceView, link to CENPE and DNAHs |
| KLRC1 | exon | 382 | Gene alias is NKG2A, associated | Gene alias is NKG2A, associated with |

Figure 10C (Continued)

| Figure 10C | | | | |
|---|---|---|---|---|
| RefSeq Gene Symbol | CNV Gene Region | NCBI Gene ID | Gene Biology Curation | Gene Annotation |
| | ic | 1 | with autoimmune disease (OMIM 161555) | autoimmune disease (OMIM 161555) |
| KLRC2 | exonic | 3822 | NKG2-C type II integral membrane protein | Natural killer (NK) cells are lymphocytes that can mediate lysis of certain tumor cells and virus-infected cells without previous activation. They can also regulate specific humoral and cell-mediated immunity. NK cells preferentially express several calcium-dependent (C-type) lectins, which have been implicated in the regulation of NK cell function. The group, designated KLRC (NKG2) are expressed primarily in natural killer (NK) cells and encodes a family of transmembrane proteins characterized by a type II membrane orientation (extracellular C terminus) and the presence of a C-type lectin domain. The KLRC (NKG2) gene family is located within the NK complex, a region that contains several C-type lectin genes preferentially expressed on NK cells. KLRC2 alternative splice variants have been described but their full-length nature has not been determined. [provided by RefSeq, Jul 2008]. Publication Note: This RefSeq record includes a subset of the publications that are available for this gene. Please see the Gene record to access additional publications. ##RefSeq-Attributes-START## Transcript_exon_combination_evidence :: X54869.1, AF078550.1 [ECO:0000332] ##RefSeq-Attributes-END## |
| KLRC3 | exonic | 3823 | NKG2-E type II integral membrane protein isoform H | Natural killer (NK) cells are lymphocytes that can mediate lysis of certain tumor cells and virus-infected cells without previous activation. They can also regulate specific humoral and cell-mediated immunity. NK cells preferentially express several calcium- |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
|---|---|---|---|---|
| | | | | dependent (C-type) lectins, which have been implicated in the regulation of NK cell function. KLRC3 is a member of the NKG2 group which are expressed primarily in natural killer (NK) cells and encodes a family of transmembrane proteins characterized by a type II membrane orientation (extracellular C terminus) and the presence of a C-type lectin domain. The NKG2 gene family is located within the NK complex, a region that contains several C-type lectin genes preferentially expressed on NK cells. Alternative splicing results in multiple transcript variants encoding different isoforms. [provided by RefSeq, Jul 2008]. Transcript Variant: This variant (1), also known as NKG2-E, represents the longer transcript but encodes the shorter isoform (E). |
| KYNU | exonic | 8942 | PD link and other neuro diseases via kynurenine pathway, see PMID 21687761: The involvement of neuroinflammation and kynurenine pathway in Parkinson's disease | PD link and other neuro diseases via kynurenine pathway, see PMID 21687761: The involvement of neuroinflammation and kynurenine pathway in Parkinson's disease |
| LGI1 | intronic | 9211 | leucine-rich, glioma inactivated 1; see OMIM 604619, strong neuro function and causes epilepsy, for example see PMIDs 20663977 and 20130004 | leucine-rich, glioma inactivated 1; see OMIM 604619, strong neuro function and causes epilepsy, for example see PMIDs 20663977 and 20130004 |
| LINC00271 | exonic | 100131814 | No gene information | No gene information |
| LMLN | exonic | 89782 | leishmanolysin-like (metallopeptidase M8 family), gene alias is invadolysin (PMID 15557119) | leishmanolysin-like (metallopeptidase M8 family), gene alias is invadolysin (PMID 15557119) |
| LOC100128292 | exonic | 100128292 | No gene information | No gene information |
| LOC100128822 | exonic | 100128822 | No gene information | uncharacterized LOC100128822 (LOC100128822) |
| LOC100506176 | exonic | 100506... | No gene information | No gene information |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| 2 | | 172 | | |
| LOC255130 | both | 255130 | No gene information | No gene information |
| LOC255654 | exonic | 255654 | No gene information | No gene information |
| LOC283731 | exonic | 283731 | No gene information | No gene information |
| LOC286297 | exonic | 286297 | No gene information | uncharacterized LOC286297 (LOC286297) |
| LOC439994 | exonic | 439994 | No gene information | No gene information |
| LOC642929 | exonic | 642929 | No gene information | general transcription factor II, i pseudogene (LOC642929) |
| LOC643648 | exonic | 643648 | No gene information | uncharacterized LOC643648 (LOC643648) |
| LOC648691 | exonic | 648691 | No gene information | uncharacterized LOC648691 (LOC648691) |
| LOC653501 | exonic | 653501 | No gene information | zinc finger protein 658 pseudogene (LOC653501) |
| LOC728190 | exonic | 728190 | No gene information | No gene information |
| LOC728218 | exonic | 728218 | No gene information | No gene information |
| LOC731779 | exonic | 731779 | No gene information | No gene information |
| LOC96610 | exonic | 96610 | BMS1 homolog, ribosome assembly protein (yeast) pseudogene; limited gene information (OMIM 605141) | BMS1 homolog, ribosome assembly protein (yeast) pseudogene; limited gene information (OMIM 605141) |
| LPP | exonic | 4026 | Gene product is a member of zyxin protein family and has a role in cell migration and focal adhesions (PMID 19111675 ), with potential link to PD/AD via alpha actinin (PMID 3293578) | Gene product is a member of zyxin protein family and has a role in cell migration and focal adhesions (PMID 19111675 ), with potential link to PD/AD via alpha actinin (PMID 3293578) |
| LRCH3 | exonic | 84859 | leucine-rich repeats and calponin homology (CH) domain containing 3; no gene function information but AceView indicates it√¢‚Ç¨‚Ñ¢s a putative partner of YWHAG, which has been shown to interact with RAF1(PD link PMID 17055733) and protein kinase C | leucine-rich repeats and calponin homology (CH) domain containing 3; no gene function information but AceView indicates it√¢‚Ç¨‚Ñ¢s a putative partner of YWHAG, which has been shown to interact with RAF1(PD link PMID 17055733) and protein kinase C |

Figure 10C (Continued)

| \multicolumn{5}{|c|}{Figure 10C} |
| --- | --- | --- | --- | --- |
| RefSeq Gene Symbol | CNV Gene Region | NCBI Gene ID | Gene Biology Curation | Gene Annotation |
| LRP1 | exonic | 4035 | Gene alias is A2MR; AD link (PMID 21585370) and neurological link (PMID 21779915) | Gene alias is A2MR; AD link (PMID 21585370) and neurological link (PMID 21779915) |
| LRP2 | exonic | 4036 | PD link and Neurological links; PMID 21800131: Up-regulation of metallothionein gene expression in Parkinsonian astrocytes; some LRP2 mutations cause Donnai-Barrow syndrome which can include brain malformations (OMIM 600073); PMID 21720686: New insights into the roles of megalin/LRP2 and the regulation of its functional expression, abstract states, "expression of megalin and some of its ligands in the central and peripheral nervous system suggests a role for this receptor in neural regeneration processes;" also linked to APP function (PMID 21947084); PMID 21833580: Metallothionein promotes regenerative axonal sprouting of dorsal root ganglion neurons after physical axotomy, abstract states "This study provides a clear indication that MT [metallothionein I/II) promotes axonal regeneration of DRG neurons, via a megalin- and MAPK-dependent mechanism;" see also PMID 21779915 | PD link and Neurological links; PMID 21800131: Up-regulation of metallothionein gene expression in Parkinsonian astrocytes; some LRP2 mutations cause Donnai-Barrow syndrome which can include brain malformations (OMIM 600073); PMID 21720686: New insights into the roles of megalin/LRP2 and the regulation of its functional expression, abstract states, "expression of megalin and some of its ligands in the central and peripheral nervous system suggests a role for this receptor in neural regeneration processes;" also linked to APP function (PMID 21947084); PMID 21833580: Metallothionein promotes regenerative axonal sprouting of dorsal root ganglion neurons after physical axotomy, abstract states "This study provides a clear indication that MT [metallothionein I/II) promotes axonal regeneration of DRG neurons, via a megalin- and MAPK-dependent mechanism;" see also PMID 21779915 |
| LRRFIP1 | intronic | 9208 | Interferon response (PMID 20586614) and linked to lysomoal structures (PMID 21102652), both processes linked to PD | Interferon response (PMID 20586614) and linked to lysomoal structures (PMID 21102652), both processes linked to PD |
| LRRIQ3 | both | 127255 | No gene information | No gene information |
| LRRK2 | exonic | 120892 | Some mutations are causative of PD (OMIM 609007) | Some mutations are causative of PD (OMIM 609007) |
| MAGI3 | intronic | 260425 | PMID 15458844: The complexity of PDZ domain-mediated interactions at glutamatergic synapses: a case study on neuroligin | PMID 15458844: The complexity of PDZ domain-mediated interactions at glutamatergic synapses: a case study on neuroligin |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| MANBA | exonic | 4126 | OMIM 609489, deletion causes spinocerebellar ataxia disease (PMID 18980795), not sure about gain | OMIM 609489, deletion causes spinocerebellar ataxia disease (PMID 18980795), not sure about gain |
| MAP2 | intronic | 4133 | 35 PubMed citations for "MAP2 AND parkinson's" | 35 PubMed citations for "MAP2 AND parkinson's" |
| MAS1 | exonic | 4142 | Gene linked to cancer but also neurobehavioral and blood pressure roles, see OMIM 165180; neurological link, see PMID 21178125: ACE2/ANG-(1-7)/Mas pathway in the brain: the axis of good | Gene linked to cancer but also neurobehavioral and blood pressure roles, see OMIM 165180; neurological link, see PMID 21178125: ACE2/ANG-(1-7)/Mas pathway in the brain: the axis of good |
| MATN2 | intronic | 4147 | matrilin 2 has strong neurological link, see PMID 19295126: The extracellular-matrix protein matrilin 2 participates in peripheral nerve regeneration | matrilin 2 has strong neurological link, see PMID 19295126: The extracellular-matrix protein matrilin 2 participates in peripheral nerve regeneration |
| MECP2 | intronic | 4204 | methyl CpG binding protein 2 (Rett syndrome); see OMIM 300005; link to PD, PMID review 19833297 and PMID 21880923: Loss of mecp2 in substantia nigra dopamine neurons compromises the nigrostriatal pathway | methyl CpG binding protein 2 (Rett syndrome); see OMIM 300005; link to PD, PMID review 19833297 and PMID 21880923: Loss of mecp2 in substantia nigra dopamine neurons compromises the nigrostriatal pathway |
| MEGF10 | both | 84466 | Neurological and AD links, PMID 20828568: MEGF10 functions as a receptor for the uptake of amyloid-√é¬≤. | Neurological and AD links, PMID 20828568: MEGF10 functions as a receptor for the uptake of amyloid-√é¬≤. |
| METTL21C | both | 196541 | Gene alias is C13orf39; methyltransferase like 21C, no gene info but present in 2 of 87 PD cases and 0 of 1005 Normals | Gene alias is C13orf39; methyltransferase like 21C, no gene info but present in 2 of 87 PD cases and 0 of 1005 Normals |
| MGAM | exonic | 8972 | maltase-glucoamylase, starch digestion; glucose metabolism (PMID 19193815) | maltase-glucoamylase, starch digestion; glucose metabolism (PMID 19193815) |
| MGAT4C | intronic | 25834 | mannosyl (alpha-1,3-)-glycoprotein beta-1,4-N-acetylglucosaminyltransferase, isozyme C; limited gene information but mice lacking N-acetylglucosaminyltransferase I die mid-gestation and embryos are developmentally retarded, most noticeably in neural tissue (PMID | mannosyl (alpha-1,3-)-glycoprotein beta-1,4-N-acetylglucosaminyltransferase, isozyme C; limited gene information but mice lacking N-acetylglucosaminyltransferase I die mid-gestation and embryos are developmentally retarded, most noticeably in neural tissue (PMID |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | 8290590) | 8290590) |
| MGC21881 | exonic | 389741 | No gene information | uncharacterized locus MGC21881 (MGC21881) |
| MIR1910 | exonic | 100302261 | No gene information | No gene information |
| MIR3123 | exonic | 100422856 | No gene information | No gene information |
| MIR548H4 | exonic | 100313884 | No gene information | No gene information |
| MIR548T | intronic | 100422849 | No gene information | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
|---|---|---|---|---|
| | | | | miRBase. Some sequence at the 5' and 3' ends may not be included in the intermediate precursor miRNA produced by Drosha cleavage. |
| MIR5694 | exonic | 100847064 | No gene information | No gene information |
| MIR650 | exonic | 723778 | No gene information | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| MLL3 | both | 585 | myeloid/lymphoid or mixed-lineage | myeloid/lymphoid or mixed-lineage |

| Figure 10C |||||
|---|---|---|---|---|
| RefSeq Gene Symbol | CNV Gene Region | NCBI Gene ID | Gene Biology Curation | Gene Annotation |
| | | 08 | leukemia 3; limited gene information | leukemia 3; limited gene information |
| MNX1 | exonic | 3110 | Gene alias is HLXB9 and it causes Currarino syndrome (also Currarino triad) is an inherited congenital disorder where the sacrum is not formed properly; also motor neuron link, see PMIDs 21593306 and 17715199 | Gene alias is HLXB9 and it causes Currarino syndrome (also Currarino triad) is an inherited congenital disorder where the sacrum is not formed properly; also motor neuron link, see PMIDs 21593306 and 17715199 |
| MOB3B | intronic | 79817 | Mps One Binder kinase activator-like 2B; RefSeq description: The protein encoded by this gene shares similarity with the yeast Mob1 protein. Yeast Mob1 binds Mps1p, a protein kinase essential for spindle pole body duplication and mitotic checkpoint regulation. This gene is located on the opposite strand as the interferon kappa precursor (IFNK) gene. | Mps One Binder kinase activator-like 2B; RefSeq description: The protein encoded by this gene shares similarity with the yeast Mob1 protein. Yeast Mob1 binds Mps1p, a protein kinase essential for spindle pole body duplication and mitotic checkpoint regulation. This gene is located on the opposite strand as the interferon kappa precursor (IFNK) gene. |
| MOGAT3 | exonic | 346606 | Gene alias is MGAT3; see mouse model (PMID 11986323): Truncated, inactive N-acetylglucosaminyltransferase III (GlcNAc-TIII) induces neurological and other traits absent in mice that lack GlcNAc-TIII, abstract: "Mgat3(T37/T37) homozygotes in a mixed or 129(SvJ) background were retarded in growth rate and exhibited an altered leg clasp reflex, an altered gait, and defective nursing behavior" | Gene alias is MGAT3; see mouse model (PMID 11986323): Truncated, inactive N-acetylglucosaminyltransferase III (GlcNAc-TIII) induces neurological and other traits absent in mice that lack GlcNAc-TIII, abstract: "Mgat3(T37/T37) homozygotes in a mixed or 129(SvJ) background were retarded in growth rate and exhibited an altered leg clasp reflex, an altered gait, and defective nursing behavior" |
| MTHFD1L | both | 25902 | The protein encoded by this gene is involved in the synthesis of tetrahydrofolate (THF) in the mitochondrion. THF is important in the de novo synthesis of purines and thymidylate and in the regeneration of methionine from homocysteine. Several transcript variants encoding different isoforms have been found for this gene. | The protein encoded by this gene is involved in the synthesis of tetrahydrofolate (THF) in the mitochondrion. THF is important in the de novo synthesis of purines and thymidylate and in the regeneration of methionine from homocysteine. Several transcript variants encoding different isoforms have been found for this gene. |
| MTUS1 | exonic | 57509 | This gene encodes a protein which contains a C-terminal domain able to interact with the angiotension II | This gene encodes a protein which contains a C-terminal domain able to interact with the angiotension II (AT2) |

Figure 10C (Continued)

| Figure 10C ||||||
|---|---|---|---|---|
| RefSeq Gene Symbol | CNV Gene Region | NCBI Gene ID | Gene Biology Curation | Gene Annotation |
| | | | (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and partcipates in AT2 signaling pathways. Other variants may encode nuclear or transmembrane proteins but it has not been determined whether they also participate in AT2 signaling pathways. | receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and partcipates in AT2 signaling pathways. Other variants may encode nuclear or transmembrane proteins but it has not been determined whether they also participate in AT2 signaling pathways. |
| MYO3B | intronic | 140469 | myosin IIIB, limited gene information | myosin IIIB, limited gene information |
| NDUFA4L2 | exonic | 56901 | Aceview lists PARK2 as putative partner | Aceview lists PARK2 as putative partner |
| NFIC | intronic | 4782 | nuclear factor I/C (CCAAT-binding transcription factor); OMIM 600729 | nuclear factor I/C (CCAAT-binding transcription factor); OMIM 600729 |
| NFKB1 | exonic | 4790 | Previous study (PMID 12203044) did not find mutations in gene in PD cases, see also PMID 20977677 ("Indeed, √é¬±-synuclein significantly reduces nuclear factor kappa B activation, which is completely quenched by dopamine treatment") AND there are several other relevant PMIDS as PubMed search "nuclear factor NF-kappa-B AND parkinson's" lists 71 refs | Previous study (PMID 12203044) did not find mutations in gene in PD cases, see also PMID 20977677 ("Indeed, √é¬±-synuclein significantly reduces nuclear factor kappa B activation, which is completely quenched by dopamine treatment") AND there are several other relevant PMIDS as PubMed search "nuclear factor NF-kappa-B AND parkinson's" lists 71 refs |
| NKAIN3 | intronic | 286183 | No gene information | Na+/K+ transporting ATPase interacting 3; limited gene information; expressed in testis and brain only, see OMIM 612872; via AceView InterPro: NKAIN (Na,K-Atpase INteracting) proteins are a family of evolutionary conserved transmembrane proteins that localise to neurons, that are critical for neuronal function, and that interact with the beta subunits, beta1 in vertebrates and beta in Drosophila, of Na,K- |

| RefSeq Gene Symbol | CNV Gene Region | NCBI Gene ID | Gene Biology Curation | Gene Annotation |
|---|---|---|---|---|
| | | | | ATPase. NKAINs have highly conserved trans-membrane domains but otherwise no other characterised domains. NKAINs may function as subunits of pore or channel structures in neurons or they may affect the function of other membrane proteins. They are likely to function within the membrane bilayer |
| NLGN1 | intronic | 22871 | Neurological function, such as PMID 21056983: N-cadherin and neuroligins cooperate to regulate synapse formation in hippocampal cultures. | Neurological function, such as PMID 21056983: N-cadherin and neuroligins cooperate to regulate synapse formation in hippocampal cultures. |
| NLRP4 | exonic | 147945 | NLRP7 also nearby; neurological and PD link, see PMID 21209283 for NLRP4 and beclin1 link: NLRP4 negatively regulates autophagic processes through an association with beclin1; PD link via beclin1, PMID 20057503: The Parkinson-associated protein PINK1 interacts with Beclin1 and promotes autophagy (also PMID 21672589) | NLRP7 also nearby; neurological and PD link, see PMID 21209283 for NLRP4 and beclin1 link: NLRP4 negatively regulates autophagic processes through an association with beclin1; PD link via beclin1, PMID 20057503: The Parkinson-associated protein PINK1 interacts with Beclin1 and promotes autophagy (also PMID 21672589) |
| NLRP7 | exonic | 199713 | NLRP4 also nearby; OMIM 609661, role in hydatidiform moles | NLRP4 also nearby; OMIM 609661, role in hydatidiform moles |
| NRG1 | intronic | 3084 | Intron CNV but is a longer transcript variant, see NM_013962.2; The protein encoded by this gene was originally identified as a 44-kD glycoprotein that interacts with the NEU/ERBB2 receptor tyrosine kinase to increase its phosphorylation on tyrosine residues; link to PD and AD see PMID 21517849, Systemic administration of neuregulin-1√é¯≤(1) protects dopaminergic neurons in a mouse model of Parkinson's disease | Intron CNV but is a longer transcript variant, see NM_013962.2; The protein encoded by this gene was originally identified as a 44-kD glycoprotein that interacts with the NEU/ERBB2 receptor tyrosine kinase to increase its phosphorylation on tyrosine residues; link to PD and AD see PMID 21517849, Systemic administration of neuregulin-1√é¯≤(1) protects dopaminergic neurons in a mouse model of Parkinson's disease |
| NRG3 | intronic | 10718 | neuregulin 3; schizophrenia, bipolar disorder, ADHD links; schizophrenia and nicotine link (PMID 18784291) | neuregulin 3; schizophrenia, bipolar disorder, ADHD links; schizophrenia and nicotine link (PMID 18784291) |
| NRXN | intro | 936 | AD link, see PMID 21084300: | AD link, see PMID 21084300: |

Figure 10C (Continued)

| \multicolumn{5}{c|}{Figure 10C} | | | | |
|---|---|---|---|---|
| RefSeq Gene Symbol | CNV Gene Region | NCBI Gene ID | Gene Biology Curation | Gene Annotation |
| 3 | nic | 9 | Processing of the synaptic cell adhesion molecule neurexin-3beta by Alzheimer disease alpha- and gamma-secretases | Processing of the synaptic cell adhesion molecule neurexin-3beta by Alzheimer disease alpha- and gamma-secretases |
| NSL1 | exonic | 25936 | Centromere function, see PMID 20231385: Inner centromere formation requires hMis14, a trident kinetochore protein that specifically recruits HP1 to human chromosomes | Centromere function, see PMID 20231385: Inner centromere formation requires hMis14, a trident kinetochore protein that specifically recruits HP1 to human chromosomes |
| NTF3 | both | 4908 | 42 PubMed refs for "neurotrophin-3 AND Parkinson's", such as PMID 20698822, Monoamine oxidase inhibitors as neuroprotective agents in age-dependent neurodegenerative disorders; see also http://en.wikipedia.org/wiki/Neurotrophin: "Neurotrophin-3, or NT-3, is a neurotrophic factor, in the NGF-family of neurotrophins. It is a protein growth factor that has activity on certain neurons of the peripheral and central nervous system; it helps to support the survival and differentiation of existing neurons, and encourages the growth and differentiation of new neurons and synapses. NT-3 is the third neurotrophic factor to be characterized, after NGF and BDNF. NT-3 is unique among the neurotrophins in the number of neurons it has potential to stimulate, given its ability to activate two of the receptor tyrosine kinase neurotrophin receptors (TrkC and TrkB). Mice born without the ability to make NT-3 have loss of proprioceptive and subsets of mechanoreceptive sensory neurons." | 42 PubMed refs for "neurotrophin-3 AND Parkinson's", such as PMID 20698822, Monoamine oxidase inhibitors as neuroprotective agents in age-dependent neurodegenerative disorders; see also http://en.wikipedia.org/wiki/Neurotrophin: "Neurotrophin-3, or NT-3, is a neurotrophic factor, in the NGF-family of neurotrophins. It is a protein growth factor that has activity on certain neurons of the peripheral and central nervous system; it helps to support the survival and differentiation of existing neurons, and encourages the growth and differentiation of new neurons and synapses. NT-3 is the third neurotrophic factor to be characterized, after NGF and BDNF. NT-3 is unique among the neurotrophins in the number of neurons it has potential to stimulate, given its ability to activate two of the receptor tyrosine kinase neurotrophin receptors (TrkC and TrkB). Mice born without the ability to make NT-3 have loss of proprioceptive and subsets of mechanoreceptive sensory neurons." |
| NTF4 | exonic | 4909 | 10 PubMed refs for "neurotrophin-4 AND Parkinson's" such as PMID 7908342: Neurotrophin-4/5 is a survival factor for embryonic | 10 PubMed refs for "neurotrophin-4 AND Parkinson's" such as PMID 7908342: Neurotrophin-4/5 is a survival factor for embryonic midbrain |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | midbrain dopaminergic neurons in enriched cultures and PMID 19789989 (Liquiritin is a traditional Chinese medicine): Liquiritin potentiate neurite outgrowth induced by nerve growth factor in PC12 cells.; see also http://en.wikipedia.org/wiki/Neurotrophin: Neurotrophin-4 (NT-4) is a neurotrophic factor that signals predominantly through the TrkB receptor tyrosine kinase. It is also known as NT4, NT5, NTF4, and NT-4/5; also from RefSeq gene descr.: While knock-outs of other neurotrophins including nerve growth factor, brain-derived neurotrophic factor, and neurotrophin 3 prove lethal during early postnatal development, NTF5-deficient mice only show minor cellular deficits and develop normally to adulthood. | dopaminergic neurons in enriched cultures and PMID 19789989 (Liquiritin is a traditional Chinese medicine): Liquiritin potentiate neurite outgrowth induced by nerve growth factor in PC12 cells.; see also http://en.wikipedia.org/wiki/Neurotrophin: Neurotrophin-4 (NT-4) is a neurotrophic factor that signals predominantly through the TrkB receptor tyrosine kinase. It is also known as NT4, NT5, NTF4, and NT-4/5; also from RefSeq gene descr.: While knock-outs of other neurotrophins including nerve growth factor, brain-derived neurotrophic factor, and neurotrophin 3 prove lethal during early postnatal development, NTF5-deficient mice only show minor cellular deficits and develop normally to adulthood. |
| NXPH4 | exonic | 11247 | Neurological link (PMID 9856994); NXPHs are neuropeptides that bind to NRXNs; see NXPH4 in patent appl: http://www.faqs.org/patents/app/20090131265 | Neurological link (PMID 9856994); NXPHs are neuropeptides that bind to NRXNs; see NXPH4 in patent appl: http://www.faqs.org/patents/app/20090131265 |
| PAK2 | exonic | 5062 | PAK2 linked to PD via LRRK2 (see PMIDs 21454543, 17883396, 17314138, 19103160) | PAK2 linked to PD via LRRK2 (see PMIDs 21454543, 17883396, 17314138, 19103160) |
| PARVB | exonic | 29780 | possible neurological/PD link via other genes, see PMID 12499396: Interaction of alphaPIX (ARHGEF6) with beta-parvin (PARVB) suggests an involvement of alphaPIX in integrin-mediated signaling; also link between PARVB and ILK, which is linked to GSK-3B, a PD Rx target (e.g., see PMIDs 15467740, 17182785, 17490631) | possible neurological/PD link via other genes, see PMID 12499396: Interaction of alphaPIX (ARHGEF6) with beta-parvin (PARVB) suggests an involvement of alphaPIX in integrin-mediated signaling; also link between PARVB and ILK, which is linked to GSK-3B, a PD Rx target (e.g., see PMIDs 15467740, 17182785, 17490631) |
| PCBD2 | intronic | 84105 | pterin-4 alpha-carbinolamine dehydratase/dimerization cofactor of hepatocyte nuclear factor 1 alpha | pterin-4 alpha-carbinolamine dehydratase/dimerization cofactor of hepatocyte nuclear factor 1 alpha |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
|---|---|---|---|---|
| | | | (TCF1) 2; limited gene information, OMIM 609836 | (TCF1) 2; limited gene information, OMIM 609836 |
| PCDHA1 | exonic | 56147 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA10 | exonic | 56139 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA2 | exonic | 56146 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA3 | exonic | 56145 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA4 | exonic | 56144 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA5 | exonic | 56143 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA6 | exonic | 56142 | protocadherin alpha genes overlap; neuro function, PMID 19625505: Protocadherin-alpha family is required for serotonergic projections to appropriately innervate target brain | protocadherin alpha genes overlap; neuro function, PMID 19625505: Protocadherin-alpha family is required for serotonergic projections to appropriately innervate target brain |

| RefSeq Gene Symbol | CNV Gene Region | NCBI Gene ID | Gene Biology Curation | Gene Annotation |
|---|---|---|---|---|
| | | | areas | areas |
| PCDHA7 | exonic | 56141 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA8 | exonic | 56140 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCDHA9 | exonic | 9752 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| PCM1 | exonic | 5108 | Downregulation of PCM1 affects axon formation (PMID 20685982), also has schizophrenia link | Downregulation of PCM1 affects axon formation (PMID 20685982), also has schizophrenia link |
| PHACTR2 | intronic | 9749 | phosphatase and actin regulator 2; PHACTR2 was identified in PD GWAS (rs11155313, OR=~1.3), see PMID 19429005: Phactr2 and Parkinson's disease | phosphatase and actin regulator 2; PHACTR2 was identified in PD GWAS (rs11155313, OR=~1.3), see PMID 19429005: Phactr2 and Parkinson's disease |
| PIGZ | exonic | 80235 | AD link between PIGZ and QPRT (involved in kynurenine pathway, see PMID 21687761, which is linked to PD), see PMID 21054826: Viable mouse gene ablations that robustly alter brain A√é¬≤ levels are rare | AD link between PIGZ and QPRT (involved in kynurenine pathway, see PMID 21687761, which is linked to PD), see PMID 21054826: Viable mouse gene ablations that robustly alter brain A√é¬≤ levels are rare |
| PITPNC1 | intronic | 26207 | This gene encodes a member of the phosphatidylinositol transfer protein family. The encoded cytoplasmic protein transfers phosphatidylinositol from one membrane compartment to another; see also PMID 21728994 | This gene encodes a member of the phosphatidylinositol transfer protein family. The encoded cytoplasmic protein transfers phosphatidylinositol from one membrane compartment to another; see also PMID 21728994 |
| PITPNM3 | exonic | 83394 | Causes autosomal dominant cone dystrophy (OMIM 608921) | Causes autosomal dominant cone dystrophy (OMIM 608921) |
| PKD1L3 | exonic | 342372 | Gene function linked to taste, and both taste and smell are sometimes | Gene function linked to taste, and both taste and smell are sometimes impaired |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
|---|---|---|---|---|
| | | | impaired in PD patients (51 PubMed refs for "taste AND parkinson's", e.g., see PMIDs 21193922, 20736182, 18606556 | in PD patients (51 PubMed refs for "taste AND parkinson's", e.g., see PMIDs 21193922, 20736182, 18606556 |
| PLCL1 | both | 5334 | PMID 19996098: Phospholipase C-related but catalytically inactive protein is required for insulin-induced cell surface expression of gamma-aminobutyric acid type A receptors.; which is also identified as molecular marker in gene expression PD patent (http://www.faqs.org/patents/app/20100221735) | PMID 19996098: Phospholipase C-related but catalytically inactive protein is required for insulin-induced cell surface expression of gamma-aminobutyric acid type A receptors.; which is also identified as molecular marker in gene expression PD patent (http://www.faqs.org/patents/app/20100221735) |
| PLD1 | intronic | 5337 | PD link, see PMID 9538008: Regulation of phospholipase D2: selective inhibition of mammalian phospholipase D isoenzymes by alpha- and beta-synucleins. | PD link, see PMID 9538008: Regulation of phospholipase D2: selective inhibition of mammalian phospholipase D isoenzymes by alpha- and beta-synucleins. |
| PLOD3 | exonic | 8985 | The protein encoded by this gene is a membrane-bound homodimeric enzyme that is localized to the cisternae of the rough endoplasmic reticulum. The enzyme (cofactors iron and ascorbate) catalyzes the hydroxylation of lysyl residues in collagen-like peptides. The resultant hydroxylysyl groups are attachment sites for carbohydrates in collagen and thus are critical for the stability of intermolecular crosslinks. Some patients with Ehlers-Danlos syndrome type VIB have deficiencies in lysyl hydroxylase activity. | The protein encoded by this gene is a membrane-bound homodimeric enzyme that is localized to the cisternae of the rough endoplasmic reticulum. The enzyme (cofactors iron and ascorbate) catalyzes the hydroxylation of lysyl residues in collagen-like peptides. The resultant hydroxylysyl groups are attachment sites for carbohydrates in collagen and thus are critical for the stability of intermolecular crosslinks. Some patients with Ehlers-Danlos syndrome type VIB have deficiencies in lysyl hydroxylase activity. |
| POLR3A | exonic | 11128 | The protein encoded by this gene is the catalytic component of RNA polymerase III, which synthesizes small RNAs. The encoded protein also acts as a sensor to detect foreign DNA and trigger an innate immune response. | The protein encoded by this gene is the catalytic component of RNA polymerase III, which synthesizes small RNAs. The encoded protein also acts as a sensor to detect foreign DNA and trigger an innate immune response. |
| POM121LIP | exonic | 25812 | No gene information | This locus appears to be a pseudogene related to DKFZp434K191, which is of unknown function. This pseudogene |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | | lies in the immunoglobulin lambda gene cluster on chromosome 22q11.21. [provided by RefSeq, Jul 2008]. Sequence Note: The RefSeq transcript was derived from genomic sequence to make the sequence consistent with the reference genome assembly. The genomic coordinates used for the transcript record were based on alignments. |
| PPIL4 | exonic | 85313 | Gene is peptidylprolyl isomerase (cyclophilin)-like 4 and little known about it, but PMID 11978968 abstract states: The cyclophilins are members of a highly conserved, ubiquitous family, and play an important role in protein folding, immunosuppression by cyclosporin A (CsA), and infection of HIV-1 virions; in general searches 7 refs for PubMed search '"peptidylprolyl isomerase" AND parkinson's', such as PMID 16365047: Prolyl-isomerase Pin1 accumulates in lewy bodies of parkinson disease and facilitates formation of alpha-synuclein inclusions; also, 28 refs for PubMed search "FK506-binding protein AND Parkinson's" such as PMID 21652707: Comparative Analysis of Different Peptidyl-Prolyl Isomerases Reveals FK506-binding Protein 12 as the Most Potent Enhancer of {alpha}-Synuclein Aggregation; PMID 21553017: Unraveling the role of peptidyl-prolyl isomerases in neurodegeneration | Gene is peptidylprolyl isomerase (cyclophilin)-like 4 and little known about it, but PMID 11978968 abstract states: The cyclophilins are members of a highly conserved, ubiquitous family, and play an important role in protein folding, immunosuppression by cyclosporin A (CsA), and infection of HIV-1 virions; in general searches 7 refs for PubMed search '"peptidylprolyl isomerase" AND parkinson's', such as PMID 16365047: Prolyl-isomerase Pin1 accumulates in lewy bodies of parkinson disease and facilitates formation of alpha-synuclein inclusions; also, 28 refs for PubMed search "FK506-binding protein AND Parkinson's" such as PMID 21652707: Comparative Analysis of Different Peptidyl-Prolyl Isomerases Reveals FK506-binding Protein 12 as the Most Potent Enhancer of {alpha}-Synuclein Aggregation; PMID 21553017: Unraveling the role of peptidyl-prolyl isomerases in neurodegeneration |
| PRAME | exonic | 23532 | melanoma antigen preferentially expressed in tumors | This gene encodes an antigen that is predominantly expressed in human melanomas and that is recognized by cytolytic T lymphocytes. It is not expressed in normal tissues, except testis. This expression pattern is similar |

Figure 10C (Continued)

| \multicolumn{5}{c}{Figure 10C} | | | | |
|---|---|---|---|---|
| RefSeq Gene Symbol | CNV Gene Region | NCBI Gene ID | Gene Biology Curation | Gene Annotation |
| | | | | to that of other CT antigens, such as MAGE, BAGE and GAGE. However, unlike these other CT antigens, this gene is also expressed in acute leukemias. Five alternatively spliced transcript variants encoding the same protein have been observed for this gene. [provided by RefSeq, Jul 2008]. Transcript Variant: This variant (1) lacks a segment in the 5' UTR compared to the longest variant (2). Both variants encode the same protein. Publication Note: This RefSeq record includes a subset of the publications that are available for this gene. Please see the Gene record to access additional publications. ##RefSeq-Attributes-START## Transcript_exon_combination_evidence :: U65011.1 [ECO:0000332] ##RefSeq-Attributes-END## |
| PREPL | exonic | 9581 | PREPL (OMIM 609557) causes hyptonia-cystinuria syndrome (OMIM 606407) involving SLCA1 and/or PREPL; see also PMIDS 16385448, 17579669, 18234729, 18781961, 21686663, 21222627; see PMID 21692504 for potential as drug target | PREPL (OMIM 609557) causes hyptonia-cystinuria syndrome (OMIM 606407) involving SLCA1 and/or PREPL; see also PMIDS 16385448, 17579669, 18234729, 18781961, 21686663, 21222627; see PMID 21692504 for potential as drug target |
| PROSC | exonic | 11212 | Gene is proline synthetase co-transcribed homolog (bacterial) and no info on function but CNV found in 2 of 87 PD cases and 0 of 1005 Normals | Gene is proline synthetase co-transcribed homolog (bacterial) and no info on function but CNV found in 2 of 87 PD cases and 0 of 1005 Normals |
| PRTN3 | exonic | 5657 | proteinase 3 (OMIM 177020) | proteinase 3 (OMIM 177020) |
| PSD3 | intronic | 23362 | Gene aliases EFA6R and HCA67; pleckstrin and Sec7 domain containing 3; cancer link, limited gene information | Gene aliases EFA6R and HCA67; pleckstrin and Sec7 domain containing 3; cancer link, limited gene information |
| PTP4A3 | exonic | 11156 | The protein encoded by this gene belongs to a small class of prenylated protein tyrosine phosphatases (PTPs). | The protein encoded by this gene belongs to a small class of prenylated protein tyrosine phosphatases (PTPs). |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| PTPRA | exonic | 5786 | PTPs are cell signaling molecules that play regulatory roles in a variety of cellular processes. This class of PTPs contain a PTP domain and a characteristic C-terminal prenylation motif. Studies of this class of PTPs in mice demonstrated that they were prenylated proteins in vivo, which suggested their association with cell plasma membrane. Overexpression of this gene in mammalian cells was reported to inhibit angiotensin-II induced cell calcium mobilization and promote cell growth. Two alternatively spliced variants exist. | PTPs are cell signaling molecules that play regulatory roles in a variety of cellular processes. This class of PTPs contain a PTP domain and a characteristic C-terminal prenylation motif. Studies of this class of PTPs in mice demonstrated that they were prenylated proteins in vivo, which suggested their association with cell plasma membrane. Overexpression of this gene in mammalian cells was reported to inhibit angiotensin-II induced cell calcium mobilization and promote cell growth. Two alternatively spliced variants exist. |
| PTPRA | exonic | 5786 | PD link and neurological link, see PMID 7691597: Receptor protein tyrosine phosphatase alpha activates pp60c-src and is involved in neuronal differentiation; abstract indicates functional role of pp60c-src (SRC) and SRC is linked to PD (20 PubMed citations for 'SRC AND Parkinson's") | PD link and neurological link, see PMID 7691597: Receptor protein tyrosine phosphatase alpha activates pp60c-src and is involved in neuronal differentiation; abstract indicates functional role of pp60c-src (SRC) and SRC is linked to PD (20 PubMed citations for 'SRC AND Parkinson's") |
| PTPRC | exonic | 5788 | OMIM 151460; PD link for beta and zeta versions of receptor (PMIDs 21375485, 19548869, 17368428), see also PMID 12435803 | OMIM 151460; PD link for beta and zeta versions of receptor (PMIDs 21375485, 19548869, 17368428), see also PMID 12435803 |
| PTPRD | intronic | 5789 | Studies of the similar genes in chicken and fly suggest the role of this PTP is in promoting neurite growth, and regulating neurons axon guidance; neurological role in mouse model (OMIM 601598) | Studies of the similar genes in chicken and fly suggest the role of this PTP is in promoting neurite growth, and regulating neurons axon guidance; neurological role in mouse model (OMIM 601598) |
| PTPRO | both | 5800 | OMIM 600579 indicates its role in kidney disease, see also PMID 21722858: Disruption of PTPRO Causes Childhood-Onset Nephrotic Syndrome; neurological/PD link unknown but occurs in 2-3 PD cases and 0 in 1005 Normals | OMIM 600579 indicates its role in kidney disease, see also PMID 21722858: Disruption of PTPRO Causes Childhood-Onset Nephrotic Syndrome; neurological/PD link unknown but occurs in 2-3 PD cases and 0 in 1005 Normals |
| PUF60 | exonic | 22827 | Protein encoded by this gene is a Ro RNP-binding protein. It interacts with Ro RNPs and their interaction is | Protein encoded by this gene is a Ro RNP-binding protein. It interacts with Ro RNPs and their interaction is |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| | | | thought to represent a gain of function for Ro RNPs. This protein also forms a ternary complex with far upstream element (FUSE) and FUSE-binding protein; limited gene information; splicing factor (PMID 18974054) | thought to represent a gain of function for Ro RNPs. This protein also forms a ternary complex with far upstream element (FUSE) and FUSE-binding protein; limited gene information; splicing factor (PMID 18974054) |
| RALYL | both | 138046 | RALY RNA binding protein-like, implicated via yeast 2-hybrid screen as binding partner of LRRK2, see PMID 19001729: Screening of LRRK2 interactants by yeast 2-hybrid analysis | RALY RNA binding protein-like, implicated via yeast 2-hybrid screen as binding partner of LRRK2, see PMID 19001729: Screening of LRRK2 interactants by yeast 2-hybrid analysis |
| RASA3 | exonic | 22821 | RAS p21 protein activator 3 and is a GAP1 family member; MAPK link (PMID 18952607) | RAS p21 protein activator 3 and is a GAP1 family member; MAPK link (PMID 18952607) |
| RASSF3 | intronic | 283349 | Ras association (RalGDS/AF-6) domain family member 3; cancer link (OMIM 607019) | Ras association (RalGDS/AF-6) domain family member 3; cancer link (OMIM 607019) |
| RBFOX1 | intronic | 54715 | Several neurological links, such as PMID 21623373; Ataxin-2 binding protein 1 has an RNP motif that is highly conserved among RNA-binding proteins. This protein binds to the C-terminus of ataxin-2 and may contribute to the restricted pathology of spinocerebellar ataxia type 2 (SCA2). PD-specific CNVs also found in CAMTA1 (Regulated by RBFOX1 in mouse, see PMID 21623373) | Several neurological links, such as PMID 21623373; Ataxin-2 binding protein 1 has an RNP motif that is highly conserved among RNA-binding proteins. This protein binds to the C-terminus of ataxin-2 and may contribute to the restricted pathology of spinocerebellar ataxia type 2 (SCA2). PD-specific CNVs also found in CAMTA1 (Regulated by RBFOX1 in mouse, see PMID 21623373) |
| RBM25 | intronic | 58517 | RNA binding motif protein 25; splicing cofactor (PMID 18663000) | RNA binding motif protein 25; splicing cofactor (PMID 18663000) |
| RBM27 | both | 54439 | RNA binding motif protein 27; limited gene information | RNA binding motif protein 27; limited gene information |
| RELL1 | exonic | 768211 | Limited gene info; RELT-like 1 (OMIM 611212); role in oxidative stress, see PMID 16389068: Identification of RELT homologues that associate with RELT and are phosphorylated by OSR1. | Limited gene info; RELT-like 1 (OMIM 611212); role in oxidative stress, see PMID 16389068: Identification of RELT homologues that associate with RELT and are phosphorylated by OSR1. |
| RGS6 | intronic | 9628 | PMID 12140291: RGS6 interacts with SCG10 and promotes neuronal differentiation. Role of the G gamma | PMID 12140291: RGS6 interacts with SCG10 and promotes neuronal differentiation. Role of the G gamma |

| RefSeq Gene Symbol | CNV Gene Region | NCBI Gene ID | Gene Biology Curation | Gene Annotation |
|---|---|---|---|---|
| | | | subunit-like (GGL) domain of RGS6; PD-specific CNVs in RGS7 | subunit-like (GGL) domain of RGS6; PD-specific CNVs in RGS7 |
| RGS7 | exonic | 6000 | RGS7 has neurological links and MIR3123 overlap this gene; see also GPR20 entry (PMID 21343290: Gi/o signaling and the palmitoyltransferase DHHC2 regulate palmitate cycling and shuttling of RGS7 family-binding protein); 2 PubMed refs for "regulator of G-protein signaling 7 AND Parkinson's": RGS9 direct PD link, PMID 15728856:D2 dopamine receptors colocalize regulator of G-protein signaling 9-2 (RGS9-2) via the RGS9 DEP domain, and RGS9 knock-out mice develop dyskinesias associated with dopamine pathways and PMID 21323908: Cannabinoid receptor signalling in neurodegenerative diseases: a potential role for membrane fluidity disturbance; PD-specific CNVs in RGS6 | RGS7 has neurological links and MIR3123 overlap this gene; see also GPR20 entry (PMID 21343290: Gi/o signaling and the palmitoyltransferase DHHC2 regulate palmitate cycling and shuttling of RGS7 family-binding protein); 2 PubMed refs for "regulator of G-protein signaling 7 AND Parkinson's": RGS9 direct PD link, PMID 15728856:D2 dopamine receptors colocalize regulator of G-protein signaling 9-2 (RGS9-2) via the RGS9 DEP domain, and RGS9 knock-out mice develop dyskinesias associated with dopamine pathways and PMID 21323908: Cannabinoid receptor signalling in neurodegenerative diseases: a potential role for membrane fluidity disturbance; PD-specific CNVs in RGS6 |
| RIMS1 | intronic | 22999 | regulating synaptic membrane exocytosis 1; Aceview summary: "The protein encoded by this gene is a RAS gene superfamily member that regulates synaptic vesicle exocytosis. The encoded protein may be part of the protein scaffold of the cell. Defects in this gene are a cause of cone-rod dystrophy type 7 (CORD7)"; see also review PMID 21922075: Pushing synaptic vesicles over the RIM; RIMS2 also impacted by CNV-specific CNVs; a PD-specific intronic CNV in 1 PD case has also been found in RIMS2 | regulating synaptic membrane exocytosis 1; Aceview summary: "The protein encoded by this gene is a RAS gene superfamily member that regulates synaptic vesicle exocytosis. The encoded protein may be part of the protein scaffold of the cell. Defects in this gene are a cause of cone-rod dystrophy type 7 (CORD7)"; see also review PMID 21922075: Pushing synaptic vesicles over the RIM; RIMS2 also impacted by CNV-specific CNVs; a PD-specific intronic CNV in 1 PD case has also been found in RIMS2 |
| RNF130 | exonic | 55819 | Protein product for RNF130 is E3 ubiquitin-protein ligase RNF130 precursor, which may be analogous to Parkin (PARK2) via its classification as RBR family member (see review | Protein product for RNF130 is E3 ubiquitin-protein ligase RNF130 precursor, which may be analogous to Parkin (PARK2) via its classification as RBR family member (see review PMID |

Figure 10C (Continued)

| Figure 10C | | | | |
|---|---|---|---|---|
| RefSeq Gene Symbol | CNV Gene Region | NCBI Gene ID | Gene Biology Curation | Gene Annotation |
| | | | PMID 15152079) | 15152079) |
| RNF144B | both | 255488 | Gene aliases are bA528A10.3;IBRDC2;KIAA0161;MGC71786;p53RFP; PIR2; other RNFs in this list and see review on RBR family (PMID 15152079); PMID 20300062 links RNF144B to BAX and BAX linked to PD, see PMID 14596892: BAX protein-immunoreactivity in midbrain neurons of Parkinson's disease patients | Gene aliases are bA528A10.3;IBRDC2;KIAA0161;MGC71786;p53RFP; PIR2; other RNFs in this list and see review on RBR family (PMID 15152079); PMID 20300062 links RNF144B to BAX and BAX linked to PD, see PMID 14596892: BAX protein-immunoreactivity in midbrain neurons of Parkinson's disease patients |
| RNF217 | exonic | 154214 | Other family members (RNF144B and RNF4) have CNVs detected in PD cases only; AceView indicates it contains IBR protein domain, which is found in: ANKIB1, ARIH1, ARIH2, CUL9, FBXO43, PARK2, RNF14, RNF19A, RNF19B, RNF144A, RNF144B, RNF217 | Other family members (RNF144B and RNF4) have CNVs detected in PD cases only; AceView indicates it contains IBR protein domain, which is found in: ANKIB1, ARIH1, ARIH2, CUL9, FBXO43, PARK2, RNF14, RNF19A, RNF19B, RNF144A, RNF144B, RNF217 |
| RNF4 | exonic | 6047 | OMIM 602850, indicates RNF4 is a SUMO-specific E3 ubiquitin ligase; PMID 20696907 abstract also indicates that RNF4 "may serve as a direct link between epigenetic DNA demethylation and DNA repair in mammalian cells" | OMIM 602850, indicates RNF4 is a SUMO-specific E3 ubiquitin ligase; PMID 20696907 abstract also indicates that RNF4 "may serve as a direct link between epigenetic DNA demethylation and DNA repair in mammalian cells" |
| RNPC3 | exonic | 55599 | Aceview lists this complex region as a single gene (RNPC3andAMY2B); RNA-binding region (RNP1, RRM) containing 3 | Aceview lists this complex region as a single gene (RNPC3andAMY2B); RNA-binding region (RNP1, RRM) containing 3 |
| ROCK1 | exonic | 6093 | Amyloid link, see PMID 14615541: Zhou et al. (2003) concluded that the Rho-Rock pathway may regulate amyloid precursor protein processing, and a subset of NSAIDs can reduce A-beta(42) through inhibition of Rho activity; see SGK1, which has CNV occuring in 7 of 87 PD cases and 0 of 1005 Normals, ROCK1 shows up in same therapeutics patents directed at kinases | Amyloid link, see PMID 14615541: Zhou et al. (2003) concluded that the Rho-Rock pathway may regulate amyloid precursor protein processing, and a subset of NSAIDs can reduce A-beta(42) through inhibition of Rho activity; see SGK1, which has CNV occuring in 7 of 87 PD cases and 0 of 1005 Normals, ROCK1 shows up in same therapeutics patents directed at kinases |

Figure 10C (Continued)

| | | | Figure 10C | |
|---|---|---|---|---|
| RefSeq Gene Symbol | CNV Gene Region | NCBI Gene ID | Gene Biology Curation | Gene Annotation |
| RORA | intronic | 6095 | RAR-related orphan receptor A; limited gene information, but see OMIM (600825) indicates RORA maps to locus in mouse 'staggerer' mouse model(PMID 13912552), which has phenotype: 'The "staggerer" mutant is recognized by its staggering gait, mild tremor, hypotonia, and small size. Symptoms develop during postnatal weeks 1 to 4 and remain stationary thereafter. The cerebellar cortex is grossly underdeveloped, with too few granule cells and unaligned Purkinje cells.' | RAR-related orphan receptor A; limited gene information, but see OMIM (600825) indicates RORA maps to locus in mouse 'staggerer' mouse model(PMID 13912552), which has phenotype: 'The "staggerer" mutant is recognized by its staggering gait, mild tremor, hypotonia, and small size. Symptoms develop during postnatal weeks 1 to 4 and remain stationary thereafter. The cerebellar cortex is grossly underdeveloped, with too few granule cells and unaligned Purkinje cells.' |
| RPL35A | exonic | 6165 | ribosomal protein L35a, limited gene information but see PMID 20378560, Mutations in the ribosomal protein genes in Japanese patients with Diamond-Blackfan anemia; OMIM 612528 | ribosomal protein L35a, limited gene information but see PMID 20378560, Mutations in the ribosomal protein genes in Japanese patients with Diamond-Blackfan anemia; OMIM 612528 |
| RPS24 | exonic | 6229 | This gene encodes a ribosomal protein that is a component of the 40S subunit. The protein belongs to the S24E family of ribosomal proteins. It is located in the cytoplasm. Multiple transcript variants encoding different isoforms have been found for this gene. As is typical for genes encoding ribosomal proteins, there are multiple processed pseudogenes of this gene dispersed through the genome. Mutations in this gene result in Diamond-Blackfan anemia. | This gene encodes a ribosomal protein that is a component of the 40S subunit. The protein belongs to the S24E family of ribosomal proteins. It is located in the cytoplasm. Multiple transcript variants encoding different isoforms have been found for this gene. As is typical for genes encoding ribosomal proteins, there are multiple processed pseudogenes of this gene dispersed through the genome. Mutations in this gene result in Diamond-Blackfan anemia. |
| RPS6KC1 | intronic | 26750 | Gene aliases humS6PKh1 and RPK118; link to PD, RPS6KC1 interacts with PRDX3 (PMID 15750338) which interacts with LRRK2 (PMID 21850687) | Gene aliases humS6PKh1 and RPK118; link to PD, RPS6KC1 interacts with PRDX3 (PMID 15750338) which interacts with LRRK2 (PMID 21850687) |
| RTTN | both | 25914 | rotatin; limited gene information, see PMIDs 11900971 and 17551791, "Embryos deficient in rotatin show also randomized heart looping and delayed neural tube closure, and fail | rotatin; limited gene information, see PMIDs 11900971 and 17551791, "Embryos deficient in rotatin show also randomized heart looping and delayed neural tube closure, and fail to undergo |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | to undergo the critical morphogenetic step of axial rotation" | the critical morphogenetic step of axial rotation" |
| SCAMP1 | intronic | 9522 | This gene product belongs to the SCAMP family of proteins which are secretory carrier membrane proteins. They function as carriers to the cell surface in post-golgi recycling pathways. | This gene product belongs to the SCAMP family of proteins which are secretory carrier membrane proteins. They function as carriers to the cell surface in post-golgi recycling pathways. |
| SENP5 | both | 205564 | SENP5 involved in mitochondrial defect (PMIDs 17102611, 17341580, 20131004) which is PARK2 and PINK1 mechanism | SENP5 involved in mitochondrial defect (PMIDs 17102611, 17341580, 20131004) which is PARK2 and PINK1 mechanism |
| SEPT14 | exonic | 346288 | PD link, PMID 20236126: "Expression changes in septins have also been associated with neurological conditions such as Alzheimer's and Parkinson's disease, as well as retinopathies, hepatitis C, spermatogenesis and Listeria infection. Pathogenic mutations of SEPT9 were identified in the autosomal dominant neurological disorder hereditary neuralgic amyotrophy (HNA)"; see also PMID 18951507, "Expression of Lewy body protein septin 4 in postmortem brain of Parkinson's disease and control subjects"; PMID 19378812: "Functions of the septin cytoskeleton and its roles in dopaminergic neurotransmission"; PMID 20181826: "Septin 14 is involved in cortical neuronal migration via interaction with Septin 4"; 15 PubMed refs for "septin AND Parkinson's" including PMIDs 18541383, 19378812. | PD link, PMID 20236126: "Expression changes in septins have also been associated with neurological conditions such as Alzheimer's and Parkinson's disease, as well as retinopathies, hepatitis C, spermatogenesis and Listeria infection. Pathogenic mutations of SEPT9 were identified in the autosomal dominant neurological disorder hereditary neuralgic amyotrophy (HNA)"; see also PMID 18951507, "Expression of Lewy body protein septin 4 in postmortem brain of Parkinson's disease and control subjects"; PMID 19378812: "Functions of the septin cytoskeleton and its roles in dopaminergic neurotransmission"; PMID 20181826: "Septin 14 is involved in cortical neuronal migration via interaction with Septin 4"; 15 PubMed refs for "septin AND Parkinson's" including PMIDs 18541383, 19378812. |
| SFRP1 | exonic | 6422 | Many cancer citations but neurological citation too, sucha as PMID 16172602: SFRP1 regulates the growth of retinal ganglion cell axons through the Fz2 receptor; SFRP1 involved in WNT signaling, 13 citations for "'wnt signaling" AND | Many cancer citations but neurological citation too, sucha as PMID 16172602: SFRP1 regulates the growth of retinal ganglion cell axons through the Fz2 receptor; SFRP1 involved in WNT signaling, 13 citations for "'wnt signaling" AND parkinson's' and also |

| RefSeq Gene Symbol | CNV Gene Region | NCBI Gene ID | Gene Biology Curation | Gene Annotation |
|---|---|---|---|---|
| | | | parkinson's' and also mentioned in abstract for PD gene VPS35, PMID 21763482 | mentioned in abstract for PD gene VPS35, PMID 21763482 |
| SGK1 | exonic | 6446 | 3 PubMed for "SGK1 AND parkinson's" for PMIDs 15673431, 16125969, 20530112; many patents with SGK1 as kinase target, along with ROCK1 (1 PD case has ROCK1 CNV) | 3 PubMed for "SGK1 AND parkinson's" for PMIDs 15673431, 16125969, 20530112; many patents with SGK1 as kinase target, along with ROCK1 (1 PD case has ROCK1 CNV) |
| SHMT2 | exonic | 6472 | Potential role in mitochondrial integrity/dysfunction, see PMID 21876188, abstract states: "De novo thymidylate synthesis activity was diminished in mitochondria isolated from glyA CHO cells that lack SHMT2 activity√¢‚Ç¨¬∂" | Potential role in mitochondrial integrity/dysfunction, see PMID 21876188, abstract states: "De novo thymidylate synthesis activity was diminished in mitochondria isolated from glyA CHO cells that lack SHMT2 activity√¢‚Ç¨¬∂" |
| SLC25A24 | both | 29957 | nuclear gene encoding mitochondrial protein, transcript variant 2; potential PD via mito function | nuclear gene encoding mitochondrial protein, transcript variant 2; potential PD via mito function |
| SLC38A6 | both | 145389 | Limited gene information; expessed in brain (PMID 18418736) | Limited gene information; expessed in brain (PMID 18418736) |
| SLC39A8 | exonic | 64116 | This gene encodes a member of the SLC39 family of solute-carrier genes, which show structural characteristics of zinc transporters. The encoded protein is glycosylated and found in the plasma membrane and mitochondria, and functions in the cellular import of zinc at the onset of inflammation. It is also thought to be the primary transporter of the toxic cation cadmium, which is found in cigarette smoke. Multiple transcript variants encoding different isoforms have been found for this gene. Additional alternatively spliced transcript variants of this gene have been described, but their full-length nature is not known. | This gene encodes a member of the SLC39 family of solute-carrier genes, which show structural characteristics of zinc transporters. The encoded protein is glycosylated and found in the plasma membrane and mitochondria, and functions in the cellular import of zinc at the onset of inflammation. It is also thought to be the primary transporter of the toxic cation cadmium, which is found in cigarette smoke. Multiple transcript variants encoding different isoforms have been found for this gene. Additional alternatively spliced transcript variants of this gene have been described, but their full-length nature is not known. |
| SLC3A1 | exonic | 6519 | This gene encodes a type II membrane glycoprotein which is one of the components of the renal amino acid transporter which transports | This gene encodes a type II membrane glycoprotein which is one of the components of the renal amino acid transporter which transports neutral and |

Figure 10C (Continued)

| \multicolumn{5}{|c|}{Figure 10C} |
| RefSeq Gene Symbol | CNV Gene Region | NCBI Gene ID | Gene Biology Curation | Gene Annotation |
| --- | --- | --- | --- | --- |
| | | | neutral and basic amino acids in the renal tubule and intestinal tract. Mutations and deletions in this gene are associated with cystinuria. Alternatively spliced transcript variants have been described, but their biological validity has not been determined. | basic amino acids in the renal tubule and intestinal tract. Mutations and deletions in this gene are associated with cystinuria. Alternatively spliced transcript variants have been described, but their biological validity has not been determined. |
| SLC9B1 | exonic | 150159 | The protein encoded by this gene is a sodium/hydrogen exchanger and transmembrane protein. Highly conserved orthologs of this gene have been found in other mammalian species. The expression of this gene may be limited to testis. Multiple transcript variants encoding different isoforms have been found for this gene. | The protein encoded by this gene is a sodium/hydrogen exchanger and transmembrane protein. Highly conserved orthologs of this gene have been found in other mammalian species. The expression of this gene may be limited to testis. Multiple transcript variants encoding different isoforms have been found for this gene. |
| SLC9B2 | exonic | 133308 | Sodium hydrogen antiporters, such as NHEDC2, convert the proton motive force established by the respiratory chain or the F1F0 mitochondrial ATPase into sodium gradients that drive other energy-requiring processes, transduce environmental signals into cell responses, or function in drug efflux (Xiang et al., 2007 [PubMed 18000046]). | Sodium hydrogen antiporters, such as NHEDC2, convert the proton motive force established by the respiratory chain or the F1F0 mitochondrial ATPase into sodium gradients that drive other energy-requiring processes, transduce environmental signals into cell responses, or function in drug efflux (Xiang et al., 2007 [PubMed 18000046]). |
| SMYD3 | exonic | 64754 | This gene encodes a histone methyltransferase which functions in RNA polymerase II complexes by an interaction with a specific RNA helicase. Multiple transcript variants encoding different isoforms have been found for this gene. | This gene encodes a histone methyltransferase which functions in RNA polymerase II complexes by an interaction with a specific RNA helicase. Multiple transcript variants encoding different isoforms have been found for this gene. |
| SPAG16 | both | 79582 | sperm associated antigen 16; limited gene information | sperm associated antigen 16; limited gene information |
| SPON1 | intronic | 10418 | spondin 1, extracellular matrix protein; AD link, see PMID 14983046: Binding of F-spondin to amyloid-beta precursor protein: a candidate amyloid-beta precursor protein ligand that modulates | spondin 1, extracellular matrix protein; AD link, see PMID 14983046: Binding of F-spondin to amyloid-beta precursor protein: a candidate amyloid-beta precursor protein ligand that modulates amyloid-beta precursor protein |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | amyloid-beta precursor protein cleavage; neuro link, see PMID 21145970: F-spondin regulates neuronal survival through activation of disabled-1 in the chicken ciliary ganglion | cleavage; neuro link, see PMID 21145970: F-spondin regulates neuronal survival through activation of disabled-1 in the chicken ciliary ganglion |
| SRF | exonic | 6722 | SRF linked to FXN; downstream target of MAPK pathway; also, SRF linked to PD via Rho GTPase, see PMID 21699982: Rho GTPase regulation of √é¬±-synuclein and VMAT2: Implications for pathogenesis of Parkinson's disease | SRF linked to FXN; downstream target of MAPK pathway; also, SRF linked to PD via Rho GTPase, see PMID 21699982: Rho GTPase regulation of √é¬±-synuclein and VMAT2: Implications for pathogenesis of Parkinson's disease |
| SRGAP2 | exonic | 23380 | Neurological funtion, see PMID 19737524: The F-BAR domain of srGAP2 induces membrane protrusions required for neuronal migration and morphogenesis | Neurological funtion, see PMID 19737524: The F-BAR domain of srGAP2 induces membrane protrusions required for neuronal migration and morphogenesis |
| STAU2 | both | 27067 | Neurological links, see PMIDs 20596529, 21508097, 21635779; MAPK link, see PMIDs 16418534 and 17587311 | Neurological links, see PMIDs 20596529, 21508097, 21635779; MAPK link, see PMIDs 16418534 and 17587311 |
| STK31 | intronic | 56164 | serine/threonine kinase 31; gene is similar to a mouse gene that encodes a putative protein kinase with a tudor domain, and shows testis-specific expression | serine/threonine kinase 31; gene is similar to a mouse gene that encodes a putative protein kinase with a tudor domain, and shows testis-specific expression |
| STRA6 | exonic | 64220 | See PMID 19309693: Phenotypic spectrum of STRA6 mutations (OMIM 610745): from Matthew-Wood syndrome to non-lethal anophthalmia; retinol link to PD: PMID 17592014, Retinoic acid counteracts developmental defects in the substantia nigra caused by Pitx3 deficiency; PMID 15359008: Retinoic acid signaling in the nervous system of adult vertebrates; PMID 21695257, Leucine-rich repeat kinase 2 modulates retinoic acid-induced neuronal differentiation of murine embryonic stem cells; AD Rx link (STRA6 binds RBP4), PMID | See PMID 19309693: Phenotypic spectrum of STRA6 mutations (OMIM 610745): from Matthew-Wood syndrome to non-lethal anophthalmia; retinol link to PD: PMID 17592014, Retinoic acid counteracts developmental defects in the substantia nigra caused by Pitx3 deficiency; PMID 15359008: Retinoic acid signaling in the nervous system of adult vertebrates; PMID 21695257, Leucine-rich repeat kinase 2 modulates retinoic acid-induced neuronal differentiation of murine embryonic stem cells; AD Rx link (STRA6 binds RBP4), PMID 17001693: Retinoid receptors, |

| RefSeq Gene Symbol | CNV Gene Region | NCBI Gene ID | Gene Biology Curation | Gene Annotation |
|---|---|---|---|---|
| | | | 17001693: Retinoid receptors, transporters, and metabolizers as therapeutic targets in late onset Alzheimer disease. | transporters, and metabolizers as therapeutic targets in late onset Alzheimer disease. |
| STX8 | intronic | 9482 | syntaxin 8, protein is involved in protein trafficking from early to late endosomes via vesicle fusion and exocytosis; PD link for syntaxin in Drosophila model (PMID 17456438) and involved in formation of SNARE (PMID 20489724), see also OMIM 604203 | syntaxin 8, protein is involved in protein trafficking from early to late endosomes via vesicle fusion and exocytosis; PD link for syntaxin in Drosophila model (PMID 17456438) and involved in formation of SNARE (PMID 20489724), see also OMIM 604203 |
| STXBP5L | intronic | 9515 | syntaxin binding protein 5-like, limited gene information | syntaxin binding protein 5-like, limited gene information |
| SYT1 | intronic | 6857 | synaptotagmin I; PD link, see PMIDs 21576241,16111820, 15033168 | synaptotagmin I; PD link, see PMIDs 21576241,16111820, 15033168 |
| TAAR1 | exonic | 134864 | PD link, for example PMID 18083911: Trace amine-associated receptor 1 modulates dopaminergic activity; see also PMIDs 21670104, 18585080, 20976142, 16584120; numerous patent filings mention TAAR1 (e.g., BrainCells Inc. and Roche); see also PMID 18083911: Trace amine-associated receptor 1 modulates dopaminergic activity; link to DRD5 | PD link, for example PMID 18083911: Trace amine-associated receptor 1 modulates dopaminergic activity; see also PMIDs 21670104, 18585080, 20976142, 16584120; numerous patent filings mention TAAR1 (e.g., BrainCells Inc. and Roche); see also PMID 18083911: Trace amine-associated receptor 1 modulates dopaminergic activity; link to DRD5 |
| TACR3 | exonic | 6870 | Gene aliases are neurokinin B, NK-3R, NK3R, NKR, TAC3RL; 5 citations for PubMed search "neuromedin-K receptor AND parkinson's" AND 95 USPTO appl. and 80 issued patents for "neurokinin 3 receptor" as it is a drug target by several pharma; role in PD for TAC3/TACR3, see PMID 184237765: Neurokinin B/NK3 receptors exert feedback inhibition on L-DOPA actions in the 6-OHDA lesion rat model of Parkinson's disease; see also PMIDs18021294, 8574643; TACR3's neuropeptide ligand (TAC3, NKB, neurokinin B) | Gene aliases are neurokinin B, NK-3R, NK3R, NKR, TAC3RL; 5 citations for PubMed search "neuromedin-K receptor AND parkinson's" AND 95 USPTO appl. and 80 issued patents for "neurokinin 3 receptor" as it is a drug target by several pharma; role in PD for TAC3/TACR3, see PMID 184237765: Neurokinin B/NK3 receptors exert feedback inhibition on L-DOPA actions in the 6-OHDA lesion rat model of Parkinson's disease; see also PMIDs18021294, 8574643; TACR3's neuropeptide ligand (TAC3, NKB, neurokinin B) also linked to preeclampsia (PMID 10866201) |

| RefSeq Gene Symbol | CNV Gene Region | NCBI Gene ID | Gene Biology Curation | Gene Annotation |
|---|---|---|---|---|
| | | | also linked to preeclampsia (PMID 10866201) | |
| TAMM41 | exonic | 132001 | No gene information | No gene information |
| TARS | exonic | 6897 | Gene product is threonyl-tRNA synthetase; 8 citations for PubMed search '"trna synthetase" AND parkinson's', such as PMID 16135753: Accumulation of the authentic parkin substrate aminoacyl-tRNA synthetase cofactor, p38/JTV-1, leads to catecholaminergic cell death; | Gene product is threonyl-tRNA synthetase; 8 citations for PubMed search '"trna synthetase" AND parkinson's', such as PMID 16135753: Accumulation of the authentic parkin substrate aminoacyl-tRNA synthetase cofactor, p38/JTV-1, leads to catecholaminergic cell death; |
| TBCE | exonic | 6905 | Cofactor E is one of four proteins (cofactors A, D, E, and C) involved in the pathway leading to correctly folded beta-tubulin from folding intermediates. Cofactors A and D are believed to play a role in capturing and stabilizing beta-tubulin intermediates in a quasi-native confirmation. Cofactor E binds to the cofactor D/beta-tubulin complex; interaction with cofactor C then causes the release of beta-tubulin polypeptides that are committed to the native state. Two transcript variants encoding the same protein have been found for this gene. | Cofactor E is one of four proteins (cofactors A, D, E, and C) involved in the pathway leading to correctly folded beta-tubulin from folding intermediates. Cofactors A and D are believed to play a role in capturing and stabilizing beta-tubulin intermediates in a quasi-native confirmation. Cofactor E binds to the cofactor D/beta-tubulin complex; interaction with cofactor C then causes the release of beta-tubulin polypeptides that are committed to the native state. Two transcript variants encoding the same protein have been found for this gene. |
| TBK1 | exonic | 29110 | TBK1 binds TRAF3 (PMID 17327220); TBK1 also linked to AKT and mTOR (21464307, also PMID 19622833: Inhibition of mTOR signaling in Parkinson's disease prevents L-DOPA-induced dyskinesia) and long-established role in NFKB activation (PMID 10581243, signaling complex contains TRAF2, TANK, TBK1); TBK1 also linked to cullin (see FBXO18 entry for details on cullin) and IFN, see PMID 17015689: Involvement of the IkappaB kinase | TBK1 binds TRAF3 (PMID 17327220); TBK1 also linked to AKT and mTOR (21464307, also PMID 19622833: Inhibition of mTOR signaling in Parkinson's disease prevents L-DOPA-induced dyskinesia) and long-established role in NFKB activation (PMID 10581243, signaling complex contains TRAF2, TANK, TBK1); TBK1 also linked to cullin (see FBXO18 entry for details on cullin) and IFN, see PMID 17015689: Involvement of the IkappaB kinase (IKK)-related kinases tank-binding kinase 1/IKKi and |

| RefSeq Gene Symbol | CNV Gene Region | NCBI Gene ID | Gene Biology Curation | Gene Annotation |
|---|---|---|---|---|
| | | | (IKK)-related kinases tank-binding kinase 1/IKKi and cullin-based ubiquitin ligases in IFN regulatory factor-3 degradation AND link between PD and IFN-gamma, see PMID 21572432: Interferon-√é¬≥ induces progressive nigrostriatal degeneration and basal ganglia calcification; PMID 21482445: Interferon-√é¬≥ plays a role in paraquat-induced neurodegeneration involving oxidative and proinflammatory pathways; potential link between PD and MS, PMID 21881474: A coincidental case of young-onset Parkinson disease and multiple sclerosis AND PMID 21870889: Targeting progressive neuroaxonal injury: lessons from multiple sclerosis; XPOT may also contribute to pathology (loss-of-function) as the CNV impacting TBK1 also impacts XPOT | cullin-based ubiquitin ligases in IFN regulatory factor-3 degradation AND link between PD and IFN-gamma, see PMID 21572432: Interferon-√é¬≥ induces progressive nigrostriatal degeneration and basal ganglia calcification; PMID 21482445: Interferon-√é¬≥ plays a role in paraquat-induced neurodegeneration involving oxidative and proinflammatory pathways; potential link between PD and MS, PMID 21881474: A coincidental case of young-onset Parkinson disease and multiple sclerosis AND PMID 21870889: Targeting progressive neuroaxonal injury: lessons from multiple sclerosis; XPOT may also contribute to pathology (loss-of-function) as the CNV impacting TBK1 also impacts XPOT |
| TFB2M | exonic | 64216 | No gene information | No gene information |
| TMEM117 | intronic | 84216 | transmembrane protein 117; limited gene information | transmembrane protein 117; limited gene information |
| TMEM52 | exonic | 339456 | transmembrane protein 52 | transmembrane protein 52 |
| TNFRSF1A | intronic | 7132 | tumor necrosis factor receptor superfamily, member 1A, and is linked to several diseases including MS; general TNF superfamily link to PD, e.g., see PMID 21728035: Tumor Necrosis Factor-alpha and the Roles it Plays in Homeostatic and Degenerative Processes Within the Central Nervous System; TRAF genes also contain PD-specific CNVs | tumor necrosis factor receptor superfamily, member 1A, and is linked to several diseases including MS; general TNF superfamily link to PD, e.g., see PMID 21728035: Tumor Necrosis Factor-alpha and the Roles it Plays in Homeostatic and Degenerative Processes Within the Central Nervous System; TRAF genes also contain PD-specific CNVs |
| TPTE2P3 | exonic | 220115 | gene is listed as pseudogene; transmembrane phosphoinositide 3-phosphatase and tensin homolog 2 pseudogene 3; limited information, | gene is listed as pseudogene; transmembrane phosphoinositide 3-phosphatase and tensin homolog 2 pseudogene 3; limited information, |

Figure 10C (Continued)

| \multicolumn{5}{c}{Figure 10C} |
| RefSeq Gene Symbol | CNV Gene Region | NCBI Gene ID | Gene Biology Curation | Gene Annotation |
|---|---|---|---|---|
| | | | AceView indicates it contains a C2 domain of PTEN tumour-suppressor protein | AceView indicates it contains a C2 domain of PTEN tumour-suppressor protein |
| TRAF3 | exonic | 7187 | TRAF3 binds TBK1 (PMID 17327220); see review, PMID 21660053: Expanding TRAF function: TRAF3 as a tri-faced immune regulator; see also PMID 18040839 | TRAF3 binds TBK1 (PMID 17327220); see review, PMID 21660053: Expanding TRAF function: TRAF3 as a tri-faced immune regulator; see also PMID 18040839 |
| TRIQK | both | 286144 | No gene information | No gene information |
| TRPM4 | exonic | 54795 | PD link, see PMID 21486760: "ICAN is likely to be mediated by a transient receptor potential (TRP) channel, and RT-PCR was used to confirm expression of TRPM2 and TRPM4 mRNA in substantia nigra pars compacta. We propose that ICAN is selectively activated during burst firing to boost NMDA currents and allow plateau potentials. This boost mechanism may render DA cells vulnerable to excitotoxicity."; see also PMID 17585083: Central role of TRPM4 channels in cerebral blood flow regulation.; see also reviews PMID 21804597: Transient receptor potential channels as therapeutic targets and PMID 15194117: TRP ion channels in the nervous system. | PD link, see PMID 21486760: "ICAN is likely to be mediated by a transient receptor potential (TRP) channel, and RT-PCR was used to confirm expression of TRPM2 and TRPM4 mRNA in substantia nigra pars compacta. We propose that ICAN is selectively activated during burst firing to boost NMDA currents and allow plateau potentials. This boost mechanism may render DA cells vulnerable to excitotoxicity."; see also PMID 17585083: Central role of TRPM4 channels in cerebral blood flow regulation.; see also reviews PMID 21804597: Transient receptor potential channels as therapeutic targets and PMID 15194117: TRP ion channels in the nervous system. |
| TSHZ2 | intronic | 128553 | teashirt zinc finger homeobox 2; AD link (PMID 19343227): FE65 binds Teashirt, inhibiting expression of the primate-specific caspase-4 [APP binds FE65] | teashirt zinc finger homeobox 2; AD link (PMID 19343227): FE65 binds Teashirt, inhibiting expression of the primate-specific caspase-4 [APP binds FE65] |
| TSPYL6 | exonic | 388951 | No gene information | No gene information |
| UBE2D3 | exonic | 7323 | PD link, see PMID 20051513: Lysine 63-linked polyubiquitination of the dopamine transporter requires WW3 and WW4 domains of Nedd4-2 and UBE2D ubiquitin-conjugating enzymes | PD link, see PMID 20051513: Lysine 63-linked polyubiquitination of the dopamine transporter requires WW3 and WW4 domains of Nedd4-2 and UBE2D ubiquitin-conjugating enzymes |

Figure 10C (Continued)

| \multicolumn{5}{c|}{Figure 10C} |
| RefSeq Gene Symbol | CNV Gene Region | NCBI Gene ID | Gene Biology Curation | Gene Annotation |
|---|---|---|---|---|
| ULK1 | exonic | 8408 | PMID 11146101 (mouse homolog): Interaction of the Unc-51-like kinase and microtubule-associated protein light chain 3 related proteins in the brain: possible role of vesicular transport in axonal elongation and PMID 1501404512: Role of Unc51.1 and its binding partners in CNS axon outgrowth, in this review, 2 binding partners of ULK1 are cited (SYNGAP1 and SDCBP), and via AceView, link to LRRK2: http://www.ncbi.nlm.nih.gov/IEB/Research/Acembly/av.cgi?db=human&term=syngap1&submit=Go | PMID 11146101 (mouse homolog): Interaction of the Unc-51-like kinase and microtubule-associated protein light chain 3 related proteins in the brain: possible role of vesicular transport in axonal elongation and PMID 1501404512: Role of Unc51.1 and its binding partners in CNS axon outgrowth, in this review, 2 binding partners of ULK1 are cited (SYNGAP1 and SDCBP), and via AceView, link to LRRK2: http://www.ncbi.nlm.nih.gov/IEB/Research/Acembly/av.cgi?db=human&term=syngap1&submit=Go |
| USP14 | exonic | 9097 | Link to PD and AD, from RefSeq description: "Mice with a mutation that results in reduced expression of the ortholog of this protein are retarded for growth, develop severe tremors by 2 to 3 weeks of age followed by hindlimb paralysis and death by 6 to 10 weeks of age"; see also PMID 19726649: The proteasome-associated deubiquitinating enzyme Usp14 is essential for the maintenance of synaptic ubiquitin levels and the development of neuromuscular junctions | Link to PD and AD, from RefSeq description: "Mice with a mutation that results in reduced expression of the ortholog of this protein are retarded for growth, develop severe tremors by 2 to 3 weeks of age followed by hindlimb paralysis and death by 6 to 10 weeks of age"; see also PMID 19726649: The proteasome-associated deubiquitinating enzyme Usp14 is essential for the maintenance of synaptic ubiquitin levels and the development of neuromuscular junctions |
| VGLL4 | both | 9686 | vestigial like 4 (Drosophila) (protein: transcription cofactor vestigial-like protein 4; PMID 15140898), gene information limited but linked to PD via its role in VEGFA expression (PMID 20702774); in 1 PD case, CNV also impacts all of C3orf31 (gene product is MMP37-like protein mitochondrial precursor) | vestigial like 4 (Drosophila) (protein: transcription cofactor vestigial-like protein 4; PMID 15140898), gene information limited but linked to PD via its role in VEGFA expression (PMID 20702774); in 1 PD case, CNV also impacts all of C3orf31 (gene product is MMP37-like protein mitochondrial precursor) |
| VIMP | exonic | 55829 | Selenoprotein with PD link, PMIDs 21456042, 20880505, and 19146923, which is linked to DJ-1: Post-transcriptional regulation of mRNA | Selenoprotein with PD link, PMIDs 21456042, 20880505, and 19146923, which is linked to DJ-1: Post-transcriptional regulation of mRNA |

Figure 10C (Continued)

| \multicolumn{5}{|c|}{Figure 10C} |
|---|---|---|---|---|
| RefSeq Gene Symbol | CNV Gene Region | NCBI Gene ID | Gene Biology Curation | Gene Annotation |
| | | | associated with DJ-1 in sporadic Parkinson disease; AND SELS interacts with ATXN3, which is linked to PARK2, see PMID 20940148: The Machado-Joseph disease-associated mutant form of ataxin-3 regulates parkin ubiquitination and stability. | associated with DJ-1 in sporadic Parkinson disease; AND SELS interacts with ATXN3, which is linked to PARK2, see PMID 20940148: The Machado-Joseph disease-associated mutant form of ataxin-3 regulates parkin ubiquitination and stability. |
| VPREB1 | exonic | 7441 | pre-B lymphocyte 1; linked to RA (PMID 21144590) | pre-B lymphocyte 1; linked to RA (PMID 21144590) |
| WBSCR17 | intronic | 64409 | Williams Syndrome gene; for gene function see PMID 15744064: Cloning and expression of a brain-specific putative UDP-GalNAc: polypeptide N-acetylgalactosaminyltransferase gene | Williams Syndrome gene; for gene function see PMID 15744064: Cloning and expression of a brain-specific putative UDP-GalNAc: polypeptide N-acetylgalactosaminyltransferase gene |
| WDR11 | exonic | 55717 | Limited gene information; cancer (OMIM 606417) | Limited gene information; cancer (OMIM 606417) |
| WLS | intronic | 79971 | wntless homolog (Drosophila), OMIM 611514 | wntless homolog (Drosophila), OMIM 611514 |
| XKR4 | intronic | 114786 | Via Aceview, InterPro annotation: "Members of this family comprise various XK-related proteins, that are involved in sodium-dependent transport of neutral amino acids or oligopeptides. These proteins are responsible for the Kx blood group system - defects results in McLeod syndrome [MIM:314850], an X-linked multi-system disorder characterised by late onset abnormalities in the neuromuscular and hematopoietic systems." | Via Aceview, InterPro annotation: "Members of this family comprise various XK-related proteins, that are involved in sodium-dependent transport of neutral amino acids or oligopeptides. These proteins are responsible for the Kx blood group system - defects results in McLeod syndrome [MIM:314850], an X-linked multi-system disorder characterised by late onset abnormalities in the neuromuscular and hematopoietic systems." |
| XPOT | exonic | 11260 | This gene encodes a protein belonging to the RAN-GTPase exportin family that mediates export of tRNA from the nucleus to the cytoplasm. Translocation of tRNA to the cytoplasm occurs once exportin has bound both tRNA and GTP-bound RAN. | This gene encodes a protein belonging to the RAN-GTPase exportin family that mediates export of tRNA from the nucleus to the cytoplasm. Translocation of tRNA to the cytoplasm occurs once exportin has bound both tRNA and GTP-bound RAN. |
| ZBTB20 | exonic | 26137 | Neurological links, such as PMIDs 17301088: Hippocampus-like | Neurological links, such as PMIDs 17301088: Hippocampus-like |

Figure 10C (Continued)

| Figure 10C |||||
|---|---|---|---|---|
| RefSeq Gene Symbol | CNV Gene Region | NCBI Gene ID | Gene Biology Curation | Gene Annotation |
| | | | corticoneurogenesis induced by two isoforms of the BTB-zinc finger gene Zbtb20 in mice; PMID 19955470: Zbtb20-induced CA1 pyramidal neuron development and area enlargement in the cerebral midline cortex of mice | corticoneurogenesis induced by two isoforms of the BTB-zinc finger gene Zbtb20 in mice; PMID 19955470: Zbtb20-induced CA1 pyramidal neuron development and area enlargement in the cerebral midline cortex of mice |
| ZC3H6 | intronic | 376940 | zinc finger CCCH-type containing 6, limited gene information | zinc finger CCCH-type containing 6, limited gene information |
| ZFHX3 | exonic | 463 | Gene alias is ATBF1; neurological links (PMID 20876357, 16251211) and PD links (PMIDs 7908247, 7881757, 15837137); associated with atrial fibrillation (PMID 19597492, 19597491 are GWAS); also many cancer refs; PMID 20876357: The ZFHX3 (ATBF1) transcription factor induces PDGFRB, which activates ATM in the cytoplasm to protect cerebellar neurons from oxidative stress; and role for family member PDGF-CC, PMID 20231377: Survival effect of PDGF-CC rescues neurons from apoptosis in both brain and retina by regulating GSK3beta phosphorylation | Gene alias is ATBF1; neurological links (PMID 20876357, 16251211) and PD links (PMIDs 7908247, 7881757, 15837137); associated with atrial fibrillation (PMID 19597492, 19597491 are GWAS); also many cancer refs; PMID 20876357: The ZFHX3 (ATBF1) transcription factor induces PDGFRB, which activates ATM in the cytoplasm to protect cerebellar neurons from oxidative stress; and role for family member PDGF-CC, PMID 20231377: Survival effect of PDGF-CC rescues neurons from apoptosis in both brain and retina by regulating GSK3beta phosphorylation |
| ZNF280A | exonic | 129025 | zinc finger protein 280A | This gene was predicted both by automated computational analysis and by similarity to a Drosophila gene and to predicted genes in other species (sheep, chimp, dog, cow). The predicted protein of this gene is similar to Drosophila suppressor of hairy wing protein, a leucine zipper protein which represses the function of transcriptional enhancers of the gypsy retrotransposon. [provided by RefSeq, Jul 2008]. ##RefSeq-Attributes-START## Transcript_exon_combination_evidence :: BC053901.1, BG473533.1 [ECO:0000332] ##RefSeq-Attributes-END## |
| ZNF28 | exon | 140 | zinc finger protein 280B | This gene was identified by homology |

Figure 10C (Continued)

| \multicolumn{6}{|c|}{Figure 10C} |
| RefSeq Gene Symbol | CNV Gene Region | NCBI Gene ID | Gene Biology Curation | Gene Annotation |
| --- | --- | --- | --- | --- |
| 0B | ic | 883 | | to other species. Its encoded protein is approximately 78-88% identical to a predicted sheep protein of unknown function. The protein is also approximately 25% identical to the Drosophila protein suppressor of hairy wing, which is a leucine zipper protein that represses the function of transcriptional enhancers of the gypsy retrotransposon. [provided by RefSeq, Jul 2008]. Sequence Note: This RefSeq record was created from transcript and genomic sequence data because no single transcript was available for the full length of the gene. The extent of this transcript is supported by transcript alignments. ##RefSeq-Attributes-START## Transcript_exon_combination_evidence :: AK097608.1, BQ219363.1 [ECO:0000332] ##RefSeq-Attributes-END## |
| ZNF317 | exonic | 57693 | zinc finger protein 317, limited gene information | zinc finger protein 317, limited gene information |
| ZNF396 | both | 252884 | Limited gene information; see PMID 12801647 | Limited gene information; see PMID 12801647 |
| ZNF585B | intronic | 92285 | zinc finger protein 585B, no gene information | zinc finger protein 585B, no gene information |
| ZNF624 | intronic | 57547 | zinc finger protein 624; limited gene information | zinc finger protein 624; limited gene information |
| ZNF658 | exonic | 26149 | zinc finger protein 658 | No gene information |
| ZNF658B | exonic | 401509 | No gene information | zinc finger protein 658B, pseudogene (ZNF658B) |
| ZNF707 | exonic | 286075 | zinc finger protein 707; limited gene information | zinc finger protein 707; limited gene information |
| ZNHIT1 | exonic | 10467 | No gene information | No gene information |

Figure 10C (Continued)

| Figure 10D | | | | | |
|---|---|---|---|---|---|
| Gene Number (GN) | RefSeq Gene Symbol | Exon_overlapID | NCBI_GeneI | Gene_Description | RefSeq_Summmary |
| 270 | AK8 | intronic | 158067 | adenylate kinase 8 | N/A |
| 271 | APLP2 | exonic | 334 | amyloid-like protein 2 isoform 1 precursor | This gene encodes amyldid precursor- like protein 2 (APLP2), which is a member of the APP (amyloid precursor protein) family including APP, APLP1 and APLP2. This protein is ubiquitously expressed. It contains heparin-, copper- and zinc-binding domains at the N-terminus, BPTI/Kunitz inhibitor and E2 domains in the middle region, and transmembrane and intracellular domains at the C-terminus. This protein interacts with major histocompatibility complex (MHC) class I molecules. The synergy of this protein and the APP is required to mediate neuromuscular transmission, spatial learning and synaptic plasticity. This protein has been implicated in the pathogenesis of Alzheimer's disease. Multiple alternatively spliced transcript variants encoding different isoforms have been identified. (provided by RefSeq, Aug 2011). Transcript Variant: This variant (1) represents the longest transcript and encodes the longest isoform (1). Publication Note: This RefSeq record includes a subset of the publications that are available for this gene. Please see the Gene record to access additional publications. ##Evidence-Data-START## Transcript exon combination :: S60099.1, L09209.1 (ECO:0000332) RNAseq introns :: single sample supports all introns ERS025081, ERS025082 [ECO:0000348] ##Evidence-Data-END## |
| 272 | ATG7 | intronic | 10533 | ubiquitin-like modifier-activating enzyme ATG7 isoform a | This gene was identified based on homology to Pichia pastoris GSA7 and Saccharomyces cerevisiae APG7. In the yeast, the protein appears to be required for fusion of peroxisomal and vacuolar membranes. The protein shows homology to the ATP-binding and catalytic sites of the E1 ubiquitin activating enzymes. [provided by RefSeq, Jan 2009]. Transcript Variant: This variant (1) represents the longest transcript and encodes the longest isoform (a). Publication Note: This RefSeq record includes a subset of the publications that are available for this gene. Please see the Gene record to access additional publications. ##Evidence-Data-START## Transcript exon combination :: AK075221.1 [ECO:0000332] RNAseq introns :: single sample supports all introns ERS025081, ERS025085 [ECO:0000348] ##Evidence-Data-END## |

Figure 10D

| Gene Number (GN) | RefSeq Gene Symbol | Exon_overlapD | NCBI_GeneI | Gene_Description | RefSeq_Summmary |
|---|---|---|---|---|---|
| 273 | ATRNL1 | exonic | 26033 | attractin-like protein 1 isoform 1 precursor | N/A |
| 274 | CCSER1 | intronic | 401145 | serine-rich coiled-coil domain-containing protein 1 isoform 1 | N/A |
| 275 | CDH12 | intronic | 1010 | cadherin-12 preproprotein | This gene encodes a type II classical cadherin from the cadherin superfamily of integral membrane proteins that mediate calcium-dependent cell-cell adhesion. Mature cadherin proteins are composed of a large N-terminal extracellular domain, a single membrane-spanning domain, and a small, highly conserved C-terminal cytoplasmic domain. Type II (atypical) cadherins are defined based on their lack of a HAV cell adhesion recognition sequence specific to type I cadherins. This particular cadherin appears to be expressed specifically in the brain and its temporal pattern of expression would be consistent with a role during a critical period of neuronal development, perhaps specifically during synaptogenesis. [provided by RefSeq, Jul 2008]. Publication Note: This RefSeq record includes a subset of the publications that are available for this gene. Please see the Gene record to access additional publications. ##Evidence-Data-START## Transcript exon combination :: L33477.1, BC047608.1 [ECO:0000332] RNAseq introns mixed/partial sample support ERS025082, ERS025084 [ECO:0000350] ##Evidence Data-END## |
| 276 | CELSR3 | exonic | 1951 | cadherin EGF LAG seven-pass G-type receptor 3 precursor | This gene belongs to the flamingo subfamily, which is included in the cadherin superfamily. The flamingo cadherins consist of nonclassic-type cadherins that do not interact with catenins. They are plasma membrane proteins containing seven epidermal growth factor-like repeats, nine cadherin domains and two laminin A G-type repeats in their ectodomain. They also have seven transmembrane domains, a characteristic feature of their subfamily. The encoded protein may be involved in the regulation of contact-dependent neurite growth and may play a role in tumor formation. [provided by RefSeq, Jun 2013]. ##Evidence-Data-START## Transcript exon combination :: AF231023.1 [ECO:0000332] RNAseq introns :: mixed/partial sample support |

Figure 10D (Continued)

| Figure 10D | | | | | |
|---|---|---|---|---|---|
| Gene Number (GN) | RefSeq Gene Symbol | Exon _overlap ID | NCBI _Gene_I | Gene_Description | RefSeq_Summmmary |
| | | | | | ERS025081, ERS025082 [ECO:0000350] ##Evidence-Data-END## |
| 277 | CGNL1 | exonic | 84952 | cingulin-like protein 1 | This gene encodes a member of the cingulin family. The encoded protein localizes to both adherens and tight cell-cell junctions and mediates junction assembly and maintenance by regulating the activity of the small GTPases RhoA and Rac1. Heterozygous chromosomal rearrangements resulting in association of the promoter for this gene with the aromatase gene are a cause of aromatase excess syndrome. Alternatively spliced transcript variants have been observed for this gene. [provided by RefSeq, Nov 2011]. Transcript Variant: This variant (1) represents the longer transcript. Variants 1 and 2 encode the same protein. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: AY610514.1 [ECO:0000332] ##Evidence-Data-END## |
| 278 | CTNNA3 | intronic | 29119 | catenin alpha-3 | N/A |
| 279 | DAP3 | exonic | 7818 | mitochondrial isoform 1 | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 28S subunit protein that also participates in apoptotic pathways which are initiated by tumor necrosis factor-alpha, Fas ligand, and gamma interferon. This protein potentially binds ATP/GTP and might be a functional partner of the mitoribosomal protein S27. Multiple alternatively spliced transcript variants encoding distinct isoforms have been found for this gene. Pseudogenes corresponding to this gene are found on chromosomes 1q and 2q. [provided by RefSeq, Dec 2010]. Transcript Variant: This variant (1) has an additional segment |

Figure 10D (Continued)

| Figure 10D | | | | | |
|---|---|---|---|---|---|
| Gene Number (GN) | RefSeq Gene Symbol | Exon_overlapID | NCBI_GeneI | Gene_Description | RefSeq_Summmmary |
| | | | | | in the 5' UTR, as compared to variant 2. Variants 1, 2 and 3 encode the same isoform (1). Sequence Note: This RefSeq record was created from transcript and genomic sequence data to make the sequence consistent with the reference genome assembly. The genomic coordinates used for the |
| 280 | DLEU1 | exonic | 10301 | N/A | N/A |
| 281 | DLEU2 | exonic | 8847 | N/A | N/A |
| 282 | ENOX2 | exonic | 10495 | ecto-NOX disulfide-thiol exchanger 2 isoform a | This gene is a tumor-specific member of the ECTO-NOX family of genes that encode cell surface NADH oxidases. The encoded protein has two enzymatic activities: catalysis of hydroquinone or NADH oxidation, and protein disulfide interchange. The protein also displays prion-like properties. Alternative splicing results in multiple transcript variants. [provided by RefSeq, Aug 2013]. Transcript Variant: This variant (1) differs in the 5' UTR and the 5' coding region and initiates translation at a downstream start codon, compared to variant 2. Variants 1 and 3 encode the same isoform (a) which is shorter at the N-terminus, compared to isoform b. Publication Note: This RefSeq record includes a subset of the publications that are available for this gene. Please see the Gene record to access additional publications. ##Evidence-Data-START## Transcript exon combination :: AK289837.1 [ECO:0000332] RNAseq introns mixed/partial sample support ERS025081, ERS025082 [ECO:0000350] ##Evidence-Data-END## |
| 283 | FAM49B | intronic | 51571 | N/A | N/A |
| 284 | FAM160B1 | exonic | 57700 | protein FAM160B1 isoform a | N/A |
| 285 | GON4L | exonic | 54856 | GON-4-like protein isoform a | N/A |
| 286 | GSTA2 | exonic | 2939 | glutathione S-transferase A2 | Cytosolic and membrane-bound forms of glutathione S-transferase are encoded by two distinct supergene families. These enzymes function in the detoxification of electrophilic compounds, including carcinogens, therapeutic drugs, environmental toxins and products of oxidative stress, by conjugation with glutathione. The genes encoding these enzymes are known to be highly polymorphic. These genetic variations |

Figure 10D (Continued)

| Figure 10D | | | | | |
|---|---|---|---|---|---|
| Gene Num ber (GN) | RefSeq Gene Symbol | Exon _ove rlap D | NCBI _Gene _I | Gene_Descripti on | RefSeq_Summmary |
| | | | | | can change an individual's susceptibility to carcinogens and toxins as well as affect the toxicity and efficacy of some drugs. At present, eight distinct classes of the soluble cytoplasmic mammalian glutathione S-transferases have been identified: alpha, kappa, mu, omega, pi, sigma, theta and zeta. This gene encodes a glutathione S-tranferase belonging to the alpha class. The alpha class genes, located in a cluster mapped to chromosome 6, are the most abundantly expressed glutathione S-transferases in liver. In addition to metabolizing bilirubin and certain anti-cancer drugs in the liver, the alpha class of these enzymes exhibit glutathione peroxidase activity thereby protecting the cells from reactive oxygen species and the products of peroxidation. [provided by RefSeq, Jul 2008]. Publication Note: This RefSeq record includes a subset of the publications that are available for this gene. Please see the Gene record to access additional publications. ##Evidence-Data-START## Transcript exon combination :: AK292602.1, BC002895.2 [ECO:0000332] RNAseq introns :: single sample supports all introns ERS025088 |
| 287 | KCNR G | exon ic | 28351 8 | potassium channel regulatory protein isoform 1 | This gene encodes a protein which regulates the activity of voltage-gated potassium channels. This gene is on chromosome 13 and overlaps the gene for tripartite motif containing 13 on the same strand. Multiple transcript variants encoding different isoforms have been found for this gene. [provided by RefSeq, Feb 2012]. Transcript Variant: This variant (1) is the shorter transcript and encodes the longer protein (isoform 1). ##Evidence-Data-START## Transcript exon combination :: AY169388.1, AY190921.1 [ECO:0000332] RNAseq introns :: single sample supports all introns ERS025082, ERS025086 [ECO:0000348] ##Evidence-Data-END## |
| 288 | LINC0 0486 | exon ic | 28504 5 | N/A | N/A |
| 289 | LOC10 027183 2 | exon ic | 10027 1832 | N/A | N/A |
| 290 | LTBP1 | exon ic | 4052 | latent-transforming growth factor beta-binding protein 1 isoform 3 precursor | The protein encoded by this gene belongs to the family of latent TGF-beta binding proteins (LTBPs). The secretion and activation of TGF-betas is regulated by their association with latency-associated proteins and with latent TGF-beta binding proteins. The product of this gene targets latent complexes of transforming growth factor beta to the extracellular matrix, where the |

Figure 10D (Continued)

| Figure 10D | | | | | |
|---|---|---|---|---|---|
| Gene Number (GN) | RefSeq Gene Symbol | Exon_overlap ID | NCBI_Gene_I | Gene_Description | RefSeq_Summmmary |
| | | | | | latent cytokine is subsequently activated by several different mechanisms. Alternatively spliced transcript variants encoding different isoforms have been identified. [provided by RefSeq, Jul 2008]. Transcript Variant: This variant (3) differs in the 5' UTR and 5' coding region, and lacks an alternate in-frame exon in the central coding region, compared to variant 1. The encoded isoform (3) has a distinct N-terminus and is shorter than isoform LTBP-1L. Publication Note: This RefSeq record includes a subset of the publications that are available for this gene. Please see the Gene record to access additional publications. ##Evidence-Data-START## Transcript exon combination :: AB208801.1 [ECO:0000332] RNAseq introns factor beta-binding protein 1 single sample supports all introns ERS025081, ERS025083 [ECO:0000348] ##Evidence-Data-END## |
| 291 | MIR15A | exonic | 406948 | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. Publication Note: This RefSeq record includes a subset of the publications that are available for this gene. Please see the Gene record to access additional publications. |

Figure 10D (Continued)

| Figure 10D | | | | | |
|---|---|---|---|---|---|
| Gene Number (GN) | RefSeq Gene Symbol | Exon_ove rlap D | NCBI _Gene _I | Gene_Descripti on | RefSeq_Summmmary |
| | | | | Drosha ribonuclease III enzyme to produce an approximately 70-nt stem-loop precursor miRNA .(pre-miRNA), which is further cleaved by the cytoplasmic Dicer ribonuclease to generate the mature miRNA and antisense miRNA star (miRNA*) products. The mature miRNA is incorporated | |
| 292 | MIR16-1 | exonic | 406950 | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may riot be included in the intermediate precursor miRNA produced by Drosha cleavagePublication Note: This RefSeq record includes a subset of the publications that are available for this gene. Please |

Figure 10D (Continued)

| Figure 10D | | | | | |
|---|---|---|---|---|---|
| Gene Number (GN) | RefSeq Gene Symbol | Exon _ove rlap D | NCBI _Gene _I | Gene_Description | RefSeq_Summmmary |
| | | | | The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated | see the Gene record to access additional publications. |
| 293 | MIR47 93 | exon ic | 10061 6112 | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further clea.ved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or • destabilization of the target mRNA. The RefSeq represents the predicted microRNA stem-loop. [provided by RefSeq, Sep 20091. Sequence Note: This record represents a predicted microRNA stem-loop as defined by miRBase. Some sequence at the 5' and 3' ends may not be included in the intermediate precursor miRNA |

Figure 10D (Continued)

| Figure 10D | | | | | |
|---|---|---|---|---|---|
| Gene Number (GN) | RefSeq Gene Symbol | Exon_ove rlap D | NCBI _Gene _I | Gene_Descripti on | RefSeq_Summmmary |
| | | | | can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated | produced by Drosha cleavage. |
| 294 | MSR1 | exon ic | 4481 | macrophage scavenger receptor types I and II isoform type 1 | This gene encodes the class A macrophage scavenger receptors, which include three different types (1, 2, 3) generated by alternative splicing of this gene. These receptors or isoforms are macrophage-specific trimeric integral membrane glycoproteins and have been implicated in many macrophage-associated physiological and pathological processes including atherosclerosis, Alzheimer's disease, and host defense. The isoforms type 1 and type 2 are functional receptors and are able to mediate the endocytosis of modified low density lipoproteins (LDLs). The isoform type 3 does not internalize modified LDL (acetyl-LDL) despite having the domain shown to mediate this function in the types 1 and 2 isoforms. It has an altered intracellular processing and is trapped within the endoplasmic reticulum, making it unable to perform endocytosis. The isoform type 3 can inhibit the function of isoforms type 1 and type 2 when co-expressed, indicating a dominant negative effect and suggesting a mechanism for regulation of scavenger receptor activity in macrophages. [provided by RefSeq, Jul |

Figure 10D (Continued)

| Figure 10D | | | | | |
|---|---|---|---|---|---|
| Gene Number (GN) | RefSeq Gene Symbol | Exon_overlapID | NCBI_GeneI | Gene_Description | RefSeq_Summmary |
| | | | | | 2008]. Transcript Variant: This variant (SR-AI), also known as phSR1, encodes the longest isoform. Publication Note: This RefSeq record includes a subset of the publications that are available for this gene. Please see the Gene record to access additional publications. ##Evidence-Data-START## Transcript exon combination :: D90187.1 [ECO:0000332] RNAseq introns mixed/partial sample support ERS025081, ERS025082 [ECO:0000350] |
| 295 | MSTO2P | exonic | 100129405 | N/A | N/A |
| 296 | NPFFR2 | exonic | 10886 | neuropeptide FF receptor 2 isoform 1 | This gene encodes a member of a subfamily of G-protein-coupled neuropeptide receptors. This protein is activated by the neuropeptides A-18-amide (NPAF) and F-8-amide (NPFF) and may function in pain modulation and regulation of the opioid system. Alternative splicing results in multiple transcript variants. [provided by RefSeq, Jan 2009]. Transcript Variant: This variant (1) represents the longest transcript and encodes the longest isoform (1). Publication Note: This RefSeq record includes a subset of the publications that are available for this gene. Please see the Gene record to access additional publications. ###Evidence-Data-START## Transcript exon combination :: AF119815.1, AK308069.1 [ECO:0000332] RNAseq introns :: mixed/partial sample support ERS025082 [ECO:0000350] ##Evidence-Data-END## |
| 297 | NR1H4 | intronic | 9971 | bile acid receptor isoform 1 | This gene encodes a ligand-activated transcription factor, which shares structural features in common with nuclear hormone receptor family, such as a DNA-binding domain that targets the receptor to specific DNA sequences, and a ligand-binding domain, which interacts directly with the ligand and contains a ligand-dependent transcriptional activation domain. This protein functions as a receptor for bile acids, and when bound to bile acids, regulates the expression of genes involved in bile acid synthesis and transport. Alternatively spliced transcript variants encoding different isoforms have been described for this gene. [provided by RefSeq, Aug 2011]. Transcript Variant: This variant (1) encodes isoform 1 (also known as FXRalpha+). Variants 1 and 6 encode the same isoform. Publication Note: This RefSeq record includes a subset of the publications that are available for this gene. Please see the Gene record to access additional publications. ##Evidence-Data-START## Transcript exon |

Figure 10D (Continued)

| Figure 10D | | | | | |
|---|---|---|---|---|---|
| Gene Number (GN) | RefSeq Gene Symbol | Exon_overlapID | NCBI_GeneI | Gene_Description | RefSeq_Summmmary |
| | | | | | combination BC144184.1 [ECO:0000332] RNAseq introns :: single sample supports all introns ERS025084, ERS025086 [ECO:0000348] ##Evidence-Data-END## |
| 298 | PARK2 | intronic | 5071 | E3 ubiquitin-protein ligase parkin isoform 1 | The precise function of this gene is unknown; however, the encoded protein is a component of a multiprotein E3 ubiquitin ligase complex that mediates the targeting of substrate proteins for proteasomal degradation. Mutations in this gene are known to cause Parkinson disease and autosomal recessive juvenile Parkinson disease. Alternative splicing of this gene produces multiple transcript variants encoding distinct isoforms. Additional splice variants of this gene have been described but currently lack transcript support. [provided by RefSeq, Jul 2008]. Transcript Variant: Transcript variant 1 represents the predominant and full-length form of this gene. Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. ##Evidence-Data-START## Transcript exon combination :: AB009973.1, AB245403.1 [ECO:0000332] RNAseq introns mixed/partial sample support ERS025081, ERS025082 [ECO:0000350] ##Evidence-Data-END## |
| 299 | PLD1 | exonic | 5337 | phospholipase D1 isoform a | This gene encodes a phosphatidylcholine-specific phospholipase which catalyzes the hydrolysis of phosphatidylcholine in order to yield phosphatidic acid and choline. The enzyme may play a role in signal transduction and subcellular trafficking. Alte.rnative splicing results in multiple transcript variants with both catalytic and regulatory properties. [provided by RefSeq, Sep 2011]. Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: BC068976.1, U38545.1 [ECO:0000332] RNAseq introns :: single sample supports all introns ERS025088 [ECO:0000348] ##Evidence-Data-END## |

Figure 10D (Continued)

| Figure 10D | | | | | |
|---|---|---|---|---|---|
| Gene Number (GN) | RefSeq Gene Symbol | Exon_ove rlap ID | NCBI _Gene _I | Gene_Descripti on | RefSeq_Summmmary |
| 300 | PPM1L | intronic | 151742 | protein phosphatase | PPM1L, or PP2CE, belongs.to the PP2C group of serine/threonine phosphatases, which are distinguished from other phosphatases by their structure, absolute requirement for Mg(24-) or Mn(2+), and insensitivity to okadaic acid. PP2Cs regulate stress-activated protein kinase (SAPK; see MIM 601158) signaling cascades that respond to extracellular stimuli (Jin et al., 2004 [PubMed 15560375]).[supplied by OMIM, Apr 2008). ##Evidence-Data-START## Transcript exon combination AY337264.1 [ECO:0000332] RNAseq introns single sample supports all introns ERS025081, ERS025082 [ECO:0000348] ##Evidence-Data-END## |
| 301 | PREPL | exonic | 9581 | prolyl endopeptidase-like isoform 1 | The protein encoded by this gene belongs to the prolyl oligopeptidase subfamily of serine peptidases. Mutations in this gene have been associated with hypotonia-cystinuria syndrome, also known as the 2p21 deletion syndrome. Several alternatively spliced transcript variants encoding either the same or different isoforms have been described for this gene.[provided by RefSeq, Jan 2010]. Transcript Variant: This variant (1, also known as variant C) represents the longest transcript, and encodes the longest isoform (1): Variants 1-3 encode the same isoform. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: DQ023505.1, DQ023505.1 [ECO:0000332] RNAseq introns mixed/partial sample support ERS025081, ERS025082 [ECO:0000350] ##Evidence-Data-END## |
| 302 | RBM47 | intronic | 54502 | RNA-binding protein 47 isoform a | N/A |
| 303 | SDK1 | intronic | 221935 | protein sidekick-1 isoform 1 | N/A |
| | | | | ubiquitin-like modifier-activating enzym | This gene was identified based on homology to Pichia pastoris GSA7 and Saccharomyces cerevisiae APG7. In the yeast, the protein appears to be reqUired for fusion of peroxisomal and vacuolar membranes. The protein shows homology to the ATP-binding and catalytic sites of the El ubiquitin activating enzymes. [provided by RefSeq; Jan 2009]. Transcript Variant: This |

| Figure 10D | | | | | |
|---|---|---|---|---|---|
| Gene Number (GN) | RefSeq Gene Symbol | Exon_overlapD | NCBI_GeneI | Gene_Description | RefSeq_Summmary |
| | | | e ATG7 | | variant (1) represents the longest transcript and encodes the longest isoform (a). Publication Note: This RefSeq record includes a subset of the publications that are available.for this gene. Please see the Gene record to access additional publications. ##Evidence-Data-START## Transcript exon Combination :: AK075221.1 [ECO:0000332] RNAseq introns single sample supports all introns ERS025081, ERS025085 [ECO:0000348] ##Evidence-Data-END## |
| 304 | SLC3A1 | exonic | 6519 | neutral and basic amino acid transport protein rBAT | This gene encodes a type 11 membrane glycoprotein which is one of the components of the renal amino acid transporter which transports neutral and basic amino acids in the renal tubule and intestinal tract. Mutations and deletions in this gene are associated with cystinuria. Alternatively Spliced transcript variants have been described, but their biological validity has not been determined. [provided by RefSeq, Jul 2008]. Publication Note: This RefSeq record includes a subset of the publications that are available for this gene. Please see the Gene record to access additional publications. ##Evidence-Data-START## Transcript exon combination :: AB033549.1, BC022386.1 [ECO:0000332] RNAseq introns :: single sample supports all introns ERS025084, ERS025088 [ECO:0000348] ##Evidence-Data-END## |
| 305 | SLC16A1 | exonic | 6566 | monocarboxylate transporter | The protein encoded by this gene is a proton-linked monocarboxylate transporter that catalyzes the movement of many monocarboxylates, such as lactate and pyruvate, across the plasma membrane. Mutations in this gene are associated with erythrocyte lactate transporter defect. Alternatively spliced transcript variants have been found for this gene.[provided by RefSeq, Oct 2009]. Transcript Variant: This variant (1) represents the predominant transcript. Variants 1 and 2 encode the same protein. Publication Note: This RefSeq record includes a subset of the publications that are available for this gene. Please see the Gene record to access additional publications. ##Evidence-Data-START## Transcript exon combination :: AL162079.1, BC026317.1 [ECO:0000332] RNAseq introns :: single sample supports all introns ERS025082, ERS025083 [ECO:0000348] ##Evidence-Data-END## |
| 306 | SLC2646 | exonic | 65010 | solute carrier family 26 member 6 | This gene belongs to the solute carrier 26 family, whose members encode anion transporter proteins. This particular family member encodes a protein |

| Figure 10D | | | | | |
|---|---|---|---|---|---|
| Gene Number (GN) | RefSeq Gene Symbol | Exon_overlapID | NCBI_GeneI | Gene_Description | RefSeq_Summmary |
| | | | | isoform 1 | involved in transporting chloride, oxalate, sulfate and bicarbonate. Alternatively spliced transcript variants encoding distinct isoforms have been described. [provided by RefSeq, Aug 2013]. Transcript Variant: This variant (1), also known as L+Q encodes the longest isoform (1). Publication Note: This RefSeq record includes a subset of the publications that are available for this gene. Please see the Gene record to access additional publications. ##Evidence-Data-START## Transcript exon combination :: AF288410.1 [ECO:0000332] RNAseq introns :: single sample supports all introns ERS025084, ERS025085 [ECO:0000348] ##Evidence-Data-END## |
| 307 | SPAG16 | intronic | 79582 | Cilia and flagella are comprised of a microtubular backbone, the axoneme, which is organized by the basal body and surrounded by plasma membrane. SPAG16 encodes 2 major proteins that associate with the axoneme of sperm tail and the nucleus of postmeiotic germ cells, respectively (Zhang et al., 2007 [PubMed 17699735]).[supplied by OMIM, Jul 2008]. Transcript Variant: This variant (3) has multiple differences, compared to variant 1. This variant is represented as non-coding because the use | Cilia and flagella are comprised of a microtubular backbone, the axoneme, which is organized by the basal body and surrounded by plasma membrane. SPAG16 encodes 2 major proteins that associate with the axoneme of sperm tail and the nucleus of postmeiotic germ cells, respectively (Zhang et al., 2007 [PubMed 17699735]).[supplied by OMIM; Jul 2008]. Transcript Variant: This variant (3) has multiple differences, compared to variant 1. This variant is represented as non-coding because the use of the 5'-most expected translational start codon, as used in variant 1, renders the transcript a candidate for nonsense-mediated mRNA decay (NMD). ##Evidence-Data-START## RNAseq introns mixed/partial sample support ERS025081, ERS025082 [ECO:0000350] ##Evidence-Data-END## |

Figure 10D (Continued)

| Figure 10D | | | | | |
|---|---|---|---|---|---|
| Gene Number (GN) | RefSeq Gene Symbol | Exon_ove rlap D | NCBI _Gene _I | Gene_Descripti on | RefSeq_Summmary |
| | | | | of the 51-most expected translational start codon, as used in variant 1, renders the transcript a candidate for nonsense-mediated mRNA decay (NMD). ##Evidence-Data-START## RNAseq introns :: mixed/partial sample support | |
| 308 | ST3G AL4 | intro nic | 6484 | CMP-N-acetylneuramina te-beta-galactosamide-alpha-2,3-sialyltransferase 4 isoform 1 precursor | This gene encodes a member of the glycosyltransferase 29 family, a group of enzymes involved in protein glycosylation. The encoded protein is targeted to Golgi membranes but may be proteolytically processed and secreted. The gene product may also be involved in the increased expression of sialyl Lewis X antigen seen in inflammatory responses. Multiple transcript variants encoding different isoforms have been found for this gene. [provided by RefSeq, Dec 2011]. Transcript Variant: This variant (1) represents the longest transcript and encodes isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: X74570.1 [ECO:0000332] RNAseq introns single sample supports all introns ERS025082, ER5025084 [ECO:0000348] ##Evidence-Data-END## |
| 309 | ST13P 4 | exon ic | 14516 5 | N/A | N/A |
| 310 | ST14 | exon ic | 6768 | suppressor of tumorigenicity 14 protein | The protein encoded by this gene is an epithelial-derived, integral membrane serine protease. This protease forms a complex with the Kunitz-type serine protease inhibitor, HAI-1, and is found to be activated by sphingosine 1-phosphate. This protease has been shown to cleave and activate |

| Gene Number (GN) | RefSeq Gene Symbol | Exon_overlapID | NCBI_GeneI | Gene_Description | RefSeq_Summmary |
|---|---|---|---|---|---|
| | | | | | hepatocyte growth factor/scattering factor, and urokinase plasminogen activator, which suggest the function of this protease as an epithelial membrane activator for other proteases and latent growth factors. The expression of this protease has been associated with breast, colon, prostate, and ovarian tumors, which implicates its role in cancer invasion, and metastasis. [provided by RefSeq, Jul 2008]. Publication Note: This RefSeq record includes a subset of the publications that are available for this gene. Please see the Gene record to access additional publications. ##Evidence-Data-START## Transcript exon combination :: BC030532.1, AF133086.1 [ECO:0000332] RNAseq introns :: single sample supports all introns ERS025084, ERS025085 [ECO:0000348] ##Evidence-Data-END## |
| 311 | SYN3 | intronic | 8224 | synapsin-3 isoform IIIa | This gene is a member of the synapsin gene family. Synapsins encode neuronal phosphoproteins which associate with the cytoplasmic surface of synaptic vesicles. Family members are characterized by common protein domains, and they are implicated in synaptogenesis and the modulation of neurotransmitter release, suggesting a potential role in several neuropsychiatric diseases. The protein encoded by this gene shares the synapsin family domain model, with domains A, C, and E exhibiting the highest degree of conservation. The protein contains a unique domain J, located between domains C and E. Based on this gene's localization to 22q12.3, a possible schizophrenia susceptibility locus, and the established neurobiological roles of the synapsins, this family member may represent a candidate gene for schizophrenia. The TIMP3 gene is located within an intron of this gene and is transcribed in the opposite direction. Alternative splicing of this gene results in multiple splice variants that encode different isoforms. [provided by RefSeq, Oct 2008]. Transcript Variant: This variant (IIIa) encodes the full-length isoform IIIa. Sequence Note: This RefSeq record was created from transcript and genomic sequence data to make the sequence consistent with the reference genome assembly. The extent of this transcript is supported by transcript alignments. Publication Note: This RefSeq record includes a subset of the publications that are available for this gene. Please see the Gene record to access additional publications. ##Evidence-Data-START## |

Figure 10D (Continued)

| Figure 10D | | | | | |
|---|---|---|---|---|---|
| Gene Number (GN) | RefSeq Gene Symbol | Exon_overlap ID | NCBI_Gene_I | Gene_Description | RefSeq_Summmary Transcript |
| 312 | TNIK | exonic | 23043 | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (9) lacks the majority of the middle and 3' regions and contains an alternate 3' terminal exon compared to variant 1. This variant is represented as non-coding because it lacks a large portion of the coding region found in variant 1. ##Evidence-Data-START## RNAseq introns :: single sample supports all introns ERS025084, ERS025088 [ECO:0000348] ##Evidence-Data-END## | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (9) lacks the majority of the middle and 3' regions and contains an alternate 3' terminal exon compared to variant 1. This variant is represented as non-coding because it la.cks a large portion of the coding region found in variant 1. ##Evidence-Data-START## RNAseq introns single sample supports all introns ERS025084, ERS025088 [ECO:0000348] ###Evidence-Data-END## |
| 313 | TOP3B | exonic | 8940 | DNA topoisomerase 3-beta-1 | This gene encodes a DNA topoisomerase, an enzyme that controls and alters the topologic states of DNA during transcription. This enzyme |

| Gene Number (GN) | RefSeq Gene Symbol | Exon_overlap ID | NCBI_Gene_I | Gene_Description | RefSeq_Summmmary |
|---|---|---|---|---|---|
| | | | | | catalyzes the transient breaking and rejoining of a single strand of DNA which allows the strands to pass through one another, thus relaxing the supercoils and altering the topology of DNA. The enzyme interacts with DNA helicase SGS1 and plays a role in DNA recombination, cellular aging and maintenance of genome stability. Low expression of this gene may be related to higher survival rates in breast cancer patients. This gene has a pseudogene on chromosome 22. Alternate splicing results in multiple transcript variants. Additional alternatively spliced transcript variants of this gene have been described, but their full-length nature is not known. [provided by RefSeq, Aug 2013]. Transcript Variant: This variant (1) represents the longest transcript. Variants 1 through 3 encode the same protein. ##Evidence-Data-START## Transcript exon combination :: BC002432.2 [ECO:0000332] RNAseq introns :: mixed/partial sample support ERS025081, ERS025082 [ECO:0000350] ##Evidence-Data-END## |
| 314 | TRIM13 | exonic | 10206 | E3 ubiquitin-protein ligase TRIM13 isoform 1 | This gene encodes a member of the tripartite motif (TRIM) family. The TRIM motif includes three zinc-binding domains, a RING, a B-box type 1 and a B-box type 2, and a coiled-coil region. This gene is located on chromosome 13 within the minimal deletion region for B-cell chronic lymphocytic leukemia. Multiple alternatively spliced transcript variants have been found for this gene. [provided by RefSeq, Jul 2008]. Transcript Variant: This variant (1) represents the shortest transcript and encodes the same protein (isoform 1) as variants 2 and 3. Publication Note: This RefSeq record includes a subset of the publications that are available for this gene. Please see the Gene'record to access additional publications. ##Evidence-Data-START## Transcript exon combination :: AF241850.1, AL360196.1 [ECO:0000332] RNAseq introns :: single sample supports all introns ERS025083, ERS025084 [ECO:0000348] ##Evidence-Data-END## |
| 315 | TRUB1 | exonic | 142940 | probable tRNA psuedouridine synthase 1 | Pseudouridine is an abundant component of rRNAs and tRNAs and is enzymatically generated by isomerization of uridine by pseudouridine synthase (Zucchini et al., 2003 [PubMed 12736709]).[supplied by OMIM, Mar 2008]. ##Evidence-Data-START## Transcript exon combination :: BC030601.2, BX648709.1 [ECO:0000332] RNAseq introns :: single sample supports all introns ERS025081, ERS025082 |

Figure 10D (Continued)

| Figure 10D | | | | | |
|---|---|---|---|---|---|
| Gene Number (GN) | RefSeq Gene Symbol | Exon_ove rlap ID | NCBI _Gene _I | Gene_Descripti on | RefSeq_Summmary |
| | | | | | [ECO:0000348] ##Evidence-Data-END## |
| 316 | WDR7 2 | intro nic | 25676 4 | This gene encodes a protein with eight WD-40 repeats. Mutations in this gene have been associated with amelogenesis imperfecta hypomaturation type 2A3. Alternative splicing results in multiple transcript variants. [provided by RefSeq, Mar 2013]. Transcript Variant: This Variant (3) differs in the 5' exon, compared to variant 1. This variant is represented as non-coding due to the presence of an upstream ORF that is predicted to interfere with translation of the longest ORF; translation of the upstream ORF renders the transcript a candidate for nonsense-mediated mRNA decay (NMD). Sequence Note: This RefSeq record was created from transcript and | This gene encodes a protein with eight WD-40 repeats. Mutations in this gene have been associated with amelogenesis imperfecta hypomaturation type 2A3. Alternative splicing results in multiple transcript variants. [provided by RefSeq, Mar 2013]. Transcript Variant: This variant (3) differs in the 5' exon, compared to variant 1. This variant is represented as non-coding due to the presence of an upstream ORF that is predicted to interfere with translation of the longest ORF; translation of the upstream ORF renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: BX648571.1 [ECO:0000332] RNAseq introns mixed/partial sample support ERS025084 [ECO:0000350] ##Evidence-Data-END## |

Figure 10D (Continued)

| Figure 10D | | | | | |
|---|---|---|---|---|---|
| Gene Number (GN) | RefSeq Gene Symbol | Exon_ove rlap D | NCBI _Gene _I | Gene_Descripti on | RefSeq_Summmary |
| | | | | genomic sequence data to make the sequence consistent | |

Figure 10D (Continued)

| Figure 11A | | | | |
|---|---|---|---|---|
| RefSeq Gene Symbol(s) | Exon overlap | RefSeq Accession Number | mRNA Description | SEQ ID |
| LYG2 | exonic | NM_175735 | Homo sapiens lysozyme G-like 2 (LYG2), mRNA. | 198 |
| LYG1 | exonic | NM_174898 | Homo sapiens lysozyme G-like 1 (LYG1), mRNA. | 199 |
| HTR7 | exonic | NM_000872 | Homo sapiens 5-hydroxytryptamine (serotonin) receptor 7, adenylate cyclase-coupled (HTR7), transcript variant a, mRNA. | 200 |
| HTR7 | exonic | NM_019859 | Homo sapiens 5-hydroxytryptamine (serotonin) receptor 7, adenylate cyclase-coupled (HTR7), transcript variant d, mRNA. | 201 |
| HTR7 | exonic | NM_019860 | Homo sapiens 5-hydroxytryptamine (serotonin) receptor 7, adenylate cyclase-coupled (HTR7), transcript variant b, mRNA. | 202 |
| SUMF1 | exonic | NM_001164674 | Homo sapiens sulfatase modifying factor 1 (SUMF1), transcript variant 2, mRNA. | 203 |
| SUMF1 | exonic | NM_001164675 | Homo sapiens sulfatase modifying factor 1 (SUMF1), transcript variant 3, mRNA. | 204 |
| SUMF1 | exonic | NM_182760 | Homo sapiens sulfatase modifying factor 1 (SUMF1), transcript variant 1, mRNA. | 205 |
| UNC13C | both | NM_001080534 | Homo sapiens unc-13 homolog C (C. elegans) (UNC13C), mRNA. | 206 |
| COMMD1 | both | NM_152516 | Homo sapiens copper metabolism (Murr1) domain containing 1 (COMMD1), mRNA. | 207 |
| BMX | exonic | NM_203281 | Homo sapiens BMX non-receptor tyrosine kinase (BMX), transcript variant 1, mRNA. | 208 |
| BMX | exonic | NM_001721 | Homo sapiens BMX non-receptor tyrosine kinase (BMX), transcript variant 2, mRNA. | 209 |
| ACE2 | exonic | NM_021804 | Homo sapiens angiotensin I converting enzyme 2 (ACE2), mRNA. | 210 |
| TMEM27 | exonic | NM_020665 | Homo sapiens transmembrane protein 27 (TMEM27), mRNA. | 211 |
| HIRA | exonic | NM_003325 | Homo sapiens histone cell cycle regulator (HIRA), mRNA. | 212 |
| SLC25A1 | exonic | NM_001256534 | Homo sapiens solute carrier family 25 (mitochondrial carrier; citrate transporter), member 1 (SLC25A1), transcript variant 3, mRNA. | 213 |
| SLC25A1 | exonic | NR_033687 | Homo sapiens solute carrier family 25 (mitochondrial carrier; citrate transporter), member 1 (SLC25A1), transcript variant 2, non-coding RNA. | 214 |
| SLC25A1 | exonic | NM_005984 | Homo sapiens solute carrier family 25 (mitochondrial carrier; citrate transporter), member 1 (SLC25A1), transcript variant 1, mRNA. | 215 |
| SLC25A1 | exonic | NR_046298 | Homo sapiens solute carrier family 25 (mitochondrial carrier; citrate transporter), member 1 (SLC25A1), transcript variant 4, non-coding RNA. | 216 |
| CLTCL1 | exonic | NM_0018 | Homo sapiens clathrin, heavy chain-like 1 (CLTCL1), transcript | 21 |

Figure 11A

| Figure 11A | | | | |
|---|---|---|---|---|
| RefSeq Gene Symbol(s) | Exon overlap | RefSeq Accession Number | mRNA Description | SEQ ID |
| | c | 35 | variant 2, mRNA. | 7 |
| CLTCL1 | exonic | NM_007098 | Homo sapiens clathrin, heavy chain-like 1 (CLTCL1), transcript variant 1, mRNA. | 218 |
| PTPRT | intronic | NM_007050 | Homo sapiens protein tyrosine phosphatase, receptor type, T (PTPRT), transcript variant 2, mRNA. | 219 |
| PTPRT | intronic | NM_133170 | Homo sapiens protein tyrosine phosphatase, receptor type, T (PTPRT), transcript variant 1, mRNA. | 220 |
| YWHAB | exonic | NM_003404 | Homo sapiens tyrosine 3-monooxygenase/tryptophan 5-monooxygenase activation protein, beta polypeptide (YWHAB), transcript variant 1, mRNA. | 221 |
| YWHAB | exonic | NM_139323 | Homo sapiens tyrosine 3-monooxygenase/tryptophan 5-monooxygenase activation protein, beta polypeptide (YWHAB), transcript variant 2, mRNA. | 222 |
| PABPC1L | exonic | NM_001124756 | Homo sapiens poly(A) binding protein, cytoplasmic 1-like (PABPC1L), mRNA. | 223 |
| TOMM34 | exonic | NM_006809 | Homo sapiens translocase of outer mitochondrial membrane 34 (TOMM34), mRNA. | 224 |
| STK4-AS1 | exonic | NR_038341 | Homo sapiens STK4 antisense RNA 1 (head to head) (STK4-AS1), non-coding RNA. | 225 |
| STK4 | exonic | NM_006282 | Homo sapiens serine/threonine kinase 4 (STK4), mRNA. | 226 |
| SGCZ | both | NM_139167 | Homo sapiens sarcoglycan, zeta (SGCZ), mRNA. | 227 |
| ANKRD11 | both | NM_001256182 | Homo sapiens ankyrin repeat domain 11 (ANKRD11), transcript variant 1, mRNA. | 228 |
| ANKRD11 | both | NM_001256183 | Homo sapiens ankyrin repeat domain 11 (ANKRD11), transcript variant 3, mRNA. | 229 |
| ANKRD11 | both | NM_013275 | Homo sapiens ankyrin repeat domain 11 (ANKRD11), transcript variant 2, mRNA. | 230 |
| ANKRD11 | intronic | NR_045839 | Homo sapiens ankyrin repeat domain 11 (ANKRD11), transcript variant 4, non-coding RNA. | 231 |
| JAKMIP2 | exonic | NM_001270934 | Homo sapiens janus kinase and microtubule interacting protein 2 (JAKMIP2), transcript variant 2, mRNA. | 232 |
| JAKMIP2 | exonic | NM_001270941 | Homo sapiens janus kinase and microtubule interacting protein 2 (JAKMIP2), transcript variant 1, mRNA. | 233 |
| JAKMIP2 | exonic | NM_014790 | Homo sapiens janus kinase and microtubule interacting protein 2 (JAKMIP2), transcript variant 3, mRNA. | 234 |
| JAKMIP2 | exonic | NR_073101 | Homo sapiens janus kinase and microtubule interacting protein 2 (JAKMIP2), transcript variant 4, non-coding RNA. | 235 |
| SPINK1 | exonic | NM_003122 | Homo sapiens serine peptidase inhibitor, Kazal type 1 (SPINK1), mRNA. | 236 |
| SCGB3A2 | exonic | NM_054023 | Homo sapiens secretoglobin, family 3A, member 2 (SCGB3A2), mRNA. | 237 |
| C5orf46 | exonic | NM_2069 | Homo sapiens chromosome 5 open reading frame 46 (C5orf46), | 23 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 66 | mRNA. | 8 |
| MYO1B | exonic | NM_0011 30158 | Homo sapiens myosin IB (MYO1B), transcript variant 1, mRNA. | 239 |
| MYO1B | exonic | NM_0122 23 | Homo sapiens myosin IB (MYO1B), transcript variant 2, mRNA. | 240 |
| MYO1B | exonic | NM_0011 61819 | Homo sapiens myosin IB (MYO1B), transcript variant 3, mRNA. | 241 |
| IQGAP2 | intronic | NM_0066 33 | Homo sapiens IQ motif containing GTPase activating protein 2 (IQGAP2), mRNA. | 242 |
| DLGAP1 | intronic | NM_0010 03809 | Homo sapiens discs, large (Drosophila) homolog-associated protein 1 (DLGAP1), transcript variant 2, mRNA. | 243 |
| DLGAP1 | intronic | NM_0012 42766 | Homo sapiens discs, large (Drosophila) homolog-associated protein 1 (DLGAP1), transcript variant 8, mRNA. | 244 |
| DLGAP1 | intronic | NM_0012 42764 | Homo sapiens discs, large (Drosophila) homolog-associated protein 1 (DLGAP1), transcript variant 6, mRNA. | 245 |
| DLGAP1 | intronic | NM_0012 42762 | Homo sapiens discs, large (Drosophila) homolog-associated protein 1 (DLGAP1), transcript variant 4, mRNA. | 246 |
| DLGAP1 | intronic | NM_0012 42763 | Homo sapiens discs, large (Drosophila) homolog-associated protein 1 (DLGAP1), transcript variant 5, mRNA. | 247 |
| DLGAP1 | intronic | NM_0047 46 | Homo sapiens discs, large (Drosophila) homolog-associated protein 1 (DLGAP1), transcript variant 1, mRNA. | 248 |
| DLGAP1 | intronic | NM_0012 42765 | Homo sapiens discs, large (Drosophila) homolog-associated protein 1 (DLGAP1), transcript variant 7, mRNA. | 249 |
| DLGAP1 | intronic | NM_0012 42761 | Homo sapiens discs, large (Drosophila) homolog-associated protein 1 (DLGAP1), transcript variant 3, mRNA. | 250 |
| DLGAP5 | exonic | NM_0011 46015 | Homo sapiens discs, large (Drosophila) homolog-associated protein 5 (DLGAP5), transcript variant 2, mRNA. | 251 |
| DLGAP5 | exonic | NM_0147 50 | Homo sapiens discs, large (Drosophila) homolog-associated protein 5 (DLGAP5), transcript variant 1, mRNA. | 252 |
| CNTN6 | exonic | NM_0144 61 | Homo sapiens contactin 6 (CNTN6), mRNA. | 253 |
| CALCRL | intronic | NM_0012 71751 | Homo sapiens calcitonin receptor-like (CALCRL), transcript variant 2, mRNA. | 254 |
| CALCRL | intronic | NM_0057 95 | Homo sapiens calcitonin receptor-like (CALCRL), transcript variant 1, mRNA. | 255 |
| JPH3 | intronic | NR_07337 9 | Homo sapiens junctophilin 3 (JPH3), transcript variant 4, non-coding RNA. | 256 |
| JPH3 | intronic | NM_0206 55 | Homo sapiens junctophilin 3 (JPH3), transcript variant 1, mRNA. | 257 |
| JPH3 | intronic | NM_0012 71604 | Homo sapiens junctophilin 3 (JPH3), transcript variant 2, mRNA. | 258 |
| JPH3 | intronic | NM_0012 71605 | Homo sapiens junctophilin 3 (JPH3), transcript variant 3, mRNA. | 259 |
| PDE4D | exonic | NM_0062 | Homo sapiens phosphodiesterase 4D, cAMP-specific (PDE4D), | 26 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 03 | transcript variant 2, mRNA. | 0 |
| PDE4D | intronic | NM_001197218 | Homo sapiens phosphodiesterase 4D, cAMP-specific (PDE4D), transcript variant 4, mRNA. | 261 |
| PDE4D | intronic | NM_001104631 | Homo sapiens phosphodiesterase 4D, cAMP-specific (PDE4D), transcript variant 1, mRNA. | 262 |
| PDE4D | intronic | NM_001165899 | Homo sapiens phosphodiesterase 4D, cAMP-specific (PDE4D), transcript variant 3, mRNA. | 263 |
| PDE4D | intronic | NM_001197223 | Homo sapiens phosphodiesterase 4D, cAMP-specific (PDE4D), transcript variant 9, mRNA. | 264 |
| PDE4D | intronic | NM_001197221 | Homo sapiens phosphodiesterase 4D, cAMP-specific (PDE4D), transcript variant 7, mRNA. | 265 |
| PDE4D | intronic | NM_001197222 | Homo sapiens phosphodiesterase 4D, cAMP-specific (PDE4D), transcript variant 8, mRNA. | 266 |
| PDE4D | intronic | NM_001197220 | Homo sapiens phosphodiesterase 4D, cAMP-specific (PDE4D), transcript variant 6, mRNA. | 267 |
| PDE4D | intronic | NM_001197219 | Homo sapiens phosphodiesterase 4D, cAMP-specific (PDE4D), transcript variant 5, mRNA. | 268 |
| SCARB1 | intronic | NM_001082959 | Homo sapiens scavenger receptor class B, member 1 (SCARB1), transcript variant 2, mRNA. | 269 |
| SCARB1 | intronic | NM_005505 | Homo sapiens scavenger receptor class B, member 1 (SCARB1), transcript variant 1, mRNA. | 270 |
| EXOC4 | exonic | NM_021807 | Homo sapiens exocyst complex component 4 (EXOC4), transcript variant 1, mRNA. | 271 |
| EXOC4 | intronic | NM_001037126 | Homo sapiens exocyst complex component 4 (EXOC4), transcript variant 2, mRNA. | 272 |
| GRM1 | intronic | NM_000838 | Homo sapiens glutamate receptor, metabotropic 1 (GRM1), transcript variant 1, mRNA. | 273 |
| GRM1 | intronic | NM_001114329 | Homo sapiens glutamate receptor, metabotropic 1 (GRM1), transcript variant 2, mRNA. | 274 |
| GRIP1 | exonic | NM_001178074 | Homo sapiens glutamate receptor interacting protein 1 (GRIP1), transcript variant 2, mRNA. | 275 |
| GRIP1 | exonic | NM_021150 | Homo sapiens glutamate receptor interacting protein 1 (GRIP1), transcript variant 1, mRNA. | 276 |
| PDE3B | exonic | NM_000922 | Homo sapiens phosphodiesterase 3B, cGMP-inhibited (PDE3B), mRNA. | 277 |
| CYP2R1 | exonic | NM_024514 | Homo sapiens cytochrome P450, family 2, subfamily R, polypeptide 1 (CYP2R1), mRNA. | 278 |
| CTNNA3 | both | NM_001127384 | Homo sapiens catenin (cadherin-associated protein), alpha 3 (CTNNA3), transcript variant 2, mRNA. | 279 |
| CTNNA3 | both | NM_013266 | Homo sapiens catenin (cadherin-associated protein), alpha 3 (CTNNA3), transcript variant 1, mRNA. | 280 |
| CREM | exonic | NM_001881 | Homo sapiens cAMP responsive element modulator (CREM), transcript variant 2, mRNA. | 281 |
| CREM | exonic | NM_0012 | Homo sapiens cAMP responsive element modulator (CREM), | 28 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 67562 | transcript variant 23, mRNA. | 2 |
| CREM | intronic | NM_001267563 | Homo sapiens cAMP responsive element modulator (CREM), transcript variant 24, mRNA. | 283 |
| CREM | exonic | NM_183013 | Homo sapiens cAMP responsive element modulator (CREM), transcript variant 19, mRNA. | 284 |
| CREM | intronic | NR_051973 | Homo sapiens cAMP responsive element modulator (CREM), transcript variant 17, non-coding RNA. | 285 |
| CREM | intronic | NR_051974 | Homo sapiens cAMP responsive element modulator (CREM), transcript variant 18, non-coding RNA. | 286 |
| CREM | exonic | NR_051975 | Homo sapiens cAMP responsive element modulator (CREM), transcript variant 32, non-coding RNA. | 287 |
| CREM | exonic | NM_181571 | Homo sapiens cAMP responsive element modulator (CREM), transcript variant 1, mRNA. | 288 |
| CREM | exonic | NM_183060 | Homo sapiens cAMP responsive element modulator (CREM), transcript variant 22, mRNA. | 289 |
| CREM | exonic | NM_183011 | Homo sapiens cAMP responsive element modulator (CREM), transcript variant 21, mRNA. | 290 |
| CREM | exonic | NM_183012 | Homo sapiens cAMP responsive element modulator (CREM), transcript variant 20, mRNA. | 291 |
| CREM | intronic | NM_001267565 | Homo sapiens cAMP responsive element modulator (CREM), transcript variant 26, mRNA. | 292 |
| CREM | intronic | NM_001267564 | Homo sapiens cAMP responsive element modulator (CREM), transcript variant 25, mRNA. | 293 |
| CREM | intronic | NM_182771 | Homo sapiens cAMP responsive element modulator (CREM), transcript variant 15, mRNA. | 294 |
| CREM | intronic | NM_182772 | Homo sapiens cAMP responsive element modulator (CREM), transcript variant 16, mRNA. | 295 |
| CREM | intronic | NM_001267566 | Homo sapiens cAMP responsive element modulator (CREM), transcript variant 27, mRNA. | 296 |
| CREM | intronic | NM_001267567 | Homo sapiens cAMP responsive element modulator (CREM), transcript variant 28, mRNA. | 297 |
| CREM | intronic | NM_182769 | Homo sapiens cAMP responsive element modulator (CREM), transcript variant 13, mRNA. | 298 |
| CREM | intronic | NM_182770 | Homo sapiens cAMP responsive element modulator (CREM), transcript variant 14, mRNA. | 299 |
| CREM | intronic | NM_001267568 | Homo sapiens cAMP responsive element modulator (CREM), transcript variant 29, mRNA. | 300 |
| CREM | intronic | NM_001267569 | Homo sapiens cAMP responsive element modulator (CREM), transcript variant 30, mRNA. | 301 |
| CREM | intronic | NM_182717 | Homo sapiens cAMP responsive element modulator (CREM), transcript variant 4, mRNA. | 302 |
| CREM | intronic | NM_182718 | Homo sapiens cAMP responsive element modulator (CREM), transcript variant 5, mRNA. | 303 |
| CREM | intronic | NM_1827 | Homo sapiens cAMP responsive element modulator (CREM), | 30 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | intronic | 19 | transcript variant 6, mRNA. | 4 |
| CREM | intronic | NM_182720 | Homo sapiens cAMP responsive element modulator (CREM), transcript variant 7, mRNA. | 305 |
| CREM | intronic | NM_001267570 | Homo sapiens cAMP responsive element modulator (CREM), transcript variant 31, mRNA. | 306 |
| CREM | intronic | NM_182721 | Homo sapiens cAMP responsive element modulator (CREM), transcript variant 8, mRNA. | 307 |
| CREM | intronic | NM_182723 | Homo sapiens cAMP responsive element modulator (CREM), transcript variant 10, mRNA. | 308 |
| CREM | intronic | NM_182724 | Homo sapiens cAMP responsive element modulator (CREM), transcript variant 11, mRNA. | 309 |
| CREM | intronic | NR_051971 | Homo sapiens cAMP responsive element modulator (CREM), transcript variant 9, non-coding RNA. | 310 |
| CREM | intronic | NR_051972 | Homo sapiens cAMP responsive element modulator (CREM), transcript variant 12, non-coding RNA. | 311 |
| CUL2 | exonic | NM_001198778 | Homo sapiens cullin 2 (CUL2), transcript variant 1, mRNA. | 312 |
| CUL2 | exonic | NM_001198779 | Homo sapiens cullin 2 (CUL2), transcript variant 2, mRNA. | 313 |
| CUL2 | exonic | NM_003591 | Homo sapiens cullin 2 (CUL2), transcript variant 3, mRNA. | 314 |
| CUL2 | exonic | NM_001198777 | Homo sapiens cullin 2 (CUL2), transcript variant 4, mRNA. | 315 |
| KCNN2 | intronic | NM_021614 | Homo sapiens potassium intermediate/small conductance calcium-activated channel, subfamily N, member 2 (KCNN2), transcript variant 1, mRNA. | 316 |
| KCNN2 | intronic | NM_170775 | Homo sapiens potassium intermediate/small conductance calcium-activated channel, subfamily N, member 2 (KCNN2), transcript variant 2, mRNA. | 317 |
| GPR39 | intronic | NM_001508 | Homo sapiens G protein-coupled receptor 39 (GPR39), mRNA. | 318 |
| CBR3-AS1 | exonic | NR_038892 | Homo sapiens CBR3 antisense RNA 1 (CBR3-AS1), transcript variant 1, non-coding RNA. | 319 |
| CBR3-AS1 | exonic | NR_038893 | Homo sapiens CBR3 antisense RNA 1 (CBR3-AS1), transcript variant 2, non-coding RNA. | 320 |
| CBR3 | exonic | NM_001236 | Homo sapiens carbonyl reductase 3 (CBR3), mRNA. | 321 |
| CBR3-AS1 | exonic | NR_038894 | Homo sapiens CBR3 antisense RNA 1 (CBR3-AS1), transcript variant 3, non-coding RNA. | 322 |
| DOPEY2 | exonic | NM_005128 | Homo sapiens dopey family member 2 (DOPEY2), mRNA. | 323 |
| DPY19L2P4 | exonic | NR_003551 | Homo sapiens dpy-19-like 2 pseudogene 4 (C. elegans) (DPY19L2P4), non-coding RNA. | 324 |
| STEAP1 | exonic | NM_0124 | Homo sapiens six transmembrane epithelial antigen of the | 32 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 49 | prostate 1 (STEAP1), mRNA. | 5 |
| STEAP2 | exonic | NM_001244944 | Homo sapiens STEAP family member 2, metalloreductase (STEAP2), transcript variant 4, mRNA. | 326 |
| STEAP2 | exonic | NM_001244945 | Homo sapiens STEAP family member 2, metalloreductase (STEAP2), transcript variant 5, mRNA. | 327 |
| STEAP2 | exonic | NM_152999 | Homo sapiens STEAP family member 2, metalloreductase (STEAP2), transcript variant 1, mRNA. | 328 |
| STEAP2 | exonic | NM_001040665 | Homo sapiens STEAP family member 2, metalloreductase (STEAP2), transcript variant 2, mRNA. | 329 |
| STEAP2 | exonic | NM_001244946 | Homo sapiens STEAP family member 2, metalloreductase (STEAP2), transcript variant 6, mRNA. | 330 |
| STEAP2 | exonic | NM_001040666 | Homo sapiens STEAP family member 2, metalloreductase (STEAP2), transcript variant 3, mRNA. | 331 |
| C7orf63 | exonic | NM_001039706 | Homo sapiens chromosome 7 open reading frame 63 (C7orf63), transcript variant 1, mRNA. | 332 |
| C7orf63 | exonic | NM_001160138 | Homo sapiens chromosome 7 open reading frame 63 (C7orf63), transcript variant 2, mRNA. | 333 |
| CDK14 | both | NM_012395 | Homo sapiens cyclin-dependent kinase 14 (CDK14), mRNA. | 334 |
| RGS13 | exonic | NM_002927 | Homo sapiens regulator of G-protein signaling 13 (RGS13), transcript variant 1, mRNA. | 335 |
| RGS13 | exonic | NM_144766 | Homo sapiens regulator of G-protein signaling 13 (RGS13), transcript variant 2, mRNA. | 336 |
| NAV3 | intronic | NM_014903 | Homo sapiens neuron navigator 3 (NAV3), mRNA. | 337 |
| CDH2 | both | NM_001792 | Homo sapiens cadherin 2, type 1, N-cadherin (neuronal) (CDH2), mRNA. | 338 |
| SUPT3H | intronic | NM_001261823 | Homo sapiens suppressor of Ty 3 homolog (S. cerevisiae) (SUPT3H), transcript variant 3, mRNA. | 339 |
| SUPT3H | intronic | NM_003599 | Homo sapiens suppressor of Ty 3 homolog (S. cerevisiae) (SUPT3H), transcript variant 1, mRNA. | 340 |
| SUPT3H | intronic | NM_181356 | Homo sapiens suppressor of Ty 3 homolog (S. cerevisiae) (SUPT3H), transcript variant 2, mRNA. | 341 |
| SMEK2 | exonic | NM_001122964 | Homo sapiens SMEK homolog 2, suppressor of mek1 (Dictyostelium) (SMEK2), transcript variant 1, mRNA. | 342 |
| SMEK2 | exonic | NM_020463 | Homo sapiens SMEK homolog 2, suppressor of mek1 (Dictyostelium) (SMEK2), transcript variant 2, mRNA. | 343 |
| SP4 | exonic | NM_003112 | Homo sapiens Sp4 transcription factor (SP4), mRNA. | 344 |
| DNAH11 | exonic | NM_001277115 | Homo sapiens dynein, axonemal, heavy chain 11 (DNAH11), mRNA. | 345 |
| CDCA7L | exonic | NM_001127370 | Homo sapiens cell division cycle associated 7-like (CDCA7L), transcript variant 2, mRNA. | 346 |
| CDCA7L | exonic | NM_0011 | Homo sapiens cell division cycle associated 7-like (CDCA7L), | 34 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 27371 | transcript variant 3, mRNA. | 7 |
| CDCA7L | exonic | NM_018719 | Homo sapiens cell division cycle associated 7-like (CDCA7L), transcript variant 1, mRNA. | 348 |
| GLRA3 | both | NM_001042543 | Homo sapiens glycine receptor, alpha 3 (GLRA3), transcript variant 2, mRNA. | 349 |
| GLRA3 | both | NM_006529 | Homo sapiens glycine receptor, alpha 3 (GLRA3), transcript variant 1, mRNA. | 350 |
| ADAM29 | exonic | NM_001130703 | Homo sapiens ADAM metallopeptidase domain 29 (ADAM29), transcript variant 2, mRNA. | 351 |
| ADAM29 | exonic | NM_001130704 | Homo sapiens ADAM metallopeptidase domain 29 (ADAM29), transcript variant 3, mRNA. | 352 |
| ADAM29 | exonic | NM_001130705 | Homo sapiens ADAM metallopeptidase domain 29 (ADAM29), transcript variant 4, mRNA. | 353 |
| ADAM29 | exonic | NM_014269 | Homo sapiens ADAM metallopeptidase domain 29 (ADAM29), transcript variant 1, mRNA. | 354 |
| PACRGL | exonic | NM_001130727 | Homo sapiens PARK2 co-regulated-like (PACRGL), transcript variant 2, mRNA. | 355 |
| PACRGL | exonic | NM_001258345 | Homo sapiens PARK2 co-regulated-like (PACRGL), transcript variant 3, mRNA. | 356 |
| PACRGL | exonic | NM_001258346 | Homo sapiens PARK2 co-regulated-like (PACRGL), transcript variant 4, mRNA. | 357 |
| PACRGL | exonic | NM_145048 | Homo sapiens PARK2 co-regulated-like (PACRGL), transcript variant 1, mRNA. | 358 |
| PACRGL | exonic | NR_047661 | Homo sapiens PARK2 co-regulated-like (PACRGL), transcript variant 5, non-coding RNA. | 359 |
| KCNIP4 | exonic | NM_147181 | Homo sapiens Kv channel interacting protein 4 (KCNIP4), transcript variant 2, mRNA. | 360 |
| KCNIP4 | exonic | NM_025221 | Homo sapiens Kv channel interacting protein 4 (KCNIP4), transcript variant 1, mRNA. | 361 |
| KCNIP4 | exonic | NM_147183 | Homo sapiens Kv channel interacting protein 4 (KCNIP4), transcript variant 4, mRNA. | 362 |
| KCNIP4 | exonic | NM_001035004 | Homo sapiens Kv channel interacting protein 4 (KCNIP4), transcript variant 6, mRNA. | 363 |
| KCNIP4 | both | NM_001035003 | Homo sapiens Kv channel interacting protein 4 (KCNIP4), transcript variant 5, mRNA. | 364 |
| KCNIP4 | both | NM_147182 | Homo sapiens Kv channel interacting protein 4 (KCNIP4), transcript variant 3, mRNA. | 365 |
| PACRG | both | NM_001080378 | Homo sapiens PARK2 co-regulated (PACRG), transcript variant 2, mRNA. | 366 |
| PACRG | both | NM_152410 | Homo sapiens PARK2 co-regulated (PACRG), transcript variant 1, mRNA. | 367 |
| PACRG | both | NM_001080379 | Homo sapiens PARK2 co-regulated (PACRG), transcript variant 3, mRNA. | 368 |
| RAB27A | intro | NM_1832 | Homo sapiens RAB27A, member RAS oncogene family | 36 |

| RefSeq Gene Symbol(s) | Exon overlap | RefSeq Accession Number | mRNA Description | SEQ ID |
|---|---|---|---|---|
|  | intronic | 34 | (RAB27A), transcript variant 2, mRNA. | 9 |
| RAB27A | intronic | NM_004580 | Homo sapiens RAB27A, member RAS oncogene family (RAB27A), transcript variant 1, mRNA. | 370 |
| RAB27A | intronic | NM_183236 | Homo sapiens RAB27A, member RAS oncogene family (RAB27A), transcript variant 4, mRNA. | 371 |
| RAB27A | intronic | NM_183235 | Homo sapiens RAB27A, member RAS oncogene family (RAB27A), transcript variant 3, mRNA. | 372 |
| ERCC8 | exonic | NM_000082 | Homo sapiens excision repair cross-complementing rodent repair deficiency, complementation group 8 (ERCC8), mRNA. | 373 |
| NDUFAF2 | both | NM_174889 | Homo sapiens NADH dehydrogenase (ubiquinone) complex I, assembly factor 2 (NDUFAF2), mRNA. | 374 |
| NUP54 | exonic | NM_017426 | Homo sapiens nucleoporin 54kDa (NUP54), transcript variant 1, mRNA. | 375 |
| SCARB2 | exonic | NM_001204255 | Homo sapiens scavenger receptor class B, member 2 (SCARB2), transcript variant 2, mRNA. | 376 |
| SCARB2 | exonic | NM_005506 | Homo sapiens scavenger receptor class B, member 2 (SCARB2), transcript variant 1, mRNA. | 377 |
| PSAP | exonic | NM_001042465 | Homo sapiens prosaposin (PSAP), transcript variant 2, mRNA. | 378 |
| PSAP | exonic | NM_001042466 | Homo sapiens prosaposin (PSAP), transcript variant 3, mRNA. | 379 |
| PSAP | exonic | NM_002778 | Homo sapiens prosaposin (PSAP), transcript variant 1, mRNA. | 380 |
| CHST3 | exonic | NM_004273 | Homo sapiens carbohydrate (chondroitin 6) sulfotransferase 3 (CHST3), mRNA. | 381 |
| LOC440905 | exonic | NR_026758 | Homo sapiens uncharacterized LOC440905 (LOC440905), non-coding RNA. | 382 |
| POTEF | exonic | NM_001099771 | Homo sapiens POTE ankyrin domain family, member F (POTEF), mRNA. | 383 |
| CCDC74B-AS1 | exonic | NR_033903 | Homo sapiens mediator complex subunit 15 pseudogene 9 (MED15P9), non-coding RNA. | 384 |
| CCDC74B | exonic | NM_001258307 | Homo sapiens coiled-coil domain containing 74B (CCDC74B), transcript variant 2, mRNA. | 385 |
| CCDC74B | exonic | NM_207310 | Homo sapiens coiled-coil domain containing 74B (CCDC74B), transcript variant 1, mRNA. | 386 |
| SMPD4 | exonic | NM_001171083 | Homo sapiens sphingomyelin phosphodiesterase 4, neutral membrane (neutral sphingomyelinase-3) (SMPD4), transcript variant 3, mRNA. | 387 |
| SMPD4 | exonic | NM_017751 | Homo sapiens sphingomyelin phosphodiesterase 4, neutral membrane (neutral sphingomyelinase-3) (SMPD4), transcript variant 1, mRNA. | 388 |
| SMPD4 | exonic | NM_017951 | Homo sapiens sphingomyelin phosphodiesterase 4, neutral membrane (neutral sphingomyelinase-3) (SMPD4), transcript variant 2, mRNA. | 389 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| SMPD4 | exonic | NR_033231 | Homo sapiens sphingomyelin phosphodiesterase 4, neutral membrane (neutral sphingomyelinase-3) (SMPD4), transcript variant 5, non-coding RNA. | 390 |
| SMPD4 | exonic | NR_033232 | Homo sapiens sphingomyelin phosphodiesterase 4, neutral membrane (neutral sphingomyelinase-3) (SMPD4), transcript variant 6, non-coding RNA. | 391 |
| SMPD4 | exonic | NR_033230 | Homo sapiens sphingomyelin phosphodiesterase 4, neutral membrane (neutral sphingomyelinase-3) (SMPD4), transcript variant 7, non-coding RNA. | 392 |
| ARSB | intronic | NM_000046 | Homo sapiens arylsulfatase B (ARSB), transcript variant 1, mRNA. | 393 |
| ARSB | intronic | NM_198709 | Homo sapiens arylsulfatase B (ARSB), transcript variant 2, mRNA. | 394 |
| PLA2G6 | exonic | NM_001004426 | Homo sapiens phospholipase A2, group VI (cytosolic, calcium-independent) (PLA2G6), transcript variant 2, mRNA. | 395 |
| PLA2G6 | exonic | NM_003560 | Homo sapiens phospholipase A2, group VI (cytosolic, calcium-independent) (PLA2G6), transcript variant 1, mRNA. | 396 |
| PLA2G6 | exonic | NM_001199562 | Homo sapiens phospholipase A2, group VI (cytosolic, calcium-independent) (PLA2G6), transcript variant 3, mRNA. | 397 |
| HM13 | exonic | NM_030789 | Homo sapiens histocompatibility (minor) 13 (HM13), transcript variant 1, mRNA. | 398 |
| HM13 | exonic | NM_178580 | Homo sapiens histocompatibility (minor) 13 (HM13), transcript variant 2, mRNA. | 399 |
| HM13 | exonic | NM_178581 | Homo sapiens histocompatibility (minor) 13 (HM13), transcript variant 3, mRNA. | 400 |
| HM13-AS1 | exonic | NR_046853 | Homo sapiens HM13 antisense RNA 1 (HM13-AS1), non-coding RNA. | 401 |
| ID1 | exonic | NM_002165 | Homo sapiens inhibitor of DNA binding 1, dominant negative helix-loop-helix protein (ID1), transcript variant 1, mRNA. | 402 |
| ID1 | exonic | NM_181353 | Homo sapiens inhibitor of DNA binding 1, dominant negative helix-loop-helix protein (ID1), transcript variant 2, mRNA. | 403 |
| MIR3193 | exonic | NR_036161 | Homo sapiens microRNA 3193 (MIR3193), microRNA. | 404 |
| COX4I2 | exonic | NM_032609 | Homo sapiens cytochrome c oxidase subunit IV isoform 2 (lung) (COX4I2), mRNA. | 405 |
| BCL2L1 | exonic | NM_001191 | Homo sapiens BCL2-like 1 (BCL2L1), transcript variant 2, mRNA. | 406 |
| BCL2L1 | exonic | NM_138578 | Homo sapiens BCL2-like 1 (BCL2L1), transcript variant 1, mRNA. | 407 |
| HM13 | intronic | NM_178582 | Homo sapiens histocompatibility (minor) 13 (HM13), transcript variant 4, mRNA. | 408 |
| GALNS | exonic | NM_000512 | Homo sapiens galactosamine (N-acetyl)-6-sulfate sulfatase (GALNS), mRNA. | 409 |
| TRAPPC2L | exonic | NM_016209 | Homo sapiens trafficking protein particle complex 2-like (TRAPPC2L), mRNA. | 410 |

| RefSeq Gene Symbol(s) | Exon overlap | RefSeq Accession Number | mRNA Description | SEQ ID |
|---|---|---|---|---|
| PABPN1L | exonic | NM_001080487 | Homo sapiens poly(A) binding protein, nuclear 1-like (cytoplasmic) (PABPN1L), mRNA. | 411 |
| CBFA2T3 | exonic | NM_175931 | Homo sapiens core-binding factor, runt domain, alpha subunit 2; translocated to, 3 (CBFA2T3), transcript variant 2, mRNA. | 412 |
| CBFA2T3 | exonic | NM_005187 | Homo sapiens core-binding factor, runt domain, alpha subunit 2; translocated to, 3 (CBFA2T3), transcript variant 1, mRNA. | 413 |
| NQO1 | exonic | NM_000903 | Homo sapiens NAD(P)H dehydrogenase, quinone 1 (NQO1), transcript variant 1, mRNA. | 414 |
| NQO1 | exonic | NM_001025433 | Homo sapiens NAD(P)H dehydrogenase, quinone 1 (NQO1), transcript variant 2, mRNA. | 415 |
| NQO1 | exonic | NM_001025434 | Homo sapiens NAD(P)H dehydrogenase, quinone 1 (NQO1), transcript variant 3, mRNA. | 416 |
| FAM180B | exonic | NM_001164379 | Homo sapiens family with sequence similarity 180, member B (FAM180B), mRNA. | 417 |
| C1QTNF4 | exonic | NM_031909 | Homo sapiens C1q and tumor necrosis factor related protein 4 (C1QTNF4), mRNA. | 418 |
| MTCH2 | exonic | NM_014342 | Homo sapiens mitochondrial carrier 2 (MTCH2), mRNA. | 419 |
| NDUFS4 | intronic | NM_002495 | Homo sapiens NADH dehydrogenase (ubiquinone) Fe-S protein 4, 18kDa (NADH-coenzyme Q reductase) (NDUFS4), mRNA. | 420 |
| PIP5K1B | exonic | NM_003558 | Homo sapiens phosphatidylinositol-4-phosphate 5-kinase, type I, beta (PIP5K1B), transcript variant 2, mRNA. | 421 |
| PRKACG | exonic | NM_002732 | Homo sapiens protein kinase, cAMP-dependent, catalytic, gamma (PRKACG), mRNA. | 422 |
| FXN | exonic | NM_000144 | Homo sapiens frataxin (FXN), transcript variant 1, mRNA. | 423 |
| FXN | exonic | NM_181425 | Homo sapiens frataxin (FXN), transcript variant 2, mRNA. | 424 |
| FXN | exonic | NM_001161706 | Homo sapiens frataxin (FXN), transcript variant 3, mRNA. | 425 |
| TJP2 | exonic | NM_001170414 | Homo sapiens tight junction protein 2 (TJP2), transcript variant 5, mRNA. | 426 |
| TJP2 | intronic | NM_001170630 | Homo sapiens tight junction protein 2 (TJP2), transcript variant 6, mRNA. | 427 |
| TJP2 | intronic | NM_004817 | Homo sapiens tight junction protein 2 (TJP2), transcript variant 1, mRNA. | 428 |
| TJP2 | intronic | NM_201629 | Homo sapiens tight junction protein 2 (TJP2), transcript variant 2, mRNA. | 429 |
| TJP2 | intronic | NM_001170415 | Homo sapiens tight junction protein 2 (TJP2), transcript variant 4, mRNA. | 430 |
| TJP2 | intronic | NM_001170416 | Homo sapiens tight junction protein 2 (TJP2), transcript variant 3, mRNA. | 431 |
| GFRA3 | exonic | NM_001496 | Homo sapiens GDNF family receptor alpha 3 (GFRA3), mRNA. | 432 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| CDC25C | exonic | NM_001790 | Homo sapiens cell division cycle 25C (CDC25C), transcript variant 1, mRNA. | 433 |
| CDC25C | exonic | NM_022809 | Homo sapiens cell division cycle 25C (CDC25C), transcript variant 2, mRNA. | 434 |
| GRIA3 | exonic | NM_000828 | Homo sapiens glutamate receptor, ionotropic, AMPA 3 (GRIA3), transcript variant 2, mRNA. | 435 |
| GRIA3 | exonic | NM_007325 | Homo sapiens glutamate receptor, ionotropic, AMPA 3 (GRIA3), transcript variant 1, mRNA. | 436 |
| GRIA3 | intronic | NM_001256743 | Homo sapiens glutamate receptor, ionotropic, AMPA 3 (GRIA3), transcript variant 3, mRNA. | 437 |
| GSTP1 | exonic | NM_000852 | Homo sapiens glutathione S-transferase pi 1 (GSTP1), mRNA. | 438 |
| NDUFV1 | exonic | NM_001166102 | Homo sapiens NADH dehydrogenase (ubiquinone) flavoprotein 1, 51kDa (NDUFV1), transcript variant 2, mRNA. | 439 |
| NDUFV1 | exonic | NM_007103 | Homo sapiens NADH dehydrogenase (ubiquinone) flavoprotein 1, 51kDa (NDUFV1), transcript variant 1, mRNA. | 440 |
| DOC2GP | exonic | NR_033791 | Homo sapiens double C2-like domains, gamma, pseudogene (DOC2GP), non-coding RNA. | 441 |
| NUDT8 | exonic | NM_181843 | Homo sapiens nudix (nucleoside diphosphate linked moiety X)-type motif 8 (NUDT8), transcript variant 2, mRNA. | 442 |
| NUDT8 | exonic | NM_001243750 | Homo sapiens nudix (nucleoside diphosphate linked moiety X)-type motif 8 (NUDT8), transcript variant 1, mRNA. | 443 |
| TBX10 | exonic | NM_005995 | Homo sapiens T-box 10 (TBX10), mRNA. | 444 |
| ACY3 | exonic | NM_080658 | Homo sapiens aspartoacylase (aminocyclase) 3 (ACY3), mRNA. | 445 |
| ALDH3B2 | exonic | NM_000695 | Homo sapiens aldehyde dehydrogenase 3 family, member B2 (ALDH3B2), transcript variant 1, mRNA. | 446 |
| ALDH3B2 | exonic | NM_001031615 | Homo sapiens aldehyde dehydrogenase 3 family, member B2 (ALDH3B2), transcript variant 2, mRNA. | 447 |
| FAM86C2P | exonic | NR_024249 | Homo sapiens family with sequence similarity 86, member C2, pseudogene (FAM86C2P), non-coding RNA. | 448 |
| HFE2 | exonic | NM_145277 | Homo sapiens hemochromatosis type 2 (juvenile) (HFE2), transcript variant b, mRNA. | 449 |
| HFE2 | exonic | NM_202004 | Homo sapiens hemochromatosis type 2 (juvenile) (HFE2), transcript variant c, mRNA. | 450 |
| HFE2 | exonic | NM_213652 | Homo sapiens hemochromatosis type 2 (juvenile) (HFE2), transcript variant d, mRNA. | 451 |
| HFE2 | exonic | NM_213653 | Homo sapiens hemochromatosis type 2 (juvenile) (HFE2), transcript variant a, mRNA. | 452 |
| TXNIP | exonic | NM_006472 | Homo sapiens thioredoxin interacting protein (TXNIP), mRNA. | 453 |
| POLR3GL | exonic | NM_032305 | Homo sapiens polymerase (RNA) III (DNA directed) polypeptide G (32kD)-like (POLR3GL), mRNA. | 454 |

| RefSeq Gene Symbol(s) | Exon overlap | RefSeq Accession Number | mRNA Description | SEQ ID |
|---|---|---|---|---|
| ANKRD34A | exonic | NM_001039888 | Homo sapiens ankyrin repeat domain 34A (ANKRD34A), mRNA. | 455 |
| LIX1L | exonic | NM_153713 | Homo sapiens Lix1 homolog (mouse)-like (LIX1L), mRNA. | 456 |
| RBM8A | exonic | NM_005105 | Homo sapiens RNA binding motif protein 8A (RBM8A), mRNA. | 457 |
| GNRHR2 | exonic | NR_002328 | Homo sapiens gonadotropin-releasing hormone (type 2) receptor 2 (GNRHR2), transcript variant 1, non-coding RNA. | 458 |
| PEX11B | exonic | NM_003846 | Homo sapiens peroxisomal biogenesis factor 11 beta (PEX11B), transcript variant 1, mRNA. | 459 |
| PEX11B | exonic | NR_073491 | Homo sapiens peroxisomal biogenesis factor 11 beta (PEX11B), transcript variant 3, non-coding RNA. | 460 |
| PEX11B | exonic | NR_073492 | Homo sapiens peroxisomal biogenesis factor 11 beta (PEX11B), transcript variant 4, non-coding RNA. | 461 |
| PEX11B | exonic | NM_001184795 | Homo sapiens peroxisomal biogenesis factor 11 beta (PEX11B), transcript variant 2, mRNA. | 462 |
| PEX11B | exonic | NR_073493 | Homo sapiens peroxisomal biogenesis factor 11 beta (PEX11B), transcript variant 5, non-coding RNA. | 463 |
| ITGA10 | exonic | NM_003637 | Homo sapiens integrin, alpha 10 (ITGA10), mRNA. | 464 |
| ANKRD35 | exonic | NM_144698 | Homo sapiens ankyrin repeat domain 35 (ANKRD35), transcript variant 1, mRNA. | 465 |
| PIAS3 | exonic | NM_006099 | Homo sapiens protein inhibitor of activated STAT, 3 (PIAS3), mRNA. | 466 |
| NUDT17 | exonic | NM_001012758 | Homo sapiens nudix (nucleoside diphosphate linked moiety X)-type motif 17 (NUDT17), mRNA. | 467 |
| POLR3C | exonic | NM_006468 | Homo sapiens polymerase (RNA) III (DNA directed) polypeptide C (62kD) (POLR3C), mRNA. | 468 |
| RNF115 | exonic | NM_014455 | Homo sapiens ring finger protein 115 (RNF115), mRNA. | 469 |
| PGLYRP4 | exonic | NM_020393 | Homo sapiens peptidoglycan recognition protein 4 (PGLYRP4), mRNA. | 470 |
| S100A9 | exonic | NM_002965 | Homo sapiens S100 calcium binding protein A9 (S100A9), mRNA. | 471 |
| S100A12 | exonic | NM_005621 | Homo sapiens S100 calcium binding protein A12 (S100A12), mRNA. | 472 |
| S100A8 | exonic | NM_002964 | Homo sapiens S100 calcium binding protein A8 (S100A8), mRNA. | 473 |
| S100A7A | exonic | NM_176823 | Homo sapiens S100 calcium binding protein A7A (S100A7A), mRNA. | 474 |
| S100A7L2 | exonic | NM_001045479 | Homo sapiens S100 calcium binding protein A7-like 2 (S100A7L2), mRNA. | 475 |
| S100A7 | exonic | NM_002963 | Homo sapiens S100 calcium binding protein A7 (S100A7), mRNA. | 476 |

| RefSeq Gene Symbol(s) | Exon overlap | RefSeq Accession Number | mRNA Description | SEQ ID |
|---|---|---|---|---|
| XDH | exonic | NM_000379 | Homo sapiens xanthine dehydrogenase (XDH), mRNA. | 477 |
| SRD5A2 | exonic | NM_000348 | Homo sapiens steroid-5-alpha-reductase, alpha polypeptide 2 (3-oxo-5 alpha-steroid delta 4-dehydrogenase alpha 2) (SRD5A2), mRNA. | 478 |
| RTN4 | exonic | NM_207521 | Homo sapiens reticulon 4 (RTN4), transcript variant 5, mRNA. | 479 |
| RTN4 | exonic | NM_020532 | Homo sapiens reticulon 4 (RTN4), transcript variant 1, mRNA. | 480 |
| RTN4 | intronic | NM_153828 | Homo sapiens reticulon 4 (RTN4), transcript variant 2, mRNA. | 481 |
| RTN4 | exonic | NM_207520 | Homo sapiens reticulon 4 (RTN4), transcript variant 4, mRNA. | 482 |
| RTN4 | intronic | NM_007008 | Homo sapiens reticulon 4 (RTN4), transcript variant 3, mRNA. | 483 |
| PRKAA1 | exonic | NM_006251 | Homo sapiens protein kinase, AMP-activated, alpha 1 catalytic subunit (PRKAA1), transcript variant 1, mRNA. | 484 |
| PRKAA1 | exonic | NM_206907 | Homo sapiens protein kinase, AMP-activated, alpha 1 catalytic subunit (PRKAA1), transcript variant 2, mRNA. | 485 |
| LOC100506548 | exonic | NR_037665 | Homo sapiens uncharacterized LOC100506548 (LOC100506548), non-coding RNA. | 486 |
| RPL37 | exonic | NM_000997 | Homo sapiens ribosomal protein L37 (RPL37), mRNA. | 487 |
| SNORD72 | exonic | NR_002583 | Homo sapiens small nucleolar RNA, C/D box 72 (SNORD72), small nucleolar RNA. | 488 |
| CARD6 | exonic | NM_032587 | Homo sapiens caspase recruitment domain family, member 6 (CARD6), mRNA. | 489 |
| PRKAG2 | intronic | NM_001040633 | Homo sapiens protein kinase, AMP-activated, gamma 2 non-catalytic subunit (PRKAG2), transcript variant c, mRNA. | 490 |
| PRKAG2 | intronic | NM_016203 | Homo sapiens protein kinase, AMP-activated, gamma 2 non-catalytic subunit (PRKAG2), transcript variant a, mRNA. | 491 |
| PRKAG2 | intronic | NM_024429 | Homo sapiens protein kinase, AMP-activated, gamma 2 non-catalytic subunit (PRKAG2), transcript variant b, mRNA. | 492 |
| CSAD | exonic | NM_001244706 | Homo sapiens cysteine sulfinic acid decarboxylase (CSAD), transcript variant 3, mRNA. | 493 |
| CSAD | exonic | NM_015989 | Homo sapiens cysteine sulfinic acid decarboxylase (CSAD), transcript variant 1, mRNA. | 494 |
| CSAD | exonic | NM_001244705 | Homo sapiens cysteine sulfinic acid decarboxylase (CSAD), transcript variant 2, mRNA. | 495 |
| ZNF740 | exonic | NM_001004304 | Homo sapiens zinc finger protein 740 (ZNF740), mRNA. | 496 |
| ITGB7 | exonic | NM_000889 | Homo sapiens integrin, beta 7 (ITGB7), transcript variant 1, mRNA. | 497 |
| RARG | exonic | NM_0010 | Homo sapiens retinoic acid receptor, gamma (RARG), transcript | 49 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 42728 | variant 2, mRNA. | 8 |
| RARG | exonic | NM_0012 43732 | Homo sapiens retinoic acid receptor, gamma (RARG), transcript variant 3, mRNA. | 499 |
| RARG | exonic | NM_0009 66 | Homo sapiens retinoic acid receptor, gamma (RARG), transcript variant 1, mRNA. | 500 |
| RARG | exonic | NM_0012 43730 | Homo sapiens retinoic acid receptor, gamma (RARG), transcript variant 4, mRNA. | 501 |
| RARG | exonic | NM_0012 43731 | Homo sapiens retinoic acid receptor, gamma (RARG), transcript variant 5, mRNA. | 502 |
| MFSD5 | exonic | NM_0011 70790 | Homo sapiens major facilitator superfamily domain containing 5 (MFSD5), transcript variant 1, mRNA. | 503 |
| MFSD5 | exonic | NM_0328 89 | Homo sapiens major facilitator superfamily domain containing 5 (MFSD5), transcript variant 2, mRNA. | 504 |
| ESPL1 | exonic | NM_0122 91 | Homo sapiens extra spindle pole bodies homolog 1 (S. cerevisiae) (ESPL1), mRNA. | 505 |
| PFDN5 | exonic | NM_0026 24 | Homo sapiens prefoldin subunit 5 (PFDN5), transcript variant 1, mRNA. | 506 |
| PFDN5 | exonic | NM_1458 97 | Homo sapiens prefoldin subunit 5 (PFDN5), transcript variant 3, mRNA. | 507 |
| C12orf10 | exonic | NM_0216 40 | Homo sapiens chromosome 12 open reading frame 10 (C12orf10), mRNA. | 508 |
| AAAS | exonic | NM_0011 73466 | Homo sapiens achalasia, adrenocortical insufficiency, alacrimia (AAAS), transcript variant 2, mRNA. | 509 |
| AAAS | exonic | NM_0156 65 | Homo sapiens achalasia, adrenocortical insufficiency, alacrimia (AAAS), transcript variant 1, mRNA. | 510 |
| SLC13A5 | exonic | NM_0011 43838 | Homo sapiens solute carrier family 13 (sodium-dependent citrate transporter), member 5 (SLC13A5), transcript variant 2, mRNA. | 511 |
| SLC13A5 | exonic | NM_1775 50 | Homo sapiens solute carrier family 13 (sodium-dependent citrate transporter), member 5 (SLC13A5), transcript variant 1, mRNA. | 512 |
| CA5B | exonic | NM_0072 20 | Homo sapiens carbonic anhydrase VB, mitochondrial (CA5B), mRNA. | 513 |
| INE2 | exonic | NR_00272 5 | Homo sapiens inactivation escape 2 (non-protein coding) (INE2), non-coding RNA. | 514 |
| ZRSR2 | exonic | NM_0050 89 | Homo sapiens zinc finger (CCCH type), RNA-binding motif and serine/arginine rich 2 (ZRSR2), mRNA. | 515 |
| CACNA1C | intronic | NM_0007 19 | Homo sapiens calcium channel, voltage-dependent, L type, alpha 1C subunit (CACNA1C), transcript variant 18, mRNA. | 516 |
| CACNA1C | intronic | NM_0011 29827 | Homo sapiens calcium channel, voltage-dependent, L type, alpha 1C subunit (CACNA1C), transcript variant 2, mRNA. | 517 |
| CACNA1C | intronic | NM_0011 29829 | Homo sapiens calcium channel, voltage-dependent, L type, alpha 1C subunit (CACNA1C), transcript variant 3, mRNA. | 518 |
| CACNA1C | intronic | NM_0011 29830 | Homo sapiens calcium channel, voltage-dependent, L type, alpha 1C subunit (CACNA1C), transcript variant 4, mRNA. | 519 |
| CACNA1C | intronic | NM_0011 | Homo sapiens calcium channel, voltage-dependent, L type, alpha | 52 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| C | nic | 29831 | 1C subunit (CACNA1C), transcript variant 5, mRNA. | 0 |
| CACNA1C | intronic | NM_00129832 | Homo sapiens calcium channel, voltage-dependent, L type, alpha 1C subunit (CACNA1C), transcript variant 6, mRNA. | 521 |
| CACNA1C | intronic | NM_00129833 | Homo sapiens calcium channel, voltage-dependent, L type, alpha 1C subunit (CACNA1C), transcript variant 7, mRNA. | 522 |
| CACNA1C | intronic | NM_00129834 | Homo sapiens calcium channel, voltage-dependent, L type, alpha 1C subunit (CACNA1C), transcript variant 8, mRNA. | 523 |
| CACNA1C | intronic | NM_00129835 | Homo sapiens calcium channel, voltage-dependent, L type, alpha 1C subunit (CACNA1C), transcript variant 9, mRNA. | 524 |
| CACNA1C | intronic | NM_00129836 | Homo sapiens calcium channel, voltage-dependent, L type, alpha 1C subunit (CACNA1C), transcript variant 10, mRNA. | 525 |
| CACNA1C | intronic | NM_00129837 | Homo sapiens calcium channel, voltage-dependent, L type, alpha 1C subunit (CACNA1C), transcript variant 11, mRNA. | 526 |
| CACNA1C | intronic | NM_00129838 | Homo sapiens calcium channel, voltage-dependent, L type, alpha 1C subunit (CACNA1C), transcript variant 12, mRNA. | 527 |
| CACNA1C | intronic | NM_00129839 | Homo sapiens calcium channel, voltage-dependent, L type, alpha 1C subunit (CACNA1C), transcript variant 13, mRNA. | 528 |
| CACNA1C | intronic | NM_00129840 | Homo sapiens calcium channel, voltage-dependent, L type, alpha 1C subunit (CACNA1C), transcript variant 14, mRNA. | 529 |
| CACNA1C | intronic | NM_00129841 | Homo sapiens calcium channel, voltage-dependent, L type, alpha 1C subunit (CACNA1C), transcript variant 15, mRNA. | 530 |
| CACNA1C | intronic | NM_00129842 | Homo sapiens calcium channel, voltage-dependent, L type, alpha 1C subunit (CACNA1C), transcript variant 16, mRNA. | 531 |
| CACNA1C | intronic | NM_00129843 | Homo sapiens calcium channel, voltage-dependent, L type, alpha 1C subunit (CACNA1C), transcript variant 17, mRNA. | 532 |
| CACNA1C | intronic | NM_00129844 | Homo sapiens calcium channel, voltage-dependent, L type, alpha 1C subunit (CACNA1C), transcript variant 19, mRNA. | 533 |
| CACNA1C | intronic | NM_00129846 | Homo sapiens calcium channel, voltage-dependent, L type, alpha 1C subunit (CACNA1C), transcript variant 20, mRNA. | 534 |
| CACNA1C | intronic | NM_00116 7623 | Homo sapiens calcium channel, voltage-dependent, L type, alpha 1C subunit (CACNA1C), transcript variant 21, mRNA. | 535 |
| CACNA1C | intronic | NM_00116 7624 | Homo sapiens calcium channel, voltage-dependent, L type, alpha 1C subunit (CACNA1C), transcript variant 22, mRNA. | 536 |
| CACNA1C | intronic | NM_00116 7625 | Homo sapiens calcium channel, voltage-dependent, L type, alpha 1C subunit (CACNA1C), transcript variant 23, mRNA. | 537 |
| CACNA1C | intronic | NM_199460 | Homo sapiens calcium channel, voltage-dependent, L type, alpha 1C subunit (CACNA1C), transcript variant 1, mRNA. | 538 |
| RTN4R | exonic | NM_023004 | Homo sapiens reticulon 4 receptor (RTN4R), mRNA. | 539 |
| DGCR6L | exonic | NM_033257 | Homo sapiens DiGeorge syndrome critical region gene 6-like (DGCR6L), mRNA. | 540 |
| LOC729444 | exonic | NR_038388 | Homo sapiens uncharacterized LOC729444 (LOC729444), non-coding RNA. | 541 |
| TMEM19 | exoni | NM_0012 | Homo sapiens transmembrane protein 191B (TMEM191B), | 54 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| 1B | c | 42313 | mRNA. | 2 |
| PI4KAP1 | exonic | NR_003563 | Homo sapiens phosphatidylinositol 4-kinase, catalytic, alpha pseudogene 1 (PI4KAP1), non-coding RNA. | 543 |
| RIMBP3 | exonic | NM_015672 | Homo sapiens RIMS binding protein 3 (RIMBP3), mRNA. | 544 |
| ZNF74 | exonic | NM_001256523 | Homo sapiens zinc finger protein 74 (ZNF74), transcript variant 2, mRNA. | 545 |
| ZNF74 | exonic | NM_001256524 | Homo sapiens zinc finger protein 74 (ZNF74), transcript variant 3, mRNA. | 546 |
| ZNF74 | exonic | NM_001256525 | Homo sapiens zinc finger protein 74 (ZNF74), transcript variant 4, mRNA. | 547 |
| ZNF74 | exonic | NM_003426 | Homo sapiens zinc finger protein 74 (ZNF74), transcript variant 1, mRNA. | 548 |
| ZNF74 | exonic | NR_046282 | Homo sapiens zinc finger protein 74 (ZNF74), transcript variant 5, non-coding RNA. | 549 |
| SCARF2 | exonic | NM_153334 | Homo sapiens scavenger receptor class F, member 2 (SCARF2), transcript variant 1, mRNA. | 550 |
| SCARF2 | exonic | NM_182895 | Homo sapiens scavenger receptor class F, member 2 (SCARF2), transcript variant 2, mRNA. | 551 |
| KLHL22 | exonic | NM_032775 | Homo sapiens kelch-like family member 22 (KLHL22), transcript variant 1, mRNA. | 552 |
| KLHL22 | exonic | NR_033825 | Homo sapiens kelch-like family member 22 (KLHL22), transcript variant 2, non-coding RNA. | 553 |
| MED15 | exonic | NM_001003891 | Homo sapiens mediator complex subunit 15 (MED15), transcript variant 1, mRNA. | 554 |
| MED15 | exonic | NM_015889 | Homo sapiens mediator complex subunit 15 (MED15), transcript variant 2, mRNA. | 555 |
| KCTD14 | exonic | NM_023930 | Homo sapiens potassium channel tetramerization domain containing 14 (KCTD14), transcript variant 1, mRNA. | 556 |
| NDUFC2-KCTD14 | exonic | NM_001203260 | Homo sapiens NDUFC2-KCTD14 readthrough (NDUFC2-KCTD14), transcript variant 1, mRNA. | 557 |
| NDUFC2-KCTD14 | exonic | NM_001203261 | Homo sapiens NDUFC2-KCTD14 readthrough (NDUFC2-KCTD14), transcript variant 2, mRNA. | 558 |
| NDUFC2-KCTD14 | exonic | NM_001203262 | Homo sapiens NDUFC2-KCTD14 readthrough (NDUFC2-KCTD14), transcript variant 3, mRNA. | 559 |
| COX6A1 | exonic | NM_004373 | Homo sapiens cytochrome c oxidase subunit VIa polypeptide 1 (COX6A1), mRNA. | 560 |
| TRIAP1 | exonic | NM_016399 | Homo sapiens TP53 regulated inhibitor of apoptosis 1 (TRIAP1), mRNA. | 561 |
| GATC | exonic | NM_176818 | Homo sapiens glutamyl-tRNA(Gln) amidotransferase, subunit C (GATC), transcript variant 1, mRNA. | 562 |
| GATC | exonic | NR_033684 | Homo sapiens glutamyl-tRNA(Gln) amidotransferase, subunit C (GATC), transcript variant 2, non-coding RNA. | 563 |
| ANKRD3 | exonic | NM_0251 | Homo sapiens ankyrin repeat domain 36B (ANKRD36B), | 56 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| 6B | c | 90 | mRNA. | 4 |
| COX5B | exonic | NM_001862 | Homo sapiens cytochrome c oxidase subunit Vb (COX5B), mRNA. | 565 |
| ACTR1B | exonic | NM_005735 | Homo sapiens ARP1 actin-related protein 1 homolog B, centractin beta (yeast) (ACTR1B), mRNA. | 566 |
| ACAD10 | exonic | NM_001136538 | Homo sapiens acyl-CoA dehydrogenase family, member 10 (ACAD10), transcript variant 1, mRNA. | 567 |
| ACAD10 | exonic | NM_025247 | Homo sapiens acyl-CoA dehydrogenase family, member 10 (ACAD10), transcript variant 2, mRNA. | 568 |
| ALDH2 | exonic | NM_000690 | Homo sapiens aldehyde dehydrogenase 2 family (mitochondrial) (ALDH2), transcript variant 1, mRNA. | 569 |
| ALDH2 | exonic | NM_001204889 | Homo sapiens aldehyde dehydrogenase 2 family (mitochondrial) (ALDH2), transcript variant 2, mRNA. | 570 |
| MAPKAPK5-AS1 | exonic | NR_015404 | Homo sapiens MAPKAPK5 antisense RNA 1 (MAPKAPK5-AS1), non-coding RNA. | 571 |
| MAPKAPK5 | exonic | NM_003668 | Homo sapiens mitogen-activated protein kinase-activated protein kinase 5 (MAPKAPK5), transcript variant 1, mRNA. | 572 |
| MAPKAPK5 | exonic | NM_139078 | Homo sapiens mitogen-activated protein kinase-activated protein kinase 5 (MAPKAPK5), transcript variant 2, mRNA. | 573 |
| NLRP14 | exonic | NM_176822 | Homo sapiens NLR family, pyrin domain containing 14 (NLRP14), mRNA. | 574 |
| TUB | exonic | NM_003320 | Homo sapiens tubby bipartite transcription factor (TUB), transcript variant 1, mRNA. | 575 |
| TUB | intronic | NM_177972 | Homo sapiens tubby bipartite transcription factor (TUB), transcript variant 2, mRNA. | 576 |
| NLRP3 | exonic | NM_001079821 | Homo sapiens NLR family, pyrin domain containing 3 (NLRP3), transcript variant 3, mRNA. | 577 |
| NLRP3 | exonic | NM_001127461 | Homo sapiens NLR family, pyrin domain containing 3 (NLRP3), transcript variant 4, mRNA. | 578 |
| NLRP3 | exonic | NM_001127462 | Homo sapiens NLR family, pyrin domain containing 3 (NLRP3), transcript variant 5, mRNA. | 579 |
| NLRP3 | exonic | NM_001243133 | Homo sapiens NLR family, pyrin domain containing 3 (NLRP3), transcript variant 6, mRNA. | 580 |
| NLRP3 | exonic | NM_004895 | Homo sapiens NLR family, pyrin domain containing 3 (NLRP3), transcript variant 1, mRNA. | 581 |
| NLRP3 | exonic | NM_183395 | Homo sapiens NLR family, pyrin domain containing 3 (NLRP3), transcript variant 2, mRNA. | 582 |
| DIAPH2 | exonic | NM_006729 | Homo sapiens diaphanous-related formin 2 (DIAPH2), transcript variant 156, mRNA. | 583 |
| DIAPH2 | intronic | NM_007309 | Homo sapiens diaphanous-related formin 2 (DIAPH2), transcript variant 12C, mRNA. | 584 |
| DIAPH3 | exonic | NM_001042517 | Homo sapiens diaphanous-related formin 3 (DIAPH3), transcript variant 1, mRNA. | 585 |
| DIAPH3 | exonic | NM_0012 | Homo sapiens diaphanous-related formin 3 (DIAPH3), transcript | 58 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | c | 58366 | variant 3, mRNA. | 6 |
| DIAPH3 | exonic | NM_0012 58367 | Homo sapiens diaphanous-related formin 3 (DIAPH3), transcript variant 4, mRNA. | 587 |
| DIAPH3 | exonic | NM_0012 58368 | Homo sapiens diaphanous-related formin 3 (DIAPH3), transcript variant 5, mRNA. | 588 |
| DIAPH3 | exonic | NM_0309 32 | Homo sapiens diaphanous-related formin 3 (DIAPH3), transcript variant 2, mRNA. | 589 |
| DIAPH3 | exonic | NM_0012 58369 | Homo sapiens diaphanous-related formin 3 (DIAPH3), transcript variant 6, mRNA. | 590 |
| DIAPH3 | exonic | NM_0012 58370 | Homo sapiens diaphanous-related formin 3 (DIAPH3), transcript variant 7, mRNA. | 591 |
| DDHD2 | exonic | NM_0011 64234 | Homo sapiens DDHD domain containing 2 (DDHD2), transcript variant 3, mRNA. | 592 |
| DDHD2 | exonic | NM_0152 14 | Homo sapiens DDHD domain containing 2 (DDHD2), transcript variant 1, mRNA. | 593 |
| DDHD2 | exonic | NM_0011 64232 | Homo sapiens DDHD domain containing 2 (DDHD2), transcript variant 2, mRNA. | 594 |
| PPAPDC1B | exonic | NM_0011 02559 | Homo sapiens phosphatidic acid phosphatase type 2 domain containing 1B (PPAPDC1B), transcript variant 1, mRNA. | 595 |
| PPAPDC1B | intronic | NM_0324 83 | Homo sapiens phosphatidic acid phosphatase type 2 domain containing 1B (PPAPDC1B), transcript variant 2, mRNA. | 596 |
| PPAPDC1B | intronic | NM_0011 02560 | Homo sapiens phosphatidic acid phosphatase type 2 domain containing 1B (PPAPDC1B), transcript variant 3, mRNA. | 597 |
| CADPS2 | intronic | NM_0010 09571 | Homo sapiens Ca++-dependent secretion activator 2 (CADPS2), transcript variant 2, mRNA. | 598 |
| CADPS2 | intronic | NM_0011 67940 | Homo sapiens Ca++-dependent secretion activator 2 (CADPS2), transcript variant 3, mRNA. | 599 |
| CADPS2 | intronic | NM_0179 54 | Homo sapiens Ca++-dependent secretion activator 2 (CADPS2), transcript variant 1, mRNA. | 600 |
| RNF133 | exonic | NM_1391 75 | Homo sapiens ring finger protein 133 (RNF133), mRNA. | 601 |
| RNF148 | exonic | NM_1980 85 | Homo sapiens ring finger protein 148 (RNF148), mRNA. | 602 |
| MPHOSPH8 | exonic | NM_0175 20 | Homo sapiens M-phase phosphoprotein 8 (MPHOSPH8), mRNA. | 603 |
| PSPC1 | exonic | NR_00327 2 | Homo sapiens paraspeckle component 1 (PSPC1), transcript variant 2, non-coding RNA. | 604 |
| PSPC1 | exonic | NR_04499 8 | Homo sapiens paraspeckle component 1 (PSPC1), transcript variant 3, non-coding RNA. | 605 |
| PSPC1 | exonic | NM_0010 42414 | Homo sapiens paraspeckle component 1 (PSPC1), transcript variant 1, mRNA. | 606 |
| PTPRR | exonic | NM_0028 49 | Homo sapiens protein tyrosine phosphatase, receptor type, R (PTPRR), transcript variant 1, mRNA. | 607 |
| PTPRR | intro | NM_1308 | Homo sapiens protein tyrosine phosphatase, receptor type, R | 60 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | intronic | 46 | (PTPRR), transcript variant 2, mRNA. | 8 |
| PTPRR | intronic | NR_073474 | Homo sapiens protein tyrosine phosphatase, receptor type, R (PTPRR), transcript variant 5, non-coding RNA. | 609 |
| PTPRR | intronic | NM_001207016 | Homo sapiens protein tyrosine phosphatase, receptor type, R (PTPRR), transcript variant 4, mRNA. | 610 |
| PTPRR | intronic | NM_001207015 | Homo sapiens protein tyrosine phosphatase, receptor type, R (PTPRR), transcript variant 3, mRNA. | 611 |
| ARHGAP11A | exonic | NM_199357 | Homo sapiens Rho GTPase activating protein 11A (ARHGAP11A), transcript variant 2, mRNA. | 612 |
| ARHGAP11A | exonic | NM_014783 | Homo sapiens Rho GTPase activating protein 11A (ARHGAP11A), transcript variant 1, mRNA. | 613 |
| SCG5 | exonic | NM_001144757 | Homo sapiens secretogranin V (7B2 protein) (SCG5), transcript variant 1, mRNA. | 614 |
| SCG5 | exonic | NM_003020 | Homo sapiens secretogranin V (7B2 protein) (SCG5), transcript variant 2, mRNA. | 615 |
| FMN1 | exonic | NM_001103184 | Homo sapiens formin 1 (FMN1), transcript variant 2, mRNA. | 616 |
| FMN1 | exonic | NM_001277313 | Homo sapiens formin 1 (FMN1), transcript variant 1, mRNA. | 617 |
| FMN1 | intronic | NM_001277314 | Homo sapiens formin 1 (FMN1), transcript variant 3, mRNA. | 618 |
| GREM1 | exonic | NM_001191322 | Homo sapiens gremlin 1, DAN family BMP antagonist (GREM1), transcript variant 3, mRNA. | 619 |
| GREM1 | exonic | NM_001191323 | Homo sapiens gremlin 1, DAN family BMP antagonist (GREM1), transcript variant 2, mRNA. | 620 |
| GREM1 | exonic | NM_013372 | Homo sapiens gremlin 1, DAN family BMP antagonist (GREM1), transcript variant 1, mRNA. | 621 |
| ARGFX | exonic | NM_001012659 | Homo sapiens arginine-fifty homeobox (ARGFX), mRNA. | 622 |
| FBXO40 | exonic | NM_016298 | Homo sapiens F-box protein 40 (FBXO40), mRNA. | 623 |
| HCLS1 | exonic | NM_005335 | Homo sapiens hematopoietic cell-specific Lyn substrate 1 (HCLS1), mRNA. | 624 |
| GOLGB1 | exonic | NM_001256486 | Homo sapiens golgin B1 (GOLGB1), transcript variant 1, mRNA. | 625 |
| GOLGB1 | exonic | NM_001256487 | Homo sapiens golgin B1 (GOLGB1), transcript variant 3, mRNA. | 626 |
| GOLGB1 | exonic | NM_001256488 | Homo sapiens golgin B1 (GOLGB1), transcript variant 4, mRNA. | 627 |
| GOLGB1 | exonic | NM_004487 | Homo sapiens golgin B1 (GOLGB1), transcript variant 2, mRNA. | 628 |
| SMARCB1 | exonic | NM_001007468 | Homo sapiens SWI/SNF related, matrix associated, actin dependent regulator of chromatin, subfamily b, member 1 (SMARCB1), transcript variant 2, mRNA. | 629 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| SMARCB1 | exonic | NM_003073 | Homo sapiens SWI/SNF related, matrix associated, actin dependent regulator of chromatin, subfamily b, member 1 (SMARCB1), transcript variant 1, mRNA. | 630 |
| DERL3 | exonic | NM_001002862 | Homo sapiens derlin 3 (DERL3), transcript variant 2, mRNA. | 631 |
| DERL3 | exonic | NM_001135751 | Homo sapiens derlin 3 (DERL3), transcript variant 1, mRNA. | 632 |
| DERL3 | exonic | NM_198440 | Homo sapiens derlin 3 (DERL3), transcript variant 3, mRNA. | 633 |
| SLC2A11 | exonic | NM_001024938 | Homo sapiens solute carrier family 2 (facilitated glucose transporter), member 11 (SLC2A11), transcript variant 3, mRNA. | 634 |
| SLC2A11 | exonic | NM_030807 | Homo sapiens solute carrier family 2 (facilitated glucose transporter), member 11 (SLC2A11), transcript variant 1, mRNA. | 635 |
| SLC2A11 | exonic | NM_001024939 | Homo sapiens solute carrier family 2 (facilitated glucose transporter), member 11 (SLC2A11), transcript variant 2, mRNA. | 636 |
| LOC284889 | exonic | NR_038911 | Homo sapiens uncharacterized LOC284889 (LOC284889), non-coding RNA. | 637 |
| MIF | exonic | NM_002415 | Homo sapiens macrophage migration inhibitory factor (glycosylation-inhibiting factor) (MIF), mRNA. | 638 |
| XRRA1 | exonic | NM_001270380 | Homo sapiens X-ray radiation resistance associated 1 (XRRA1), transcript variant 2, mRNA. | 639 |
| XRRA1 | exonic | NM_001270381 | Homo sapiens X-ray radiation resistance associated 1 (XRRA1), transcript variant 3, mRNA. | 640 |
| XRRA1 | exonic | NM_182969 | Homo sapiens X-ray radiation resistance associated 1 (XRRA1), transcript variant 1, mRNA. | 641 |
| SPCS2 | exonic | NM_014752 | Homo sapiens signal peptidase complex subunit 2 homolog (S. cerevisiae) (SPCS2), mRNA. | 642 |
| NEU3 | exonic | NM_006656 | Homo sapiens sialidase 3 (membrane sialidase) (NEU3), mRNA. | 643 |
| ARRB1 | exonic | NM_004041 | Homo sapiens arrestin, beta 1 (ARRB1), transcript variant 1, mRNA. | 644 |
| ARRB1 | exonic | NM_020251 | Homo sapiens arrestin, beta 1 (ARRB1), transcript variant 2, mRNA. | 645 |
| MIR326 | exonic | NR_029891 | Homo sapiens microRNA 326 (MIR326), microRNA. | 646 |
| BUB1B | exonic | NM_001211 | Homo sapiens BUB1 mitotic checkpoint serine/threonine kinase B (BUB1B), mRNA. | 647 |
| PAK6 | exonic | NM_001128628 | Homo sapiens p21 protein (Cdc42/Rac)-activated kinase 6 (PAK6), transcript variant 2, mRNA. | 648 |
| PAK6 | exonic | NM_001128629 | Homo sapiens p21 protein (Cdc42/Rac)-activated kinase 6 (PAK6), transcript variant 3, mRNA. | 649 |
| PAK6 | intronic | NM_001276718 | Homo sapiens p21 protein (Cdc42/Rac)-activated kinase 6 (PAK6), transcript variant 5, mRNA. | 650 |
| PAK6 | intro | NM_0201 | Homo sapiens p21 protein (Cdc42/Rac)-activated kinase 6 | 65 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| | intronic | 68 | (PAK6), transcript variant 1, mRNA. | 1 |
| PAK6 | intronic | NM_001276717 | Homo sapiens p21 protein (Cdc42/Rac)-activated kinase 6 (PAK6), transcript variant 4, mRNA. | 652 |
| RCOR1 | exonic | NM_015156 | Homo sapiens REST corepressor 1 (RCOR1), mRNA. | 653 |
| ZNF839 | exonic | NM_001267827 | Homo sapiens zinc finger protein 839 (ZNF839), transcript variant 2, mRNA. | 654 |
| ZNF839 | exonic | NM_001267828 | Homo sapiens zinc finger protein 839 (ZNF839), transcript variant 3, mRNA. | 655 |
| ZNF839 | exonic | NM_018335 | Homo sapiens zinc finger protein 839 (ZNF839), transcript variant 1, mRNA. | 656 |
| CINP | exonic | NM_001177611 | Homo sapiens cyclin-dependent kinase 2 interacting protein (CINP), transcript variant 1, mRNA. | 657 |
| CINP | exonic | NM_001177612 | Homo sapiens cyclin-dependent kinase 2 interacting protein (CINP), transcript variant 3, mRNA. | 658 |
| CINP | exonic | NM_032630 | Homo sapiens cyclin-dependent kinase 2 interacting protein (CINP), mRNA. | 659 |
| TECPR2 | exonic | NM_001172631 | Homo sapiens tectonin beta-propeller repeat containing 2 (TECPR2), transcript variant 2, mRNA. | 660 |
| TECPR2 | exonic | NM_014844 | Homo sapiens tectonin beta-propeller repeat containing 2 (TECPR2), transcript variant 1, mRNA. | 661 |
| SPOCK1 | exonic | NM_004598 | Homo sapiens sparc/osteonectin, cwcv and kazal-like domains proteoglycan (testican) 1 (SPOCK1), mRNA. | 662 |
| APBA2 | exonic | NM_001130414 | Homo sapiens amyloid beta (A4) precursor protein-binding, family A, member 2 (APBA2), transcript variant 2, mRNA. | 663 |
| APBA2 | exonic | NM_005503 | Homo sapiens amyloid beta (A4) precursor protein-binding, family A, member 2 (APBA2), transcript variant 1, mRNA. | 664 |
| CLDN14 | exonic | NM_001146078 | Homo sapiens claudin 14 (CLDN14), transcript variant gamma, mRNA. | 665 |
| CLDN14 | exonic | NM_001146077 | Homo sapiens claudin 14 (CLDN14), transcript variant 3, mRNA. | 666 |
| CLDN14 | intronic | NM_012130 | Homo sapiens claudin 14 (CLDN14), transcript variant epsilon, mRNA. | 667 |
| CLDN14 | intronic | NM_001146079 | Homo sapiens claudin 14 (CLDN14), transcript variant 5, mRNA. | 668 |
| CLDN14 | intronic | NM_144492 | Homo sapiens claudin 14 (CLDN14), transcript variant 1, mRNA. | 669 |
| DGKD | exonic | NM_152879 | Homo sapiens diacylglycerol kinase, delta 130kDa (DGKD), transcript variant 2, mRNA. | 670 |
| DGKD | exonic | NM_003648 | Homo sapiens diacylglycerol kinase, delta 130kDa (DGKD), transcript variant 1, mRNA. | 671 |
| ATG16L1 | exonic | NM_001190266 | Homo sapiens autophagy related 16-like 1 (S. cerevisiae) (ATG16L1), transcript variant 4, mRNA. | 672 |
| ATG16L | exonic | NM_0011 | Homo sapiens autophagy related 16-like 1 (S. cerevisiae) | 67 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| 1 | c | 90267 | (ATG16L1), transcript variant 5, mRNA. | 3 |
| ATG16L1 | exonic | NM_017974 | Homo sapiens autophagy related 16-like 1 (S. cerevisiae) (ATG16L1), transcript variant 2, mRNA. | 674 |
| ATG16L1 | exonic | NM_030803 | Homo sapiens autophagy related 16-like 1 (S. cerevisiae) (ATG16L1), transcript variant 1, mRNA. | 675 |
| ATG16L1 | exonic | NM_198890 | Homo sapiens autophagy related 16-like 1 (S. cerevisiae) (ATG16L1), transcript variant 3, mRNA. | 676 |
| SAG | exonic | NM_000541 | Homo sapiens S-antigen; retina and pineal gland (arrestin) (SAG), mRNA. | 677 |
| HLCS | intronic | NM_001242784 | Homo sapiens holocarboxylase synthetase (biotin-(proprionyl-CoA-carboxylase (ATP-hydrolysing)) ligase) (HLCS), transcript variant 3, mRNA. | 678 |
| HLCS | intronic | NM_001242785 | Homo sapiens holocarboxylase synthetase (biotin-(proprionyl-CoA-carboxylase (ATP-hydrolysing)) ligase) (HLCS), transcript variant 2, mRNA. | 679 |
| HLCS | intronic | NM_000411 | Homo sapiens holocarboxylase synthetase (biotin-(proprionyl-CoA-carboxylase (ATP-hydrolysing)) ligase) (HLCS), transcript variant 1, mRNA. | 680 |
| KCND2 | intronic | NM_012281 | Homo sapiens potassium voltage-gated channel, Shal-related subfamily, member 2 (KCND2), mRNA. | 681 |
| MERTK | exonic | NM_006343 | Homo sapiens c-mer proto-oncogene tyrosine kinase (MERTK), mRNA. | 682 |
| TMEM87B | exonic | NM_032824 | Homo sapiens transmembrane protein 87B (TMEM87B), mRNA. | 683 |
| FBLN7 | exonic | NM_001128165 | Homo sapiens fibulin 7 (FBLN7), transcript variant 2, mRNA. | 684 |
| FBLN7 | exonic | NM_153214 | Homo sapiens fibulin 7 (FBLN7), transcript variant 1, mRNA. | 685 |
| PGM5 | exonic | NM_021965 | Homo sapiens phosphoglucomutase 5 (PGM5), mRNA. | 686 |
| TMEM252 | exonic | NM_153237 | Homo sapiens transmembrane protein 252 (TMEM252), mRNA. | 687 |
| PSEN1 | exonic | NM_000021 | Homo sapiens presenilin 1 (PSEN1), transcript variant 1, mRNA. | 688 |
| PSEN1 | exonic | NM_007318 | Homo sapiens presenilin 1 (PSEN1), transcript variant 2, mRNA. | 689 |
| RNASEH2B-AS1 | exonic | NR_046552 | Homo sapiens RNASEH2B antisense RNA 1 (RNASEH2B-AS1), non-coding RNA. | 690 |
| RNASEH2B | exonic | NM_024570 | Homo sapiens ribonuclease H2, subunit B (RNASEH2B), transcript variant 1, mRNA. | 691 |
| RNASEH2B | exonic | NM_001142279 | Homo sapiens ribonuclease H2, subunit B (RNASEH2B), transcript variant 2, mRNA. | 692 |
| GUCY1B2 | exonic | NR_003923 | Homo sapiens guanylate cyclase 1, soluble, beta 2 (pseudogene) (GUCY1B2), non-coding RNA. | 693 |

| RefSeq Gene Symbol(s) | Exon overlap | RefSeq Accession Number | mRNA Description | SEQ ID |
|---|---|---|---|---|
| PHACTR4 | exonic | NM_001048183 | Homo sapiens phosphatase and actin regulator 4 (PHACTR4), transcript variant 1, mRNA. | 694 |
| PHACTR4 | exonic | NM_023923 | Homo sapiens phosphatase and actin regulator 4 (PHACTR4), transcript variant 2, mRNA. | 695 |
| SNHG3 | exonic | NR_002909 | Homo sapiens small nucleolar RNA host gene 3 (non-protein coding) (SNHG3), transcript variant 2, non-coding RNA. | 696 |
| SNHG3 | exonic | NR_036473 | Homo sapiens small nucleolar RNA host gene 3 (non-protein coding) (SNHG3), transcript variant 1, non-coding RNA. | 697 |
| RCC1 | exonic | NM_001048199 | Homo sapiens regulator of chromosome condensation 1 (RCC1), transcript variant 4, mRNA. | 698 |
| RCC1 | exonic | NR_030725 | Homo sapiens regulator of chromosome condensation 1 (RCC1), transcript variant 5, non-coding RNA. | 699 |
| RCC1 | exonic | NR_030726 | Homo sapiens regulator of chromosome condensation 1 (RCC1), transcript variant 6, non-coding RNA. | 700 |
| RCC1 | exonic | NM_001048194 | Homo sapiens regulator of chromosome condensation 1 (RCC1), transcript variant 1, mRNA. | 701 |
| RCC1 | exonic | NM_001048195 | Homo sapiens regulator of chromosome condensation 1 (RCC1), transcript variant 2, mRNA. | 702 |
| RCC1 | exonic | NM_001269 | Homo sapiens regulator of chromosome condensation 1 (RCC1), transcript variant 3, mRNA. | 703 |
| YY1AP1 | exonic | NM_001198899 | Homo sapiens YY1 associated protein 1 (YY1AP1), transcript variant 6, mRNA. | 704 |
| YY1AP1 | exonic | NM_001198903 | Homo sapiens YY1 associated protein 1 (YY1AP1), transcript variant 10, mRNA. | 705 |
| YY1AP1 | exonic | NM_001198904 | Homo sapiens YY1 associated protein 1 (YY1AP1), transcript variant 11, mRNA. | 706 |
| YY1AP1 | exonic | NM_001198902 | Homo sapiens YY1 associated protein 1 (YY1AP1), transcript variant 9, mRNA. | 707 |
| YY1AP1 | exonic | NM_139119 | Homo sapiens YY1 associated protein 1 (YY1AP1), transcript variant 3, mRNA. | 708 |
| YY1AP1 | exonic | NM_001198900 | Homo sapiens YY1 associated protein 1 (YY1AP1), transcript variant 7, mRNA. | 709 |
| YY1AP1 | exonic | NM_001198905 | Homo sapiens YY1 associated protein 1 (YY1AP1), transcript variant 12, mRNA. | 710 |
| YY1AP1 | exonic | NM_018253 | Homo sapiens YY1 associated protein 1 (YY1AP1), transcript variant 1, mRNA. | 711 |
| YY1AP1 | exonic | NM_139121 | Homo sapiens YY1 associated protein 1 (YY1AP1), transcript variant 5, mRNA. | 712 |
| YY1AP1 | exonic | NM_001198901 | Homo sapiens YY1 associated protein 1 (YY1AP1), transcript variant 8, mRNA. | 713 |
| YY1AP1 | exonic | NM_001198906 | Homo sapiens YY1 associated protein 1 (YY1AP1), transcript variant 13, mRNA. | 714 |
| YY1AP1 | exonic | NM_139118 | Homo sapiens YY1 associated protein 1 (YY1AP1), transcript variant 2, mRNA. | 715 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| DAP3 | exonic | NM_001199849 | Homo sapiens death associated protein 3 (DAP3), transcript variant 3, mRNA. | 716 |
| DAP3 | exonic | NM_001199850 | Homo sapiens death associated protein 3 (DAP3), transcript variant 4, mRNA. | 717 |
| DAP3 | exonic | NM_001199851 | Homo sapiens death associated protein 3 (DAP3), transcript variant 5, mRNA. | 718 |
| DAP3 | exonic | NM_004632 | Homo sapiens death associated protein 3 (DAP3), transcript variant 2, mRNA. | 719 |
| DAP3 | exonic | NM_033657 | Homo sapiens death associated protein 3 (DAP3), transcript variant 1, mRNA. | 720 |
| CAPN8 | exonic | NM_001143962 | Homo sapiens calpain 8 (CAPN8), mRNA. | 721 |
| CAPN2 | exonic | NM_001146068 | Homo sapiens calpain 2, (m/II) large subunit (CAPN2), transcript variant 2, mRNA. | 722 |
| CAPN2 | exonic | NM_001748 | Homo sapiens calpain 2, (m/II) large subunit (CAPN2), transcript variant 1, mRNA. | 723 |
| SPAST | exonic | NM_014946 | Homo sapiens spastin (SPAST), transcript variant 1, mRNA. | 724 |
| SPAST | exonic | NM_199436 | Homo sapiens spastin (SPAST), transcript variant 2, mRNA. | 725 |
| SLC30A6 | exonic | NM_001193513 | Homo sapiens solute carrier family 30 (zinc transporter), member 6 (SLC30A6), transcript variant 1, mRNA. | 726 |
| SLC30A6 | exonic | NM_001193514 | Homo sapiens solute carrier family 30 (zinc transporter), member 6 (SLC30A6), transcript variant 3, mRNA. | 727 |
| SLC30A6 | exonic | NM_001193515 | Homo sapiens solute carrier family 30 (zinc transporter), member 6 (SLC30A6), transcript variant 4, mRNA. | 728 |
| SLC30A6 | exonic | NM_017964 | Homo sapiens solute carrier family 30 (zinc transporter), member 6 (SLC30A6), transcript variant 2, mRNA. | 729 |
| NLRC4 | exonic | NM_001199138 | Homo sapiens NLR family, CARD domain containing 4 (NLRC4), transcript variant 2, mRNA. | 730 |
| NLRC4 | exonic | NM_001199139 | Homo sapiens NLR family, CARD domain containing 4 (NLRC4), transcript variant 3, mRNA. | 731 |
| NLRC4 | exonic | NM_021209 | Homo sapiens NLR family, CARD domain containing 4 (NLRC4), transcript variant 1, mRNA. | 732 |
| YIPF4 | exonic | NM_032312 | Homo sapiens Yip1 domain family, member 4 (YIPF4), mRNA. | 733 |
| EPHA4 | intronic | NM_004438 | Homo sapiens EPH receptor A4 (EPHA4), mRNA. | 734 |
| ATG7 | intronic | NM_001136031 | Homo sapiens autophagy related 7 (ATG7), transcript variant 2, mRNA. | 735 |
| ATG7 | intronic | NM_001144912 | Homo sapiens autophagy related 7 (ATG7), transcript variant 3, mRNA. | 736 |
| ATG7 | intronic | NM_006395 | Homo sapiens autophagy related 7 (ATG7), transcript variant 1, mRNA. | 737 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| WIPI2 | exonic | NM_001033518 | Homo sapiens WD repeat domain, phosphoinositide interacting 2 (WIPI2), transcript variant 3, mRNA. | 738 |
| WIPI2 | exonic | NM_001033519 | Homo sapiens WD repeat domain, phosphoinositide interacting 2 (WIPI2), transcript variant 4, mRNA. | 739 |
| WIPI2 | exonic | NM_015610 | Homo sapiens WD repeat domain, phosphoinositide interacting 2 (WIPI2), transcript variant 1, mRNA. | 740 |
| WIPI2 | exonic | NM_016003 | Homo sapiens WD repeat domain, phosphoinositide interacting 2 (WIPI2), transcript variant 2, mRNA. | 741 |
| WIPI2 | exonic | NM_001033520 | Homo sapiens WD repeat domain, phosphoinositide interacting 2 (WIPI2), transcript variant 5, mRNA. | 742 |
| PRKAR2B | intronic | NM_002736 | Homo sapiens protein kinase, cAMP-dependent, regulatory, type II, beta (PRKAR2B), mRNA. | 743 |
| PNPLA7 | exonic | NM_001098537 | Homo sapiens patatin-like phospholipase domain containing 7 (PNPLA7), transcript variant 1, mRNA. | 744 |
| PNPLA7 | exonic | NM_152286 | Homo sapiens patatin-like phospholipase domain containing 7 (PNPLA7), transcript variant 2, mRNA. | 745 |
| MRPL41 | exonic | NM_032477 | Homo sapiens mitochondrial ribosomal protein L41 (MRPL41), mRNA. | 746 |
| WDR85 | exonic | NM_138778 | Homo sapiens diphthamide biosynthesis 7 (DPH7), mRNA. | 747 |
| DHTKD1 | exonic | NM_018706 | Homo sapiens dehydrogenase E1 and transketolase domain containing 1 (DHTKD1), mRNA. | 748 |
| SEC61A2 | exonic | NM_001142628 | Homo sapiens Sec61 alpha 2 subunit (S. cerevisiae) (SEC61A2), transcript variant 2, mRNA. | 749 |
| SEC61A2 | exonic | NM_018144 | Homo sapiens Sec61 alpha 2 subunit (S. cerevisiae) (SEC61A2), transcript variant 1, mRNA. | 750 |
| SEC61A2 | exonic | NM_001142627 | Homo sapiens Sec61 alpha 2 subunit (S. cerevisiae) (SEC61A2), transcript variant 3, mRNA. | 751 |
| SEC61A2 | exonic | NR_024576 | Homo sapiens Sec61 alpha 2 subunit (S. cerevisiae) (SEC61A2), transcript variant 5, non-coding RNA. | 752 |
| SEC61A2 | exonic | NR_024577 | Homo sapiens Sec61 alpha 2 subunit (S. cerevisiae) (SEC61A2), transcript variant 4, non-coding RNA. | 753 |
| PRCP | exonic | NM_005040 | Homo sapiens prolylcarboxypeptidase (angiotensinase C) (PRCP), transcript variant 1, mRNA. | 754 |
| PRCP | exonic | NM_199418 | Homo sapiens prolylcarboxypeptidase (angiotensinase C) (PRCP), transcript variant 2, mRNA. | 755 |
| C11orf82 | exonic | NM_145018 | Homo sapiens chromosome 11 open reading frame 82 (C11orf82), mRNA. | 756 |
| RAB30 | exonic | NM_014488 | Homo sapiens RAB30, member RAS oncogene family (RAB30), mRNA. | 757 |
| HEPHL1 | exonic | NM_001098672 | Homo sapiens hephaestin-like 1 (HEPHL1), mRNA. | 758 |
| PANX1 | exonic | NM_015368 | Homo sapiens pannexin 1 (PANX1), mRNA. | 759 |

| RefSeq Gene Symbol(s) | Exon overlap | RefSeq Accession Number | mRNA Description | SEQ ID |
|---|---|---|---|---|
| ABCB9 | exonic | NM_001243014 | Homo sapiens ATP-binding cassette, sub-family B (MDR/TAP), member 9 (ABCB9), transcript variant 5, mRNA. | 760 |
| ABCB9 | exonic | NM_203444 | Homo sapiens ATP-binding cassette, sub-family B (MDR/TAP), member 9 (ABCB9), transcript variant 4, mRNA. | 761 |
| ABCB9 | exonic | NM_001243013 | Homo sapiens ATP-binding cassette, sub-family B (MDR/TAP), member 9 (ABCB9), transcript variant 6, mRNA. | 762 |
| ABCB9 | exonic | NM_019624 | Homo sapiens ATP-binding cassette, sub-family B (MDR/TAP), member 9 (ABCB9), transcript variant 2, mRNA. | 763 |
| ABCB9 | exonic | NM_019625 | Homo sapiens ATP-binding cassette, sub-family B (MDR/TAP), member 9 (ABCB9), transcript variant 1, mRNA. | 764 |
| NBEA | exonic | NM_015678 | Homo sapiens neurobeachin (NBEA), transcript variant 1, mRNA. | 765 |
| NBEA | intronic | NM_001204197 | Homo sapiens neurobeachin (NBEA), transcript variant 2, mRNA. | 766 |
| SPG21 | exonic | NM_001127889 | Homo sapiens spastic paraplegia 21 (autosomal recessive, Mast syndrome) (SPG21), transcript variant 2, mRNA. | 767 |
| SPG21 | exonic | NM_001127890 | Homo sapiens spastic paraplegia 21 (autosomal recessive, Mast syndrome) (SPG21), transcript variant 3, mRNA. | 768 |
| SPG21 | exonic | NM_016630 | Homo sapiens spastic paraplegia 21 (autosomal recessive, Mast syndrome) (SPG21), transcript variant 1, mRNA. | 769 |
| MTFMT | exonic | NM_139242 | Homo sapiens mitochondrial methionyl-tRNA formyltransferase (MTFMT), mRNA. | 770 |
| SLC51B | exonic | NM_178859 | Homo sapiens solute carrier family 51, beta subunit (SLC51B), mRNA. | 771 |
| RASL12 | exonic | NM_016563 | Homo sapiens RAS-like, family 12 (RASL12), mRNA. | 772 |
| GABARAPL3 | exonic | NR_028287 | Homo sapiens GABA(A) receptors associated protein like 3, pseudogene (GABARAPL3), non-coding RNA. | 773 |
| ZNF774 | exonic | NM_001004309 | Homo sapiens zinc finger protein 774 (ZNF774), mRNA. | 774 |
| IQGAP1 | exonic | NM_003870 | Homo sapiens IQ motif containing GTPase activating protein 1 (IQGAP1), mRNA. | 775 |
| PIK3C3 | exonic | NM_002647 | Homo sapiens phosphatidylinositol 3-kinase, catalytic subunit type 3 (PIK3C3), mRNA. | 776 |
| PHACTR3 | intronic | NM_001199505 | Homo sapiens phosphatase and actin regulator 3 (PHACTR3), transcript variant 4, mRNA. | 777 |
| PHACTR3 | intronic | NM_080672 | Homo sapiens phosphatase and actin regulator 3 (PHACTR3), transcript variant 1, mRNA. | 778 |
| PHACTR3 | intronic | NM_001199506 | Homo sapiens phosphatase and actin regulator 3 (PHACTR3), transcript variant 5, mRNA. | 779 |
| PHACTR3 | intronic | NM_183244 | Homo sapiens phosphatase and actin regulator 3 (PHACTR3), transcript variant 2, mRNA. | 780 |
| PHACTR3 | intronic | NM_183246 | Homo sapiens phosphatase and actin regulator 3 (PHACTR3), transcript variant 3, mRNA. | 781 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| TCP10L | exonic | NM_144659 | Homo sapiens t-complex 10-like (TCP10L), mRNA. | 782 |
| C21orf59 | exonic | NR_036552 | Homo sapiens chromosome 21 open reading frame 59 (C21orf59), transcript variant 2, non-coding RNA. | 783 |
| C21orf59 | exonic | NM_021254 | Homo sapiens chromosome 21 open reading frame 59 (C21orf59), transcript variant 1, mRNA. | 784 |
| SYNJ1 | exonic | NM_001160302 | Homo sapiens synaptojanin 1 (SYNJ1), transcript variant 3, mRNA. | 785 |
| SYNJ1 | exonic | NM_001160306 | Homo sapiens synaptojanin 1 (SYNJ1), transcript variant 4, mRNA. | 786 |
| SYNJ1 | exonic | NM_003895 | Homo sapiens synaptojanin 1 (SYNJ1), transcript variant 1, mRNA. | 787 |
| SYNJ1 | exonic | NM_203446 | Homo sapiens synaptojanin 1 (SYNJ1), transcript variant 2, mRNA. | 788 |
| SMIM11 | exonic | NM_058182 | Homo sapiens small integral membrane protein 11 (SMIM11), mRNA. | 789 |
| KCNE1 | exonic | NM_001127670 | Homo sapiens potassium voltage-gated channel, Isk-related family, member 1 (KCNE1), transcript variant 1, mRNA. | 790 |
| KCNE1 | exonic | NM_001127668 | Homo sapiens potassium voltage-gated channel, Isk-related family, member 1 (KCNE1), transcript variant 3, mRNA. | 791 |
| KCNE1 | exonic | NM_001127669 | Homo sapiens potassium voltage-gated channel, Isk-related family, member 1 (KCNE1), transcript variant 4, mRNA. | 792 |
| KCNE1 | exonic | NM_001270405 | Homo sapiens potassium voltage-gated channel, Isk-related family, member 1 (KCNE1), transcript variant 8, mRNA. | 793 |
| KCNE1 | exonic | NM_001270403 | Homo sapiens potassium voltage-gated channel, Isk-related family, member 1 (KCNE1), transcript variant 6, mRNA. | 794 |
| KCNE1 | exonic | NM_001270402 | Homo sapiens potassium voltage-gated channel, Isk-related family, member 1 (KCNE1), transcript variant 5, mRNA. | 795 |
| KCNE1 | exonic | NM_001270404 | Homo sapiens potassium voltage-gated channel, Isk-related family, member 1 (KCNE1), transcript variant 7, mRNA. | 796 |
| KCNE1 | exonic | NM_000219 | Homo sapiens potassium voltage-gated channel, Isk-related family, member 1 (KCNE1), transcript variant 2, mRNA. | 797 |
| RCAN1 | exonic | NM_203418 | Homo sapiens regulator of calcineurin 1 (RCAN1), transcript variant 3, mRNA. | 798 |
| RCAN1 | exonic | NM_203417 | Homo sapiens regulator of calcineurin 1 (RCAN1), transcript variant 2, mRNA. | 799 |
| RCAN1 | exonic | NM_004414 | Homo sapiens regulator of calcineurin 1 (RCAN1), transcript variant 1, mRNA. | 800 |
| GYG2 | exonic | NM_001079855 | Homo sapiens glycogenin 2 (GYG2), transcript variant 1, mRNA. | 801 |
| GYG2 | exonic | NM_001184702 | Homo sapiens glycogenin 2 (GYG2), transcript variant 3, mRNA. | 802 |
| GYG2 | exonic | NM_001184703 | Homo sapiens glycogenin 2 (GYG2), transcript variant 4, mRNA. | 803 |

Figure 11A (Continued)

| Figure 11A | | | | |
|---|---|---|---|---|
| RefSeq Gene Symbol(s) | Exon overlap | RefSeq Accession Number | mRNA Description | SEQ ID |
| GYG2 | exonic | NM_001184704 | Homo sapiens glycogenin 2 (GYG2), transcript variant 5, mRNA. | 804 |
| GYG2 | exonic | NM_003918 | Homo sapiens glycogenin 2 (GYG2), transcript variant 2, mRNA. | 805 |

Figure 11A (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| NUBPL | Intronic | NM_025152 | Homo sapiens nucleotide binding protein-like (NUBPL), nuclear gene encoding mitochondrial protein, transcript variant 1, mRNA. | This gene encodes a member of the Mrp/NBP35 ATP-binding proteins family. The encoded protein is required for the assembly of the respiratory chain NADH dehydrogenase (complex I), an oligomeric enzymatic complex located in the inner mitochondrial membrane. The respiratory complex I consists of 45 subunits and 8 iron-sulfur (Fe/S) clusters. This protein is an Fe/S protein that plays a critical role in the assembly of respiratory complex I, likely by transferring Fe/S into the Fe/S-containing complex I subunits. Mutations in this gene cause mitochondrial complex I deficiency. Alternatively spliced transcript variants encoding distinct isoforms have been identified.[provided by RefSeq, Jan 2011]. Transcript Variant: This variant (1) encodes the longest isoform (1). | 1341 |
| NUBPL | Intronic | NM_001201573 | Homo sapiens nucleotide binding protein-like (NUBPL), transcript variant 2, mRNA. | This gene encodes a member of the Mrp/NBP35 ATP-binding proteins family. The encoded protein is required for the assembly of the respiratory chain NADH dehydrogenase (complex I), an oligomeric enzymatic complex located in the inner mitochondrial membrane. The respiratory complex I consists of 45 subunits and 8 iron-sulfur (Fe/S) clusters. This protein is an Fe/S protein that plays a critical role in the assembly of respiratory complex I, likely by transferring Fe/S into the Fe/S-containing complex I subunits. Mutations in this gene cause mitochondrial complex I deficiency. Alternatively spliced transcript variants encoding distinct isoforms have been identified.[provided by RefSeq, Jan 2011]. Transcript Variant: This variant (2) lacks two exons from the 5' end and has an alternate 5' exon, as compared to variant 1. The resulting isoform (2) has a shorter N-terminus, as compared to isoform 1. Sequence Note: This RefSeq record was created from transcript and genomic sequence data to make the sequence consistent with the reference genome assembly. The genomic coordinates used for the transcript record were based on transcript alignments. | 1342 |
| NUBPL | Intronic | NM_001201574 | Homo sapiens nucleotide binding | This gene encodes a member of the Mrp/NBP35 ATP-binding proteins family. The encoded protein is required for the assembly of the respiratory chain | 1343 |

Figure 11B

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | protein-like (NUBPL), transcript variant 3, mRNA. | NADH dehydrogenase (complex I), an oligomeric enzymatic complex located in the inner mitochondrial membrane. The respiratory complex I consists of 45 subunits and 8 iron-sulfur (Fe/S) clusters. This protein is an Fe/S protein that plays a critical role in the assembly of respiratory complex I, likely by transferring Fe/S into the Fe/S-containing complex I subunits. Mutations in this gene cause mitochondrial complex I deficiency. Alternatively spliced transcript variants encoding distinct isoforms have been identified.[provided by RefSeq, Jan 2011]. Transcript Variant: This variant (3) lacks several exons from the 5' end and has an alternate 5' exon, as compared to variant 1. The resulting isoform (3) has a much shorter N-terminus, as compared to isoform 1. Sequence Note: This RefSeq record was created from transcript and genomic sequence data to make the sequence consistent with the reference genome assembly. The genomic coordinates used for the transcript record were based on transcript alignments. | |
| TNIK | Intronic | NM_001161560 | Homo sapiens TRAF2 and NCK interacting kinase (TNIK), transcript variant 2, mRNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (2) lacks an in-frame exon in the middle portion of the coding region compared to variant 1. This results in a shorter protein (isoform 2) compared to isoform 1. | 1344 |
| TNIK | Intronic | NM_001161561 | Homo sapiens TRAF2 and NCK interacting kinase (TNIK), transcript variant 3, mRNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (3) lacks an in-frame exon in the middle portion of the coding region compared to variant 1. This results in a shorter protein (isoform 3) compared to isoform 1. | 1345 |
| TNIK | Intronic | NM_001161562 | Homo sapiens TRAF2 and NCK interacting kinase (TNIK), | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. | 1346 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | transcript variant 4, mRNA. | Transcript Variant: This variant (4) lacks two in-frame exons in the middle portion of the coding region compared to variant 1. This results in a shorter protein (isoform 4) compared to isoform 1. | |
| TNIK | Intronic | NM_001161563 | Homo sapiens TRAF2 and NCK interacting kinase (TNIK), transcript variant 5, mRNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (5) lacks an in-frame exon in the middle portion of the coding region compared to variant 1. This results in a shorter protein (isoform 5) compared to isoform 1. | 1347 |
| TNIK | Intronic | NM_001161564 | Homo sapiens TRAF2 and NCK interacting kinase (TNIK), transcript variant 6, mRNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (6) lacks two in-frame exons in the middle portion of the coding region compared to variant 1. This results in a shorter protein (isoform 6) compared to isoform 1. | 1348 |
| TNIK | Intronic | NM_001161565 | Homo sapiens TRAF2 and NCK interacting kinase (TNIK), transcript variant 7, mRNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (7) lacks two in-frame exons in the middle portion of the coding region compared to variant 1. This results in a shorter protein (isoform 7) compared to isoform 1. | 1349 |
| TNIK | Intronic | NM_001161566 | Homo sapiens TRAF2 and NCK interacting kinase (TNIK), transcript variant 8, mRNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (8) lacks three in-frame exons in the middle portion of the coding region compared to variant 1. This results in a shorter protein (isoform 8) compared to isoform 1. | 1350 |
| TNIK | Intronic | NM_015028 | Homo sapiens TRAF2 and NCK interacting | Germinal center kinases (GCKs), such as TNIK, are characterized by an N-terminal kinase domain and a C-terminal GCK domain that serves a regulatory function (Fu et al., 1999 [PubMed | 1351 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | kinase (TNIK), transcript variant 1, mRNA. | 10521462]).[supplied by OMIM, Mar 2008]. Transcript Variant: This variant (1) represents the longest transcript and encodes the longest isoform (1). | |
| TNIK | Intronic | NR_027767 | Homo sapiens TRAF2 and NCK interacting kinase (TNIK), transcript variant 9, non-coding RNA. | Germinal center kinases (GCKs), such as TNIK, are characterized by an N-terminal kinase domain and a C-terminal GCK domain that serves a regulatory function (Fu et al., 1999 [PubMed 10521462]).[supplied by OMIM, Mar 2008]. Transcript Variant: This variant (9) lacks the majority of the middle and 3' regions and contains an alternate 3' terminal exon compared to variant 1. This variant is represented as non-coding because it lacks a large portion of the coding region found in variant 1. | 1352 |
| AIM1 | Exonic | NM_001624 | Homo sapiens absent in melanoma 1 (AIM1), mRNA. | N/A | 1353 |
| MGRN1 | Intronic | NM_001142289 | Homo sapiens mahogunin, ring finger 1 (MGRN1), transcript variant 2, mRNA. | Mahogunin (MGRN1) is a C3HC4 RING-containing protein with E3 ubiquitin ligase activity in vitro.[supplied by OMIM, Apr 2004]. Transcript Variant: This variant (2) lacks an alternate in-frame exon, compared to variant 1. The resulting isoform (2) has the same N- and C-termini but is shorter compared to isoform 1. Sequence Note: This RefSeq record was created from transcript and genomic sequence data to make the sequence consistent with the reference genome assembly. The genomic coordinates used for the transcript record were based on transcript alignments. | 1354 |
| MGRN1 | Intronic | NM_001142290 | Homo sapiens mahogunin, ring finger 1 (MGRN1), transcript variant 3, mRNA. | Mahogunin (MGRN1) is a C3HC4 RING-containing protein with E3 ubiquitin ligase activity in vitro.[supplied by OMIM, Apr 2004]. Transcript Variant: This variant (3) uses an alternate splice junction at the 5' end of the last exon compared to variant 1. The resulting isoform (3) has a shorter and distinct C-terminus compared to isoform 1. Sequence Note: This RefSeq record was created from transcript and genomic sequence data to make the sequence consistent with the reference genome assembly. The genomic coordinates used for the transcript record were based on transcript | 1355 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | alignments. | |
| MGRN1 | Intronic | NM_001142291 | Homo sapiens mahogunin, ring finger 1 (MGRN1), transcript variant 4, mRNA. | Mahogunin (MGRN1) is a C3HC4 RING-containing protein with E3 ubiquitin ligase activity in vitro.[supplied by OMIM, Apr 2004]. Transcript Variant: This variant (4) lacks an alternate in-frame exon and uses an alternate splice junction at the 5' end of the last exon compared to variant 1. The resulting isoform (4) is shorter and has a distinct C-terminus compared to isoform 1. Sequence Note: This RefSeq record was created from transcript and genomic sequence data to make the sequence consistent with the reference genome assembly. The genomic coordinates used for the transcript record were based on transcript alignments. | 1356 |
| MGRN1 | Intronic | NM_015246 | Homo sapiens mahogunin, ring finger 1 (MGRN1), transcript variant 1, mRNA. | Mahogunin (MGRN1) is a C3HC4 RING-containing protein with E3 ubiquitin ligase activity in vitro.[supplied by OMIM, Apr 2004]. Transcript Variant: This variant (1) encodes the longest isoform (1). Sequence Note: This RefSeq record was created from transcript and genomic sequence data to make the sequence consistent with the reference genome assembly. The genomic coordinates used for the transcript record were based on transcript alignments. | 1357 |
| SLC2A9 | Intronic | NM_001001290 | Homo sapiens solute carrier family 2 (facilitated glucose transporter), member 9 (SLC2A9), transcript variant 2, mRNA. | This gene encodes a member of the SLC2A facilitative glucose transporter family. Members of this family play a significant role in maintaining glucose homeostasis. The encoded protein may play a role in the development and survival of chondrocytes in cartilage matrices. Two transcript variants encoding distinct isoforms have been identified for this gene. [provided by RefSeq, Jul 2008]. Transcript Variant: This variant (2), also known as GLUT9deltaN, contains alternate in-frame segments in the 5' UTR and coding region and uses a different start codon, compared to variant 1. Isoform 2 has a shorter N-terminus, compared to isoform 1. | 1358 |
| SLC2A9 | Intronic | NM_020041 | Homo sapiens solute carrier family 2 (facilitated glucose transporter), | This gene encodes a member of the SLC2A facilitative glucose transporter family. Members of this family play a significant role in maintaining glucose homeostasis. The encoded protein may play a role in the development and survival of chondrocytes in cartilage matrices. Two transcript | 1359 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | member 9 (SLC2A9), transcript variant 1, mRNA. | variants encoding distinct isoforms have been identified for this gene. [provided by RefSeq, Jul 2008]. Transcript Variant: This variant (1) represents the shorter transcript, and encodes the longer isoform (1). | |
| A2M | Exonic | NM_000014 | Homo sapiens alpha-2-macroglobulin (A2M), mRNA. | Alpha-2-macroglobulin is a protease inhibitor and cytokine transporter. It inhibits many proteases, including trypsin, thrombin and collagenase. A2M is implicated in Alzheimer disease (AD) due to its ability to mediate the clearance and degradation of A-beta, the major component of beta-amyloid deposits. [provided by RefSeq, Jul 2008]. | 1360 |
| FLJ39080 | Intronic | NR_033830 | Homo sapiens uncharacterized LOC441355 (FLJ39080), non-coding RNA. | N/A | 1361 |
| EPAS1 | Intronic | NM_001430 | Homo sapiens endothelial PAS domain protein 1 (EPAS1), mRNA. | This gene encodes a transcription factor involved in the induction of genes regulated by oxygen, which is induced as oxygen levels fall. The encoded protein contains a basic-helix-loop-helix domain protein dimerization domain as well as a domain found in proteins in signal transduction pathways which respond to oxygen levels. Mutations in this gene are associated with erythrocytosis familial type 4. [provided by RefSeq, Nov 2009]. | 1362 |
| ENPP2 | Intronic | NM_001040092 | Homo sapiens ectonucleotide pyrophosphatase/phosphodiesterase 2 (ENPP2), transcript variant 2, mRNA. | The protein encoded by this gene functions as both a phosphodiesterase, which cleaves phosphodiester bonds at the 5' end of oligonucleotides, and a phospholipase, which catalyzes production of lysophosphatidic acid (LPA) in extracellular fluids. LPA evokes growth factor-like responses including stimulation of cell proliferation and chemotaxis. This gene product stimulates the motility of tumor cells and has angiogenic properties, and its expression is upregulated in several kinds of carcinomas. The gene product is secreted and further processed to make the biologically active form. Several alternatively spliced transcript variants encoding different isoforms have been identified. [provided by RefSeq, Aug 2008]. Transcript Variant: This variant (2) lacks an exon in the coding region, but maintains the reading frame, | 1363 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | compared to variant 1. The encoded isoform (2, also known as beta) is shorter than isoform 1. Publication Note: This RefSeq record includes a subset of the publications that are available for this gene. Please see the Gene record to access additional publications. | |
| ENPP2 | Intronic | NM_001130863 | Homo sapiens ectonucleotide pyrophosphatase/phosphodiesterase 2 (ENPP2), transcript variant 3, mRNA. | The protein encoded by this gene functions as both a phosphodiesterase, which cleaves phosphodiester bonds at the 5' end of oligonucleotides, and a phospholipase, which catalyzes production of lysophosphatidic acid (LPA) in extracellular fluids. LPA evokes growth factor-like responses including stimulation of cell proliferation and chemotaxis. This gene product stimulates the motility of tumor cells and has angiogenic properties, and its expression is upregulated in several kinds of carcinomas. The gene product is secreted and further processed to make the biologically active form. Several alternatively spliced transcript variants encoding different isoforms have been identified. [provided by RefSeq, Aug 2008]. Transcript Variant: This variant (3) lacks includes an alternate exon in the 5' coding region and lacks an exon in the 3' coding region, but maintains the reading frame, compared to variant 1. The encoded isoform (3, also known as gamma) is shorter than isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1364 |
| ENPP2 | Intronic | NM_006209 | Homo sapiens ectonucleotide pyrophosphatase/phosphodiesterase 2 (ENPP2), transcript variant 1, mRNA. | The protein encoded by this gene functions as both a phosphodiesterase, which cleaves phosphodiester bonds at the 5' end of oligonucleotides, and a phospholipase, which catalyzes production of lysophosphatidic acid (LPA) in extracellular fluids. LPA evokes growth factor-like responses including stimulation of cell proliferation and chemotaxis. This gene product stimulates the motility of tumor cells and has angiogenic properties, and its | 1365 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | expression is upregulated in several kinds of carcinomas. The gene product is secreted and further processed to make the biologically active form. Several alternatively spliced transcript variants encoding different isoforms have been identified. [provided by RefSeq, Aug 2008]. Transcript Variant: This variant (1) represents the longest transcript and encodes the longest isoform (1, also known as alpha). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | |
| ENPP2 | Intronic | NR_045555 | Homo sapiens ectonucleotide pyrophosphatase/phosphodiesterase 2 (ENPP2), transcript variant 4, non-coding RNA. | The protein encoded by this gene functions as both a phosphodiesterase, which cleaves phosphodiester bonds at the 5' end of oligonucleotides, and a phospholipase, which catalyzes production of lysophosphatidic acid (LPA) in extracellular fluids. LPA evokes growth factor-like responses including stimulation of cell proliferation and chemotaxis. This gene product stimulates the motility of tumor cells and has angiogenic properties, and its expression is upregulated in several kinds of carcinomas. The gene product is secreted and further processed to make the biologically active form. Several alternatively spliced transcript variants encoding different isoforms have been identified. [provided by RefSeq, Aug 2008]. Transcript Variant: This variant (4) uses an alternate 5'-most exon compared to variant 1. This variant is represented as non-coding due to the presence of an upstream ORF that is predicted to interfere with translation of the longest ORF; translation of the upstream ORF renders the transcript a candidate for nonsense-mediated mRNA decay (NMD). Publication Note: This RefSeq record includes a subset of the publications that are available for this gene. Please see the Gene record to access additional publications. | 1366 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| EYS | Intronic | NM_001142800 | Homo sapiens eyes shut homolog (Drosophila) (EYS), transcript variant 1, mRNA. | The product of this gene contains multiple epidermal growth factor (EGF)-like and LamG domains. The protein is expressed in the photoreceptor layer of the retina, and the gene is mutated in autosomal recessive retinitis pigmentosa. Multiple transcript variants encoding different isoforms have been found for this gene. [provided by RefSeq, Dec 2008]. Transcript Variant: This variant (1) represents the longest transcript and encodes the longest isoform (1). | 1367 |
| EYS | Intronic | NM_001142801 | Homo sapiens eyes shut homolog (Drosophila) (EYS), transcript variant 2, mRNA. | The product of this gene contains multiple epidermal growth factor (EGF)-like and LamG domains. The protein is expressed in the photoreceptor layer of the retina, and the gene is mutated in autosomal recessive retinitis pigmentosa. Multiple transcript variants encoding different isoforms have been found for this gene. [provided by RefSeq, Dec 2008]. Transcript Variant: This variant (2) uses an alternate exon and 3' UTR, compared to variant 1. The resulting isoform (2) has a substantially shorter and unique C-terminus, compared to isoform 1. | 1368 |
| EYS | Intronic | NM_198283 | Homo sapiens eyes shut homolog (Drosophila) (EYS), transcript variant 3, mRNA. | The product of this gene contains multiple epidermal growth factor (EGF)-like and LamG domains. The protein is expressed in the photoreceptor layer of the retina, and the gene is mutated in autosomal recessive retinitis pigmentosa. Multiple transcript variants encoding different isoforms have been found for this gene. [provided by RefSeq, Dec 2008]. Transcript Variant: This variant (3) uses an alternate splice pattern and 3' UTR, compared to variant 1. The resulting isoform (3) has a substantially shorter and unique C-terminus, compared to isoform 1. | 1369 |
| COL28A1 | Exonic | NM_001037763 | Homo sapiens collagen, type XXVIII, alpha 1 (COL28A1), mRNA. | COL28A1 belongs to a class of collagens containing von Willebrand factor (VWF; MIM 613160) type A (VWFA) domains (Veit et al., 2006 [PubMed 16330543]).[supplied by OMIM, Nov 2010]. | 1370 |
| PARD3B | Intronic | NM_057177 | Homo sapiens par-3 partitioning defective 3 homolog B (C. | N/A | 1371 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | elegans) (PARD3B), mRNA. | | |
| PARD3B | Intronic | NM_152526 | Homo sapiens par-3 partitioning defective 3 homolog B (C. elegans) (PARD3B), mRNA. | N/A | 1372 |
| PARD3B | Intronic | NM_205863 | Homo sapiens par-3 partitioning defective 3 homolog B (C. elegans) (PARD3B), mRNA. | N/A | 1373 |
| MOB2 | Intronic | NM_053005 | Homo sapiens MOB kinase activator 2 (MOB2), transcript variant 2, mRNA. | N/A | 1374 |
| MOB2 | Intronic | NM_001172223 | Homo sapiens MOB kinase activator 2 (MOB2), transcript variant 1, mRNA. | N/A | 1375 |
| WNK1 | Intronic | NM_001184985 | Homo sapiens WNK lysine deficient protein kinase 1 (WNK1), transcript variant 4, mRNA. | This gene encodes a member of the WNK subfamily of serine/threonine protein kinases. The encoded protein may be a key regulator of blood pressure by controlling the transport of sodium and chloride ions. Mutations in this gene have been associated with pseudohypoaldosteronism type II and hereditary sensory neuropathy type II. Alternatively spliced transcript variants encoding different isoforms have been described but the full-length nature of all of them has yet to be determined.[provided by RefSeq, May 2010]. | 1376 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | Transcript Variant: This variant (4) has multiple differences in the coding region but maintains the reading frame compared to variant 1. This variant represents the exon combination of the dorsal root ganglia and sciatic nerve variant described in Figure 2F of PubMed ID 18521183. This variant encodes isoform 4, which is longer than isoform 1. Sequence Note: The RefSeq transcript and protein were derived from genomic sequence to make the sequence consistent with the reference genome assembly. The genomic coordinates used for the transcript record were based on alignments. The combination of alternatively spliced exons within the coding region is inferred based on experimental evidence reported in Figures 2F and 3 from PubMed ID 18521183. | |
| WNK1 | Intronic | NM_014823 | Homo sapiens WNK lysine deficient protein kinase 1 (WNK1), transcript variant 2, mRNA. | This gene encodes a member of the WNK subfamily of serine/threonine protein kinases. The encoded protein may be a key regulator of blood pressure by controlling the transport of sodium and chloride ions. Mutations in this gene have been associated with pseudohypoaldosteronism type II and hereditary sensory neuropathy type II. Alternatively spliced transcript variants encoding different isoforms have been described but the full-length nature of all of them has yet to be determined.[provided by RefSeq, May 2010]. Transcript Variant: This variant (2) uses two alternative splice sites and lacks two exons in the coding region compared to variant 1. The resulting protein (isoform 2) is shorter but has the same N- and C-termini compared to isoform 1. Sequence Note: This RefSeq record was created from transcript and genomic sequence data to make the sequence consistent with the reference genome assembly. The genomic coordinates used for the transcript record were based on transcript alignments. | 1377 |
| WNK1 | Intronic | NM_018979 | Homo sapiens WNK lysine deficient protein kinase 1 (WNK1), transcript | This gene encodes a member of the WNK subfamily of serine/threonine protein kinases. The encoded protein may be a key regulator of blood pressure by controlling the transport of sodium and chloride ions. Mutations in this gene have been associated with pseudohypoaldosteronism type II | 1378 |

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | variant 1, mRNA. | and hereditary sensory neuropathy type II. Alternatively spliced transcript variants encoding different isoforms have been described but the full-length nature of all of them has yet to be determined.[provided by RefSeq, May 2010]. Transcript Variant: This variant (1) encodes the most common isoform (1), as indicated in PubMed ID 18521183. Sequence Note: This RefSeq record was created from transcript and genomic sequence data to make the sequence consistent with the reference genome assembly. The genomic coordinates used for the transcript record were based on transcript alignments. | |
| WNK1 | Intronic | NM_213655 | Homo sapiens WNK lysine deficient protein kinase 1 (WNK1), transcript variant 3, mRNA. | This gene encodes a member of the WNK subfamily of serine/threonine protein kinases. The encoded protein may be a key regulator of blood pressure by controlling the transport of sodium and chloride ions. Mutations in this gene have been associated with pseudohypoaldosteronism type II and hereditary sensory neuropathy type II. Alternatively spliced transcript variants encoding different isoforms have been described but the full-length nature of all of them has yet to be determined.[provided by RefSeq, May 2010]. Transcript Variant: This variant (3) has multiple differences in the coding region but maintains the reading frame compared to variant 1. This variant represents the exon combination of the brain and spinal cord variant described in Figure 2F of PubMed ID 18521183. This variant encodes isoform 3, which is longer than isoform 1. Sequence Note: This RefSeq record was created from transcript and genomic sequence data to make the sequence consistent with the reference genome assembly. The genomic coordinates used for the transcript record were based on transcript alignments. The combination of alternatively spliced exons within the coding region is inferred based on experimental evidence reported in Figures 2F and 3 from PubMed ID 18521183. | 1379 |
| TRPM7 | Exonic | NM_017672 | Homo sapiens transient receptor potential cation | The protein encoded by this gene is both an ion channel and a serine/threonine protein kinase. The kinase activity is essential for the ion channel function, which serves to increase intracellular | 1380 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | channel, subfamily M, member 7 (TRPM7), mRNA. | calcium levels and to help regulate magnesium ion homeostasis. Defects in this gene are a cause of amyotrophic lateral sclerosis-parkinsonism/dementia complex of Guam.[provided by RefSeq, May 2010]. Sequence Note: This RefSeq record was created from transcript and genomic sequence data to make the sequence consistent with the reference genome assembly. The genomic coordinates used for the transcript record were based on transcript alignments. | |
| FGGY | Both | NM_001113411 | Homo sapiens FGGY carbohydrate kinase domain containing (FGGY), transcript variant 1, mRNA. | This gene encodes a member of the FGGY kinase family which acts as a phosphotransferase. Some GWAS studies have found an association with amyotrophic lateral sclerosis patients, yet other GWAS studies have not found any association. [provided by RefSeq, Sep 2011]. | 1381 |
| FGGY | Both | NM_018291 | Homo sapiens FGGY carbohydrate kinase domain containing (FGGY), transcript variant 2, mRNA. | This gene encodes a member of the FGGY kinase family which acts as a phosphotransferase. Some GWAS studies have found an association with amyotrophic lateral sclerosis patients, yet other GWAS studies have not found any association. [provided by RefSeq, Sep 2011]. | 1382 |
| FGGY | Both | NM_001244714 | Homo sapiens FGGY carbohydrate kinase domain containing (FGGY), transcript variant 3, mRNA. | This gene encodes a member of the FGGY kinase family which acts as a phosphotransferase. Some GWAS studies have found an association with amyotrophic lateral sclerosis patients, yet other GWAS studies have not found any association. [provided by RefSeq, Sep 2011]. Transcript Variant: This variant (3) has multiple differences in the 5' UTR and in the coding region, compared to variant 1. The encoded protein (isoform 3) is shorter than isoform 1. | 1383 |
| PRKCB | Intronic | NM_002738 | Homo sapiens protein kinase C, beta (PRKCB), transcript variant 2, | Protein kinase C (PKC) is a family of serine- and threonine-specific protein kinases that can be activated by calcium and second messenger diacylglycerol. PKC family members phosphorylate a wide variety of protein targets and are known to be involved in diverse cellular signaling pathways. | 1384 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | PKC family members also serve as major receptors for phorbol esters, a class of tumor promoters. Each member of the PKC family has a specific expression profile and is believed to play a distinct role in cells. The protein encoded by this gene is one of the PKC family members. This protein kinase has been reported to be involved in many different cellular functions, such as B cell activation, apoptosis induction, endothelial cell proliferation, and intestinal sugar absorption. Studies in mice also suggest that this kinase may also regulate neuronal functions and correlate fear-induced conflict behavior after stress. Alternatively spliced transcript variants encoding distinct isoforms have been reported. [provided by RefSeq, Jul 2008]. Transcript Variant: This variant (2) represents the longer transcript and encodes the longer isoform (2). Sequence Note: This RefSeq record was created from transcript and genomic sequence data because no single transcript was available for the full length of the gene. The extent of this transcript is supported by transcript alignments. | |
| PRKCB | Intronic | NM_212535 | Homo sapiens protein kinase C, beta (PRKCB), transcript variant 1, mRNA. | Protein kinase C (PKC) is a family of serine- and threonine-specific protein kinases that can be activated by calcium and second messenger diacylglycerol. PKC family members phosphorylate a wide variety of protein targets and are known to be involved in diverse cellular signaling pathways. PKC family members also serve as major receptors for phorbol esters, a class of tumor promoters. Each member of the PKC family has a specific expression profile and is believed to play a distinct role in cells. The protein encoded by this gene is one of the PKC family members. This protein kinase has been reported to be involved in many different cellular functions, such as B cell activation, apoptosis induction, endothelial cell proliferation, and intestinal sugar absorption. Studies in mice also suggest that this kinase may also regulate neuronal functions and correlate fear-induced conflict behavior after stress. Alternatively spliced transcript variants encoding distinct isoforms have been reported. [provided by RefSeq, | 1385 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | Jul 2008]. Transcript Variant: This variant (1) uses an alternate splice junction at the 5' end of the last exon compared to variant 2. The resulting isoform (1) has a distinct and shorter C-terminus compared to isoform 2. Sequence Note: This RefSeq record was created from transcript and genomic sequence data because no single transcript was available for the full length of the gene. The extent of this transcript is supported by transcript alignments. | |
| RPS6KA2 | Intronic | NM_001006932 | Homo sapiens ribosomal protein S6 kinase, 90kDa, polypeptide 2 (RPS6KA2), transcript variant 2, mRNA. | This gene encodes a member of the RSK (ribosomal S6 kinase) family of serine/threonine kinases. This kinase contains 2 non-identical kinase catalytic domains and phosphorylates various substrates, including members of the mitogen-activated kinase (MAPK) signalling pathway. The activity of this protein has been implicated in controlling cell growth and differentiation. Alternate transcriptional splice variants, encoding different isoforms, have been characterized. [provided by RefSeq, Jul 2008]. Transcript Variant: This variant (2) differs in the 5' UTR and has multiple coding region differences, compared to variant 1. These differences result in translation initiation at an upstream ATG and an isoform (b) with a distinct N-terminus compared to isoform a. | 1386 |
| RPS6KA2 | Intronic | NM_021135 | Homo sapiens ribosomal protein S6 kinase, 90kDa, polypeptide 2 (RPS6KA2), transcript variant 1, mRNA. | This gene encodes a member of the RSK (ribosomal S6 kinase) family of serine/threonine kinases. This kinase contains 2 non-identical kinase catalytic domains and phosphorylates various substrates, including members of the mitogen-activated kinase (MAPK) signalling pathway. The activity of this protein has been implicated in controlling cell growth and differentiation. Alternate transcriptional splice variants, encoding different isoforms, have been characterized. [provided by RefSeq, Jul 2008]. Transcript Variant: This variant (1) represents the longer transcript but encodes the shorter isoform (a). | 1387 |
| MYLK4 | Intronic | NM_001012418 | Homo sapiens myosin light chain kinase family, member 4 (MYLK4), mRNA. | N/A | 1388 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| NELL1 | Intronic | NM_006157 | Homo sapiens NEL-like 1 (chicken) (NELL1), transcript variant 1, mRNA. | This gene encodes a cytoplasmic protein that contains epidermal growth factor (EGF)-like repeats. The encoded heterotrimeric protein may be involved in cell growth regulation and differentiation. A similar protein in rodents is involved in craniosynostosis. Two transcript variants encoding different isoforms have been found for this gene. [provided by RefSeq, Jan 2009]. Transcript Variant: This variant (1) represents the longer transcript and encodes the longer isoform 1. Publication Note: This RefSeq record includes a subset of the publications that are available for this gene. Please see the Gene record to access additional publications. | 1389 |
| NELL1 | Intronic | NM_201551 | Homo sapiens NEL-like 1 (chicken) (NELL1), transcript variant 2, mRNA. | This gene encodes a cytoplasmic protein that contains epidermal growth factor (EGF)-like repeats. The encoded heterotrimeric protein may be involved in cell growth regulation and differentiation. A similar protein in rodents is involved in craniosynostosis. Two transcript variants encoding different isoforms have been found for this gene. [provided by RefSeq, Jan 2009]. Transcript Variant: This variant (2) lacks an alternate in-frame exon compared to variant 1. The resulting isoform (2) has the same N- and C-termini but is shorter compared to isoform 1. Publication Note: This RefSeq record includes a subset of the publications that are available for this gene. Please see the Gene record to access additional publications. | 1390 |
| NME5 | Intronic | NM_003551 | Homo sapiens non-metastatic cells 5, protein expressed in (nucleoside-diphosphate kinase) (NME5), mRNA. | N/A | 1391 |
| CLSTN1 | Intronic | NM_001009566 | Homo sapiens calsyntenin 1 (CLSTN1), transcript variant 1, | N/A | 1392 |

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | | |
| CLSTN1 | Intronic | NM_014944 | Homo sapiens calsyntenin 1 (CLSTN1), transcript variant 2, mRNA. | N/A | 1393 |
| GMDS | Intronic | NM_001500 | Homo sapiens GDP-mannose 4,6-dehydratase (GMDS), mRNA. | GDP-mannose 4,6-dehydratase (GMD; EC 4.2.1.47) catalyzes the conversion of GDP-mannose to GDP-4-keto-6-deoxymannose, the first step in the synthesis of GDP-fucose from GDP-mannose, using NADP+ as a cofactor. The second and third steps of the pathway are catalyzed by a single enzyme, GDP-keto-6-deoxymannose 3,5-epimerase, 4-reductase, designated FX in humans (MIM 137020).[supplied by OMIM, Aug 2009]. | 1394 |
| SDK1 | Intronic | NM_152744 | Homo sapiens sidekick homolog 1, cell adhesion molecule (chicken) (SDK1), transcript variant 1, mRNA. | N/A | 1395 |
| SDK1 | Intronic | NM_001079653 | Homo sapiens sidekick homolog 1, cell adhesion molecule (chicken) (SDK1), transcript variant 2, mRNA. | N/A | 1396 |
| VPS13B | Exonic | NM_015243 | Homo sapiens vacuolar protein sorting 13 homolog B (yeast) (VPS13B), transcript variant 3, | This gene encodes a potential transmembrane protein that may function in vesicle-mediated transport and sorting of proteins within the cell. This protein may play a role in the development and the function of the eye, hematological system, and central nervous system. Mutations in this gene have been associated with Cohen syndrome. Multiple splice variants encoding distinct isoforms have been | 1397 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | identified for this gene. [provided by RefSeq, Jul 2008]. Transcript Variant: This variant (3) includes an alternate exon, which results in an early stop codon, compared to variant 5. The resulting isoform (3) has a shorter and distinct C-terminus, compared to isoform 5. Publication Note: This RefSeq record includes a subset of the publications that are available for this gene. Please see the Gene record to access additional publications. | |
| VPS13B | Exonic | NM_017890 | Homo sapiens vacuolar protein sorting 13 homolog B (yeast) (VPS13B), transcript variant 5, mRNA. | This gene encodes a potential transmembrane protein that may function in vesicle-mediated transport and sorting of proteins within the cell. This protein may play a role in the development and the function of the eye, hematological system, and central nervous system. Mutations in this gene have been associated with Cohen syndrome. Multiple splice variants encoding distinct isoforms have been identified for this gene. [provided by RefSeq, Jul 2008]. Transcript Variant: This variant (5) encodes the longest isoform (5). Publication Note: This RefSeq record includes a subset of the publications that are available for this gene. Please see the Gene record to access additional publications. | 1398 |
| VPS13B | Exonic | NM_152564 | Homo sapiens vacuolar protein sorting 13 homolog B (yeast) (VPS13B), transcript variant 1, mRNA. | This gene encodes a potential transmembrane protein that may function in vesicle-mediated transport and sorting of proteins within the cell. This protein may play a role in the development and the function of the eye, hematological system, and central nervous system. Mutations in this gene have been associated with Cohen syndrome. Multiple splice variants encoding distinct isoforms have been identified for this gene. [provided by RefSeq, Jul 2008]. Transcript Variant: This variant (1) lacks one alternate in-frame exon and includes a different in-frame exon, compared to variant 5. The resulting isoform (1) is shorter and varies within this region of the protein, but has the same C- and N-termini, compared to isoform 5. Publication Note: This RefSeq record includes a subset of the publications that are available for this gene. Please see the Gene record to access additional publications. | 1399 |
| VPS13B | Exonic | NM_181661 | Homo sapiens vacuolar protein sorting | This gene encodes a potential transmembrane protein that may function in vesicle-mediated transport and sorting of proteins within the cell. | 1400 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | 13 homolog B (yeast) (VPS13B), transcript variant 4, mRNA. | This protein may play a role in the development and the function of the eye, hematological system, and central nervous system. Mutations in this gene have been associated with Cohen syndrome. Multiple splice variants encoding distinct isoforms have been identified for this gene. [provided by RefSeq, Jul 2008]. Transcript Variant: This variant (4) uses an alternate splice site in the coding region, which results in introduction of a stop codon, compared to variant 5. The resulting isoform (4) has a shorter and distinct C-terminus, compared to isoform 5. Publication Note: This RefSeq record includes a subset of the publications that are available for this gene. Please see the Gene record to access additional publications. | |
| BCKDHB | Intronic | NM_000056 | Homo sapiens branched chain keto acid dehydrogenase E1, beta polypeptide (BCKDHB), nuclear gene encoding mitochondrial protein, transcript variant 2, mRNA. | Branched-chain keto acid dehydrogenase is a multienzyme complex associated with the inner membrane of mitochondria, and functions in the catabolism of branched-chain amino acids. The complex consists of multiple copies of 3 components: branched-chain alpha-keto acid decarboxylase (E1), lipoamide acyltransferase (E2) and lipoamide dehydrogenase (E3). This gene encodes the E1 beta subunit, and mutations therein have been associated with maple syrup urine disease (MSUD), type 1B, a disease characterized by a maple syrup odor to the urine in addition to mental and physical retardation, and feeding problems. Alternative splicing at this locus results in transcript variants with different 3' non-coding regions, but encoding the same isoform. [provided by RefSeq, Jul 2008]. Transcript Variant: This variant (2) is missing a segment in the 3' UTR compared to transcript variant 1, and thus has a shorter 3' UTR. Both variants 1 and 2 encode the same protein. | 1401 |
| BCKDHB | Intronic | NM_183050 | Homo sapiens branched chain keto acid dehydrogenase E1, beta polypeptide (BCKDHB), nuclear gene | Branched-chain keto acid dehydrogenase is a multienzyme complex associated with the inner membrane of mitochondria, and functions in the catabolism of branched-chain amino acids. The complex consists of multiple copies of 3 components: branched-chain alpha-keto acid decarboxylase (E1), lipoamide acyltransferase (E2) and lipoamide dehydrogenase (E3). This gene | 1402 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | encoding mitochondrial protein, transcript variant 1, mRNA. | encodes the E1 beta subunit, and mutations therein have been associated with maple syrup urine disease (MSUD), type 1B, a disease characterized by a maple syrup odor to the urine in addition to mental and physical retardation, and feeding problems. Alternative splicing at this locus results in transcript variants with different 3' non-coding regions, but encoding the same isoform. [provided by RefSeq, Jul 2008]. Transcript Variant: This variant (1) represents the longer transcript. Both variants 1 and 2 encode the same protein. Sequence Note: This RefSeq record was created from transcript and genomic sequence data to make the sequence consistent with the reference genome assembly. The extent of this transcript is supported by transcript alignments. | |
| EML1 | Exonic | NM_001008707 | Homo sapiens echinoderm microtubule associated protein like 1 (EML1), transcript variant 1, mRNA. | Human echinoderm microtubule-associated protein-like is a strong candidate for the Usher syndrome type 1A gene. Usher syndromes (USHs) are a group of genetic disorders consisting of congenital deafness, retinitis pigmentosa, and vestibular dysfunction of variable onset and severity depending on the genetic type. The disease process in USHs involves the entire brain and is not limited to the posterior fossa or auditory and visual systems. The USHs are catagorized as type I (USH1A, USH1B, USH1C, USH1D, USH1E and USH1F), type II (USH2A and USH2B) and type III (USH3). The type I is the most severe form. Gene loci responsible for these three types are all mapped. Two transcript variants encoding different isoforms have been found for this gene. [provided by RefSeq, Jul 2008]. Transcript Variant: This variant (1) represents the longer transcript and encodes the longer isoform (a). | 1403 |
| EML1 | Exonic | NM_004434 | Homo sapiens echinoderm microtubule associated protein like 1 (EML1), transcript variant 2, mRNA. | Human echinoderm microtubule-associated protein-like is a strong candidate for the Usher syndrome type 1A gene. Usher syndromes (USHs) are a group of genetic disorders consisting of congenital deafness, retinitis pigmentosa, and vestibular dysfunction of variable onset and severity depending on the genetic type. The disease process in USHs involves the entire brain and is not limited to the posterior fossa or auditory and visual | 1404 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | systems. The USHs are catagorized as type I (USH1A, USH1B, USH1C, USH1D, USH1E and USH1F), type II (USH2A and USH2B) and type III (USH3). The type I is the most severe form. Gene loci responsible for these three types are all mapped. Two transcript variants encoding different isoforms have been found for this gene. [provided by RefSeq, Jul 2008]. Transcript Variant: This variant (2) lacks an alternate in-frame exon compared to variant 1. The resulting isoform (b) has the same N- and C-termini but is shorter compared to isoform a. | |
| EML6 | Both | NM_001039753 | Homo sapiens echinoderm microtubule associated protein like 6 (EML6), mRNA. | N/A | 1405 |
| EHD4 | Intronic | NM_139265 | Homo sapiens EH-domain containing 4 (EHD4), mRNA. | N/A | 1406 |
| GRIK2 | Intronic | NM_001166247 | Homo sapiens glutamate receptor, ionotropic, kainate 2 (GRIK2), transcript variant 3, mRNA. | Glutamate receptors are the predominant excitatory neurotransmitter receptors in the mammalian brain and are activated in a variety of normal neurophysiologic processes. This gene product belongs to the kainate family of glutamate receptors, which are composed of four subunits and function as ligand-activated ion channels. The subunit encoded by this gene is subject to RNA editing at multiple sites within the first and second transmembrane domains, which is thought to alter the structure and function of the receptor complex. Alternatively spliced transcript variants encoding different isoforms have also been described for this gene. Mutations in this gene have been associated with autosomal recessive mental retardation. [provided by RefSeq, Jul 2008]. Transcript Variant: This variant (3) contains an additional exon in the 3' coding region, compared to transcript variant 1. The resulting isoform (3) is shorter and has a distinct C-terminus compared to isoform 1. RNA editing | 1407 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | changes Ile567Val, Tyr571Cys and Gln621Arg. Sequence Note: This RefSeq record was created from transcript and genomic sequence data to make the sequence consistent with the reference genome assembly. The genomic coordinates used for the transcript record were based on transcript alignments. | |
| GRIK2 | Intronic | NM_021956 | Homo sapiens glutamate receptor, ionotropic, kainate 2 (GRIK2), transcript variant 1, mRNA. | Glutamate receptors are the predominant excitatory neurotransmitter receptors in the mammalian brain and are activated in a variety of normal neurophysiologic processes. This gene product belongs to the kainate family of glutamate receptors, which are composed of four subunits and function as ligand-activated ion channels. The subunit encoded by this gene is subject to RNA editing at multiple sites within the first and second transmembrane domains, which is thought to alter the structure and function of the receptor complex. Alternatively spliced transcript variants encoding different isoforms have also been described for this gene. Mutations in this gene have been associated with autosomal recessive mental retardation. [provided by RefSeq, Jul 2008]. Transcript Variant: This variant (1) encodes the longer isoform (1). RNA editing changes Ile567Val, Tyr571Cys and Gln621Arg. Sequence Note: This RefSeq record was created from transcript and genomic sequence data to make the sequence consistent with the reference genome assembly. The genomic coordinates used for the transcript record were based on transcript alignments. | 1408 |
| GRIK2 | Intronic | NM_175768 | Homo sapiens glutamate receptor, ionotropic, kainate 2 (GRIK2), transcript variant 2, mRNA. | Glutamate receptors are the predominant excitatory neurotransmitter receptors in the mammalian brain and are activated in a variety of normal neurophysiologic processes. This gene product belongs to the kainate family of glutamate receptors, which are composed of four subunits and function as ligand-activated ion channels. The subunit encoded by this gene is subject to RNA editing at multiple sites within the first and second transmembrane domains, which is thought to alter the structure and function of the receptor complex. Alternatively spliced transcript variants encoding different isoforms have also been described for this | 1409 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | gene. Mutations in this gene have been associated with autosomal recessive mental retardation. [provided by RefSeq, Jul 2008]. Transcript Variant: This variant (2) contains an additional exon in the 3' coding region, compared to transcript variant 1. The resulting isoform (2) is shorter and has a distinct C-terminus compared to isoform 1. RNA editing changes Ile567Val, Tyr571Cys and Gln621Arg. Sequence Note: This RefSeq record was created from transcript and genomic sequence data to make the sequence consistent with the reference genome assembly. The genomic coordinates used for the transcript record were based on transcript alignments. | |
| PTGIS | Exonic | NM_000961 | Homo sapiens prostaglandin I2 (prostacyclin) synthase (PTGIS), mRNA. | This gene encodes a member of the cytochrome P450 superfamily of enzymes. The cytochrome P450 proteins are monooxygenases which catalyze many reactions involved in drug metabolism and synthesis of cholesterol, steroids and other lipids. However, this protein is considered a member of the cytochrome P450 superfamily on the basis of sequence similarity rather than functional similarity. This endoplasmic reticulum membrane protein catalyzes the conversion of prostglandin H2 to prostacyclin (prostaglandin I2), a potent vasodilator and inhibitor of platelet aggregation. An imbalance of prostacyclin and its physiological antagonist thromboxane A2 contribute to the development of myocardial infarction, stroke, and atherosclerosis. [provided by RefSeq, Jul 2008]. | 1410 |
| RYR2 | Intronic | NM_001035 | Homo sapiens ryanodine receptor 2 (cardiac) (RYR2), mRNA. | This gene encodes a ryanodine receptor found in cardiac muscle sarcoplasmic reticulum. The encoded protein is one of the components of a calcium channel, composed of a tetramer of the ryanodine receptor proteins and a tetramer of FK506 binding protein 1B proteins, that supplies calcium to cardiac muscle. Mutations in this gene are associated with stress-induced polymorphic ventricular tachycardia and arrhythmogenic right ventricular dysplasia. [provided by RefSeq, Jul 2008]. Publication Note: This RefSeq record includes a subset of the publications that are available for this gene. Please see the Gene record to access additional publications. | 1411 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| NRXN1 | Intronic | NM_001135659 | Homo sapiens neurexin 1 (NRXN1), transcript variant alpha2, mRNA. | Neurexins function in the vertebrate nervous system as cell adhesion molecules and receptors. Two neurexin genes are among the largest known in human (NRXN1 and NRXN3). By using alternate promoters, splice sites and exons, predictions of hundreds or even thousands of distinct mRNAs have been made. Most transcripts use the upstream promoter and encode alpha-neurexin isoforms; fewer transcripts are produced from the downstream promoter and encode beta-neurexin isoforms. Alpha-neurexins contain epidermal growth factor-like (EGF-like) sequences and laminin G domains, and they interact with neurexophilins. Beta-neurexins lack EGF-like sequences and contain fewer laminin G domains than alpha-neurexins. The RefSeq Project has decided to create only a few representative transcript variants of the multitude that are possible. [provided by RefSeq, Oct 2008]. Transcript Variant: This variant (alpha2) represents the transcript that encodes the longest protein (isoform alpha2) of the three representative RefSeq records. | 1412 |
| NRXN1 | Intronic | NM_004801 | Homo sapiens neurexin 1 (NRXN1), transcript variant alpha1, mRNA. | Neurexins function in the vertebrate nervous system as cell adhesion molecules and receptors. Two neurexin genes are among the largest known in human (NRXN1 and NRXN3). By using alternate promoters, splice sites and exons, predictions of hundreds or even thousands of distinct mRNAs have been made. Most transcripts use the upstream promoter and encode alpha-neurexin isoforms; fewer transcripts are produced from the downstream promoter and encode beta-neurexin isoforms. Alpha-neurexins contain epidermal growth factor-like (EGF-like) sequences and laminin G domains, and they interact with neurexophilins. Beta-neurexins lack EGF-like sequences and contain fewer laminin G domains than alpha-neurexins. The RefSeq Project has decided to create only a few representative transcript variants of the multitude that are possible. [provided by RefSeq, Oct 2008]. Transcript Variant: This variant (alpha1) lacks several segments in the coding region, as compared to variant alpha2. The resulting protein (isoform alpha1) is shorter when it is compared to isoform | 1413 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | alpha2. | |
| PARK2 | Both | NM_004562 | Homo sapiens parkinson protein 2, E3 ubiquitin protein ligase (parkin) (PARK2), transcript variant 1, mRNA. | The precise function of this gene is unknown; however, the encoded protein is a component of a multiprotein E3 ubiquitin ligase complex that mediates the targeting of substrate proteins for proteasomal degradation. Mutations in this gene are known to cause Parkinson disease and autosomal recessive juvenile Parkinson disease. Alternative splicing of this gene produces multiple transcript variants encoding distinct isoforms. Additional splice variants of this gene have been described but currently lack transcript support. [provided by RefSeq, Jul 2008]. Transcript Variant: Transcript variant 1 represents the predominant and full-length form of this gene. Sequence Note: This RefSeq record was created from transcript and genomic sequence data because no single transcript was available for the full length of the gene. The extent of this transcript is supported by transcript alignments. | 1414 |
| PARK2 | Both | NM_013987 | Homo sapiens parkinson protein 2, E3 ubiquitin protein ligase (parkin) (PARK2), transcript variant 2, mRNA. | The precise function of this gene is unknown; however, the encoded protein is a component of a multiprotein E3 ubiquitin ligase complex that mediates the targeting of substrate proteins for proteasomal degradation. Mutations in this gene are known to cause Parkinson disease and autosomal recessive juvenile Parkinson disease. Alternative splicing of this gene produces multiple transcript variants encoding distinct isoforms. Additional splice variants of this gene have been described but currently lack transcript support. [provided by RefSeq, Jul 2008]. Transcript Variant: Transcript variant 2 lacks exons 5 which is present in the full-length variant 1. Sequence Note: This RefSeq record was created from transcript and genomic sequence data because no single transcript was available for the full length of the gene. The extent of this transcript is supported by transcript alignments. | 1415 |
| PARK2 | Both | NM_013988 | Homo sapiens parkinson protein 2, E3 ubiquitin protein ligase | The precise function of this gene is unknown; however, the encoded protein is a component of a multiprotein E3 ubiquitin ligase complex that mediates the targeting of substrate proteins for proteasomal degradation. Mutations in this gene are | 1416 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | (parkin) (PARK2), transcript variant 3, mRNA. | known to cause Parkinson disease and autosomal recessive juvenile Parkinson disease. Alternative splicing of this gene produces multiple transcript variants encoding distinct isoforms. Additional splice variants of this gene have been described but currently lack transcript support. [provided by RefSeq, Jul 2008]. Transcript Variant: Transcript variant 3 lacks exons 3 to 5 present in the full-length transcript variant 1. Sequence Note: This RefSeq record was created from transcript and genomic sequence data because no single transcript was available for the full length of the gene. The extent of this transcript is supported by transcript alignments. | |
| NRXN1 | Intronic | NM_138735 | Homo sapiens neurexin 1 (NRXN1), transcript variant beta, mRNA. | Neurexins function in the vertebrate nervous system as cell adhesion molecules and receptors. Two neurexin genes are among the largest known in human (NRXN1 and NRXN3). By using alternate promoters, splice sites and exons, predictions of hundreds or even thousands of distinct mRNAs have been made. Most transcripts use the upstream promoter and encode alpha-neurexin isoforms; fewer transcripts are produced from the downstream promoter and encode beta-neurexin isoforms. Alpha-neurexins contain epidermal growth factor-like (EGF-like) sequences and laminin G domains, and they interact with neurexophilins. Beta-neurexins lack EGF-like sequences and contain fewer laminin G domains than alpha-neurexins. The RefSeq Project has decided to create only a few representative transcript variants of the multitude that are possible. [provided by RefSeq, Oct 2008]. Transcript Variant: This variant (beta) represents a beta neurexin transcript. It is transcribed from a downstream promoter, includes a different segment for its 5' UTR and 5' coding region, and lacks most of the 5' exons present in alpha transcripts, as compared to variant alpha2. The resulting protein (isoform beta) has a shorter and distinct N-terminus when it is compared to isoform alpha2. Sequence Note: The RefSeq transcript and protein were derived from transcript and genomic sequence to make the sequence consistent with the reference genome assembly. The genomic coordinates used | 1417 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | for the transcript record were based on alignments. | |
| HMGB3 | Both | NM_005342 | Homo sapiens high mobility group box 3 (HMGB3), mRNA. | HMGB3 belongs to the high mobility group (HMG) protein superfamily. Like HMG1 (MIM 163905) and HMG2 (MIM 163906), HMGB3 contains DNA-binding HMG box domains and is classified into the HMG box subfamily. Members of the HMG box subfamily are thought to play a fundamental role in DNA replication, nucleosome assembly and transcription (Wilke et al., 1997 [PubMed 9370291]; Nemeth et al., 2006 [PubMed 16945912]).[supplied by OMIM, Mar 2008]. | 1418 |
| KIAA1324 | Intronic | NM_020775 | Homo sapiens KIAA1324 (KIAA1324), mRNA. | N/A | 1419 |
| MIR548T | Intronic | NR_036093 | Homo sapiens microRNA 548t (MIR548T), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | 1420 |
| ADRA1A | Intronic | NM_033303 | Homo sapiens adrenergic, | Alpha-1-adrenergic receptors (alpha-1-ARs) are members of the G protein-coupled receptor | 1421 |

| RefSeq Gene Symbol(s) | Exon overlap | RefSeq Accession Number | mRNA Description | RefSeq Summary | SEQ ID |
|---|---|---|---|---|---|
| | | | alpha-1A-, receptor (ADRA1A), transcript variant 2, mRNA. | superfamily. They activate mitogenic responses and regulate growth and proliferation of many cells. There are 3 alpha-1-AR subtypes: alpha-1A, -1B and -1D, all of which signal through the Gq/11 family of G-proteins and different subtypes show different patterns of activation. This gene encodes alpha-1A-adrenergic receptor. Alternative splicing of this gene generates four transcript variants, which encode four different isoforms with distinct C-termini but having similar ligand binding properties. [provided by RefSeq, Jul 2008]. Transcript Variant: This variant (2) includes an alternate 3' terminal exon, compared to variant 3. It encodes isoform 2, which has a longer and distinct C-terminus, compared to isoform 3. | |
| ADRA1A | Intronic | NM_033302 | Homo sapiens adrenergic, alpha-1A-, receptor (ADRA1A), transcript variant 3, mRNA. | Alpha-1-adrenergic receptors (alpha-1-ARs) are members of the G protein-coupled receptor superfamily. They activate mitogenic responses and regulate growth and proliferation of many cells. There are 3 alpha-1-AR subtypes: alpha-1A, -1B and -1D, all of which signal through the Gq/11 family of G-proteins and different subtypes show different patterns of activation. This gene encodes alpha-1A-adrenergic receptor. Alternative splicing of this gene generates four transcript variants, which encode four different isoforms with distinct C-termini but having similar ligand binding properties. [provided by RefSeq, Jul 2008]. Transcript Variant: This variant (3) encodes the shortest isoform (3). | 1422 |
| ADRA1A | Intronic | NM_033304 | Homo sapiens adrenergic, alpha-1A-, receptor (ADRA1A), transcript variant 4, mRNA. | Alpha-1-adrenergic receptors (alpha-1-ARs) are members of the G protein-coupled receptor superfamily. They activate mitogenic responses and regulate growth and proliferation of many cells. There are 3 alpha-1-AR subtypes: alpha-1A, -1B and -1D, all of which signal through the Gq/11 family of G-proteins and different subtypes show different patterns of activation. This gene encodes alpha-1A-adrenergic receptor. Alternative splicing of this gene generates four transcript variants, which encode four different isoforms with distinct C-termini but having similar ligand binding properties. [provided by RefSeq, Jul 2008]. Transcript Variant: This variant (4) includes an | 1423 |

| RefSeq Gene Symbol(s) | Exon overlap | RefSeq Accession Number | mRNA Description | RefSeq Summary | SEQ ID |
|---|---|---|---|---|---|
| | | | | alternate 3' terminal exon, compared to variant 3. It encodes isoform 4, which has a longer and distinct C-terminus, compared to isoform 3. | |
| ADRA1A | Intronic | NM_000680 | Homo sapiens adrenergic, alpha-1A-, receptor (ADRA1A), transcript variant 1, mRNA. | Alpha-1-adrenergic receptors (alpha-1-ARs) are members of the G protein-coupled receptor superfamily. They activate mitogenic responses and regulate growth and proliferation of many cells. There are 3 alpha-1-AR subtypes: alpha-1A, -1B and -1D, all of which signal through the Gq/11 family of G-proteins and different subtypes show different patterns of activation. This gene encodes alpha-1A-adrenergic receptor. Alternative splicing of this gene generates four transcript variants, which encode four different isoforms with distinct C-termini but having similar ligand binding properties. [provided by RefSeq, Jul 2008]. Transcript Variant: This variant (1) is alternatively spliced in the 3' end, compared to variant 3. It encodes isoform 1, which has a longer and distinct C-terminus compared to isoform 3. | 1424 |
| ALDH7A1 | Exonic | NM_001182 | Homo sapiens aldehyde dehydrogenase 7 family, member A1 (ALDH7A1), nuclear gene encoding mitochondrial protein, transcript variant 1, mRNA. | The protein encoded by this gene is a member of subfamily 7 in the aldehyde dehydrogenase gene family. These enzymes are thought to play a major role in the detoxification of aldehydes generated by alcohol metabolism and lipid peroxidation. This particular member has homology to a previously described protein from the green garden pea, the 26g pea turgor protein. It is also involved in lysine catabolism that is known to occur in the mitochondrial matrix. Recent reports show that this protein is found both in the cytosol and the mitochondria, and the two forms likely arise from the use of alternative translation initiation sites. An additional variant encoding a different isoform has also been found for this gene. Mutations in this gene are associated with pyridoxine-dependent epilepsy. Several related pseudogenes have also been identified. [provided by RefSeq, Jan 2011]. Transcript Variant: This variant (1) encodes two isoforms resulting from the use of alternative in-frame translation initiation codons. The longer isoform (1) is derived from an upstream AUG (at nt 193-195), while the shorter isoform (2) is derived from a downstream AUG (at nt 277-279). This | 1425 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | RefSeq represents the longer isoform, which resides in the mitochondria (PMIDs: 20207735 and 19885858). Sequence Note: This Refseq, containing three potential in-frame translation initiation codons (all with weak Kozak signals), is annotated with a CDS starting from a downstream start codon (at nt 193-195) based on better conservation, N-terminal consistency with homologous proteins, and the presence of a transit peptide, which is essential for the localization of this isoform in the mitochondria (PMIDs: 20207735 and 19885858), and is consistent with the function of this gene in lysine catabolism (which is known to occur in the mitochondria). The use of an upstream start codon (at nt 112-114) that is present in only a subset of higher mammals, would increase the protein length by 27 aa. A shorter, soluble isoform resulting from the use of another downstream start codon (at nt 277-279) is represented in a separate RefSeq (NM_001201377.1). This RefSeq record was created from transcript and genomic sequence data to make the sequence consistent with the reference genome assembly. The extent of this transcript is supported by transcript alignments. Publication Note: This RefSeq record includes a subset of the publications that are available for this gene. Please see the Gene record to access additional publications. | |
| ALDH7A1 | Exonic | NM_001201377 | Homo sapiens aldehyde dehydrogenase 7 family, member A1 (ALDH7A1), transcript variant 1, mRNA. | The protein encoded by this gene is a member of subfamily 7 in the aldehyde dehydrogenase gene family. These enzymes are thought to play a major role in the detoxification of aldehydes generated by alcohol metabolism and lipid peroxidation. This particular member has homology to a previously described protein from the green garden pea, the 26g pea turgor protein. It is also involved in lysine catabolism that is known to occur in the mitochondrial matrix. Recent reports show that this protein is found both in the cytosol and the mitochondria, and the two forms likely arise from the use of alternative translation initiation sites. An additional variant encoding a different isoform has also been found for this gene. Mutations in this gene are associated with pyridoxine-dependent | 1426 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | epilepsy. Several related pseudogenes have also been identified. [provided by RefSeq, Jan 2011]. Transcript Variant: This variant (1) encodes two isoforms resulting from the use of alternative in-frame translation initiation codons. The longer isoform (1) is derived from an upstream AUG (at nt 193-195), while the shorter isoform (2) is derived from a downstream AUG (at nt 277-279). This RefSeq represents the shorter isoform, which is found in the cytosol (PMIDs: 20207735 and 19885858). Sequence Note: This Refseq, containing three potential in-frame translation initiation codons (all with weak Kozak signals), is annotated with a CDS starting from a downstream start codon (at nt 277-279), which results in a shorter, soluble isoform that is localized in the cytosol (PMIDs: 20207735 and 19885858). A longer isoform, resulting from the use of an upstream start codon (at nt 193-195) and localized in the mitochondria, is represented in a separate RefSeq (NM_001182.4). The use of another upstream start codon (at nt 112-114) that is present in only a subset of higher mammals, would increase the protein length by another 27 aa. This RefSeq record was created from transcript and genomic sequence data to make the sequence consistent with the reference genome assembly. The extent of this transcript is supported by transcript alignments. Publication Note: This RefSeq record includes a subset of the publications that are available for this gene. Please see the Gene record to access additional publications. | |
| ALDH7A1 | Exonic | NM_001202404 | Homo sapiens aldehyde dehydrogenase 7 family, member A1 (ALDH7A1), transcript variant 2, mRNA. | The protein encoded by this gene is a member of subfamily 7 in the aldehyde dehydrogenase gene family. These enzymes are thought to play a major role in the detoxification of aldehydes generated by alcohol metabolism and lipid peroxidation. This particular member has homology to a previously described protein from the green garden pea, the 26g pea turgor protein. It is also involved in lysine catabolism that is known to occur in the mitochondrial matrix. Recent reports show that this protein is found both in the cytosol and the mitochondria, and the two forms likely arise from the use of alternative translation initiation sites. An | 1427 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | additional variant encoding a different isoform has also been found for this gene. Mutations in this gene are associated with pyridoxine-dependent epilepsy. Several related pseudogenes have also been identified. [provided by RefSeq, Jan 2011]. Transcript Variant: This variant (2) is missing two in-frame coding exons compared to variant 1, resulting in a shorter isoform (3) lacking an internal protein segment compared to isoform 1. Sequence Note: This Refseq, containing three potential in-frame translation initiation codons (all with weak Kozak signals), is annotated with a CDS starting from the upstream start codon (at nt 112-114). While this variant has transcript support, the localization and/or function of this isoform is not known. Translation from the downstream AUGs (at nt 193-195 and 277-279) may occur by leaky scanning. This RefSeq record was created from transcript and genomic sequence data to make the sequence consistent with the reference genome assembly. The extent of this transcript is supported by transcript alignments. | |
| SNTG1 | Intronic | NM_018967 | Homo sapiens syntrophin, gamma 1 (SNTG1), mRNA. | The protein encoded by this gene is a member of the syntrophin family. Syntrophins are cytoplasmic peripheral membrane proteins that typically contain 2 pleckstrin homology (PH) domains, a PDZ domain that bisects the first PH domain, and a C-terminal domain that mediates dystrophin binding. This gene is specifically expressed in the brain. Transcript variants for this gene have been described, but their full-length nature has not been determined. [provided by RefSeq, Jul 2008]. | 1428 |
| CSMD1 | Intronic | NM_033225 | Homo sapiens CUB and Sushi multiple domains 1 (CSMD1), mRNA. | N/A | 1429 |
| DSCAM | Exonic | NM_001389 | Homo sapiens Down syndrome cell adhesion molecule (DSCAM), | N/A | 1430 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | transcript variant 1, mRNA. | | |
| NPFFR2 | Intronic | NM_004885 | Homo sapiens neuropeptide FF receptor 2 (NPFFR2), transcript variant 1, mRNA. | This gene encodes a member of a subfamily of G-protein-coupled neuropeptide receptors. This protein is activated by the neuropeptides A-18-amide (NPAF) and F-8-amide (NPFF) and may function in pain modulation and regulation of the opioid system. Alternative splicing results in multiple transcript variants. [provided by RefSeq, Jan 2009]. Transcript Variant: This variant (1) represents the longest transcript and encodes the longest isoform (1). | 1431 |
| NPFFR2 | Intronic | NM_001144756 | Homo sapiens neuropeptide FF receptor 2 (NPFFR2), transcript variant 3, mRNA. | This gene encodes a member of a subfamily of G-protein-coupled neuropeptide receptors. This protein is activated by the neuropeptides A-18-amide (NPAF) and F-8-amide (NPFF) and may function in pain modulation and regulation of the opioid system. Alternative splicing results in multiple transcript variants. [provided by RefSeq, Jan 2009]. Transcript Variant: This variant (3) differs in the 5' UTR, lacks a portion of the 5' coding region, and initiates translation at an alternate start codon, compared to variant 1. The encoded isoform (3) has a distinct N-terminus and is shorter than isoform 1. | 1432 |
| NPFFR2 | Intronic | NM_053036 | Homo sapiens neuropeptide FF receptor 2 (NPFFR2), transcript variant 2, mRNA. | This gene encodes a member of a subfamily of G-protein-coupled neuropeptide receptors. This protein is activated by the neuropeptides A-18-amide (NPAF) and F-8-amide (NPFF) and may function in pain modulation and regulation of the opioid system. Alternative splicing results in multiple transcript variants. [provided by RefSeq, Jan 2009]. Transcript Variant: This variant (2) contains an alternate exon in the 5' UTR that causes translation initiation at a downstream AUG, and results an isoform (2) with a shorter N-terminus compared to isoform 1. | 1433 |
| GNPNAT1 | Intronic | NM_198066 | Homo sapiens glucosamine-phosphate N-acetyltransferase 1 (GNPNAT1), | N/A | 1434 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | | |
| PAPD5 | Intronic | NM_001040284 | Homo sapiens PAP associated domain containing 5 (PAPD5), transcript variant 1, mRNA. | N/A | 1435 |
| PAPD5 | Intronic | NM_001040285 | Homo sapiens PAP associated domain containing 5 (PAPD5), transcript variant 2, mRNA. | N/A | 1436 |
| OXR1 | Intronic | NM_001198533 | Homo sapiens oxidation resistance 1 (OXR1), transcript variant 4, mRNA. | N/A | 1437 |
| OXR1 | Intronic | NM_018002 | Homo sapiens oxidation resistance 1 (OXR1), transcript variant 1, mRNA. | N/A | 1438 |
| OXR1 | Intronic | NM_001198532 | Homo sapiens oxidation resistance 1 (OXR1), transcript variant 3, mRNA. | N/A | 1439 |
| OXR1 | Intronic | NM_001198534 | Homo sapiens oxidation resistance 1 (OXR1), transcript variant 5, | N/A | 1440 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | | |
| OXR1 | Intronic | NM_001198535 | Homo sapiens oxidation resistance 1 (OXR1), transcript variant 6, mRNA. | N/A | 1441 |
| OXR1 | Intronic | NM_181354 | Homo sapiens oxidation resistance 1 (OXR1), transcript variant 2, mRNA. | N/A | 1442 |
| GSN | Intronic | NM_001127662 | Homo sapiens gelsolin (GSN), transcript variant 3, mRNA. | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (3) differs in the 5' UTR and coding sequence compared to variant 1. The resulting isoform (b) has a shorter N-terminus compared to isoform a. Variants 2, 3, 4, 5, and 6 all encode isoform b. | 1443 |
| GSN | Intronic | NM_001127663 | Homo sapiens gelsolin (GSN), transcript variant 4, mRNA. | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (4) differs in the 5' UTR and coding sequence compared to variant 1. The resulting isoform (b) has a shorter N-terminus compared to isoform a. Variants 2, 3, 4, 5, and 6 all encode isoform b. | 1444 |
| GSN | Intronic | NM_001 | Homo sapiens | The protein encoded by this gene binds to the 'plus' | 144 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | c | 127664 | gelsolin (GSN), transcript variant 5, mRNA. | ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (5) differs in the 5' UTR and coding sequence compared to variant 1. The resulting isoform (b) has a shorter N-terminus compared to isoform a. Variants 2, 3, 4, 5, and 6 all encode isoform b. | 5 |
| GSN | Intronic | NM_001127665 | Homo sapiens gelsolin (GSN), transcript variant 6, mRNA. | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (6) differs in the 5' UTR and coding sequence compared to variant 1. The resulting isoform (b) has a shorter N-terminus compared to isoform a. Variants 2, 3, 4, 5, and 6 all encode isoform b. | 1446 |
| GSN | Intronic | NM_001127666 | Homo sapiens gelsolin (GSN), transcript variant 7, mRNA. | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (7) differs in the 5' UTR and coding sequence compared to variant 1. The resulting isoform (c) has a shorter and distinct N-terminus compared to isoform a. Variants 7 and 8 both encode isoform c. | 1447 |
| GSN | Intronic | NM_001127667 | Homo sapiens gelsolin (GSN), transcript | The protein encoded by this gene binds to the 'plus' ends of actin monomers and filaments to prevent monomer exchange. The encoded calcium-regulated | 1448 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | variant 8, mRNA. | protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (8) differs in the 5' UTR and coding sequence compared to variant 1. The resulting isoform (c) has a shorter and distinct N-terminus compared to isoform a. Variants 7 and 8 both encode isoform c. | |
| GSN | Intronic | NM_198252 | Homo sapiens gelsolin (GSN), transcript variant 2, mRNA. | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (2) differs in the 5' UTR and coding sequence compared to variant 1. The resulting isoform (b) has a shorter N-terminus compared to isoform a. Variants 2, 3, 4, 5, and 6 all encode isoform b. | 1449 |
| GSN | Intronic | NM_000177 | Homo sapiens gelsolin (GSN), transcript variant 1, mRNA. | The protein encoded by this gene binds to the 'plus' ends of actin monomers and filaments to prevent monomer exchange. The encoded calcium-regulated protein functions in both assembly and disassembly of actin filaments. Defects in this gene are a cause of familial amyloidosis Finnish type (FAF). Multiple transcript variants encoding several different isoforms have been found for this gene. [provided by RefSeq, Jul 2008]. Transcript Variant: This variant (1) represents the longest isoform (a). | 1450 |
| ANGPT1 | Intronic | NM_001146 | Homo sapiens angiopoietin 1 (ANGPT1), transcript variant 1, mRNA. | Angiopoietins are proteins with important roles in vascular development and angiogenesis. All angiopoietins bind with similar affinity to an endothelial cell-specific tyrosine-protein kinase receptor. The protein encoded by this gene is a secreted glycoprotein that activates the receptor by inducing its tyrosine phosphorylation. It plays a critical role in mediating reciprocal interactions between the endothelium and surrounding matrix | 1451 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | and mesenchyme and inhibits endothelial permeability. The protein also contributes to blood vessel maturation and stability, and may be involved in early development of the heart. Alternative splicing results in multiple transcript variants encoding distinct isoforms.[provided by RefSeq, Dec 2010]. Transcript Variant: This variant (1) represents the longer transcript and encodes the longer isoform (1). | |
| ANGPT1 | Intronic | NM_001199859 | Homo sapiens angiopoietin 1 (ANGPT1), transcript variant 2, mRNA. | Angiopoietins are proteins with important roles in vascular development and angiogenesis. All angiopoietins bind with similar affinity to an endothelial cell-specific tyrosine-protein kinase receptor. The protein encoded by this gene is a secreted glycoprotein that activates the receptor by inducing its tyrosine phosphorylation. It plays a critical role in mediating reciprocal interactions between the endothelium and surrounding matrix and mesenchyme and inhibits endothelial permeability. The protein also contributes to blood vessel maturation and stability, and may be involved in early development of the heart. Alternative splicing results in multiple transcript variants encoding distinct isoforms.[provided by RefSeq, Dec 2010]. Transcript Variant: This variant (2) uses an alternate in-frame splice site in the coding region, compared to variant 1, which results in an isoform (2) that is one amino acid shorter than isoform 1. | 1452 |
| MAP4 | Intronic | NM_001134364 | Homo sapiens microtubule-associated protein 4 (MAP4), transcript variant 4, mRNA. | The protein encoded by this gene is a major non-neuronal microtubule-associated protein. This protein contains a domain similar to the microtubule-binding domains of neuronal microtubule-associated protein (MAP2) and microtubule-associated protein tau (MAPT/TAU). This protein promotes microtubule assembly, and has been shown to counteract destabilization of interphase microtubule catastrophe promotion. Cyclin B was found to interact with this protein, which targets cell division cycle 2 (CDC2) kinase to microtubules. The phosphorylation of this protein affects microtubule properties and cell cycle progression. Multiple transcript variants encoding different isoforms have been found for this gene. | 1453 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | [provided by RefSeq, Aug 2008]. Transcript Variant: This variant (4) lacks an alternate exon and uses an alternate splice site in the 3' coding region, compared to variant 1. The resulting protein (isoform 4) has a shorter and distinct C-terminus, compared to isoform 1. | |
| MAP4 | Intronic | NM_002375 | Homo sapiens microtubule-associated protein 4 (MAP4), transcript variant 1, mRNA. | The protein encoded by this gene is a major non-neuronal microtubule-associated protein. This protein contains a domain similar to the microtubule-binding domains of neuronal microtubule-associated protein (MAP2) and microtubule-associated protein tau (MAPT/TAU). This protein promotes microtubule assembly, and has been shown to counteract destabilization of interphase microtubule catastrophe promotion. Cyclin B was found to interact with this protein, which targets cell division cycle 2 (CDC2) kinase to microtubules. The phosphorylation of this protein affects microtubule properties and cell cycle progression. Multiple transcript variants encoding different isoforms have been found for this gene. [provided by RefSeq, Aug 2008]. Transcript Variant: This variant (1) represents the longest transcript. It encodes the longest isoform (1). | 1454 |
| MAP4 | Intronic | NM_030885 | Homo sapiens microtubule-associated protein 4 (MAP4), transcript variant 3, mRNA. | The protein encoded by this gene is a major non-neuronal microtubule-associated protein. This protein contains a domain similar to the microtubule-binding domains of neuronal microtubule-associated protein (MAP2) and microtubule-associated protein tau (MAPT/TAU). This protein promotes microtubule assembly, and has been shown to counteract destabilization of interphase microtubule catastrophe promotion. Cyclin B was found to interact with this protein, which targets cell division cycle 2 (CDC2) kinase to microtubules. The phosphorylation of this protein affects microtubule properties and cell cycle progression. Multiple transcript variants encoding different isoforms have been found for this gene. [provided by RefSeq, Aug 2008]. Transcript Variant: This variant (3) lacks multiple exons in the 3' region and uses an unique splice site at the 3' end-exon compared to variant 1. The resulting isoform (3) has a distinct and shorter C-terminus, as | 1455 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | compared to isoform 1. | |
| MYO1E | Intronic | NM_004998 | Homo sapiens myosin IE (MYO1E), mRNA. | N/A | 1456 |
| ODZ2 | Intronic | NM_001122679 | Homo sapiens odz, odd Oz/ten-m homolog 2 (Drosophila) (ODZ2), mRNA. | N/A | 1457 |
| SYNJ2BP | Intronic | NM_018373 | Homo sapiens synaptojanin 2 binding protein (SYNJ2BP), mRNA. | N/A | 1458 |
| SYNJ2BP-COX16 | Intronic | NM_001202547 | Homo sapiens SYNJ2BP-COX16 readthrough (SYNJ2BP-COX16), transcript variant 1, mRNA. | This locus represents naturally occurring read-through transcription between the neighboring SYNJ2BP (synaptojanin 2 binding protein) and COX16 (COX16 cytochrome c oxidase assembly homolog (S. cerevisiae)) genes on chromosome 14. The read-through transcript produces a fusion protein that shares sequence identity with each individual gene product. Alternate splicing results in multiple transcript variants that encode different isoforms. [provided by RefSeq, Feb 2011]. Transcript Variant: This variant (1) represents the longest transcript and encodes the longest isoform (1). Sequence Note: This RefSeq record was created from transcript and genomic sequence data to make the sequence consistent with the reference genome assembly. The genomic coordinates used for the transcript record were based on transcript alignments. | 1459 |
| SYNJ2BP-COX16 | Intronic | NM_001202548 | Homo sapiens SYNJ2BP-COX16 readthrough (SYNJ2BP-COX16), transcript variant 2, mRNA. | This locus represents naturally occurring read-through transcription between the neighboring SYNJ2BP (synaptojanin 2 binding protein) and COX16 (COX16 cytochrome c oxidase assembly homolog (S. cerevisiae)) genes on chromosome 14. The read-through transcript produces a fusion protein that shares sequence identity with each individual gene product. Alternate splicing results in multiple transcript variants that encode different | 1460 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | isoforms. [provided by RefSeq, Feb 2011]. Transcript Variant: This variant (2) has multiple differences in the coding region but maintains the reading frame, compared to variant 1. The encoded isoform (2) is shorter than isoform 1. Sequence Note: This RefSeq record was created from transcript and genomic sequence data to make the sequence consistent with the reference genome assembly. The genomic coordinates used for the transcript record were based on transcript alignments. | |
| SYNJ2BP-COX16 | Intronic | NM_001202549 | Homo sapiens SYNJ2BP-COX16 readthrough (SYNJ2BP-COX16), transcript variant 3, mRNA. | This locus represents naturally occurring read-through transcription between the neighboring SYNJ2BP (synaptojanin 2 binding protein) and COX16 (COX16 cytochrome c oxidase assembly homolog (S. cerevisiae)) genes on chromosome 14. The read-through transcript produces a fusion protein that shares sequence identity with each individual gene product. Alternate splicing results in multiple transcript variants that encode different isoforms. [provided by RefSeq, Feb 2011]. Transcript Variant: This variant (3) lacks an in-frame exon in the coding region, compared to variant 1. The encoded isoform (3) is shorter than isoform 1. Sequence Note: This RefSeq record was created from transcript and genomic sequence data to make the sequence consistent with the reference genome assembly. The genomic coordinates used for the transcript record were based on transcript alignments. | 1461 |
| CYP2A6 | Exonic | NM_000762 | Homo sapiens cytochrome P450, family 2, subfamily A, polypeptide 6 (CYP2A6), mRNA. | This gene, CYP2A6, encodes a member of the cytochrome P450 superfamily of enzymes. The cytochrome P450 proteins are monooxygenases which catalyze many reactions involved in drug metabolism and synthesis of cholesterol, steroids and other lipids. This protein localizes to the endoplasmic reticulum and its expression is induced by phenobarbital. The enzyme is known to hydroxylate coumarin, and also metabolizes nicotine, aflatoxin B1, nitrosamines, and some pharmaceuticals. Individuals with certain allelic variants are said to have a poor metabolizer phenotype, meaning they do not efficiently metabolize coumarin or nicotine. This gene is part | 1462 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | of a large cluster of cytochrome P450 genes from the CYP2A, CYP2B and CYP2F subfamilies on chromosome 19q. The gene was formerly referred to as CYP2A3; however, it has been renamed CYP2A6. [provided by RefSeq, Jul 2008]. | |
| NF1 | Intronic | NM_000267 | Homo sapiens neurofibromin 1 (NF1), transcript variant 2, mRNA. | This gene product appears to function as a negative regulator of the ras signal transduction pathway. Mutations in this gene have been linked to neurofibromatosis type 1, juvenile myelomonocytic leukemia and Watson syndrome. The mRNA for this gene is subject to RNA editing (CGA>UGA->Arg1306Term) resulting in premature translation termination. Alternatively spliced transcript variants encoding different isoforms have also been described for this gene. [provided by RefSeq, Jul 2008]. Transcript Variant: This variant (2) lacks an in-frame coding exon compared to transcript variant 1, resulting in a shorter isoform (2) missing an internal 21 aa segment, compared to isoform 1. Sequence Note: This RefSeq record was created from transcript and genomic sequence data to make the sequence consistent with the reference genome assembly. The genomic coordinates used for the transcript record were based on transcript alignments. | 1463 |
| NF1 | Intronic | NM_001042492 | Homo sapiens neurofibromin 1 (NF1), transcript variant 1, mRNA. | This gene product appears to function as a negative regulator of the ras signal transduction pathway. Mutations in this gene have been linked to neurofibromatosis type 1, juvenile myelomonocytic leukemia and Watson syndrome. The mRNA for this gene is subject to RNA editing (CGA>UGA->Arg1306Term) resulting in premature translation termination. Alternatively spliced transcript variants encoding different isoforms have also been described for this gene. [provided by RefSeq, Jul 2008]. Transcript Variant: This variant (1), with an additional in-frame coding exon, represents the longest transcript and encodes the longest isoform (1). Studies suggest preferential C->U RNA editing of transcripts containing this exon. Sequence Note: This RefSeq record was created from transcript and genomic sequence data to make the sequence consistent with the reference genome assembly. The genomic coordinates used for the transcript record | 1464 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | were based on transcript alignments. | |
| NF1 | Intronic | NM_001128147 | Homo sapiens neurofibromin 1 (NF1), transcript variant 3, mRNA. | This gene product appears to function as a negative regulator of the ras signal transduction pathway. Mutations in this gene have been linked to neurofibromatosis type 1, juvenile myelomonocytic leukemia and Watson syndrome. The mRNA for this gene is subject to RNA editing (CGA>UGA->Arg1306Term) resulting in premature translation termination. Alternatively spliced transcript variants encoding different isoforms have also been described for this gene. [provided by RefSeq, Jul 2008]. Transcript Variant: This variant (3) lacks multiple 3' exons and has an alternate 3' end, as compared to variant 1. The resulting isoform (3) has a much shorter and different C-terminus, and lacks ras-GTPase activating domain and SEC14 domain, compared to isoform 1. | 1465 |
| ANKS1B | Intronic | NM_152788 | Homo sapiens ankyrin repeat and sterile alpha motif domain containing 1B (ANKS1B), transcript variant 1, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (1) represents the longest transcript and encodes the longest isoform (a, also known as AIDA-1b). Publication Note: This RefSeq record includes a subset of the publications that are available for this gene. Please see the Gene record to access additional publications. | 1466 |
| ANKS1B | Intronic | NM_001204065 | Homo sapiens ankyrin repeat and sterile alpha motif domain containing 1B (ANKS1B), transcript | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with | 1467 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | variant 4, mRNA. | t(1;19) translocation. Alternatively spliced transcript variants encoding different isoforms (some with different subcellular localization, PMID:15004329) have been described for this gene. [provided by RefSeq, Aug 2011]. Transcript Variant: This variant (4) differs in the 5' UTR and coding region, in the 3' UTR and coding region, and contains an alternate in-frame exon compared to variant 1. The resulting isoform (d) has a shorter N-terminus, a longer and distinct C-terminus, and an additional segment compared to isoform a. Publication Note: This RefSeq record includes a subset of the publications that are available for this gene. Please see the Gene record to access additional publications. | |
| ANKS1B | Intronic | NM_001204066 | Homo sapiens ankyrin repeat and sterile alpha motif domain containing 1B (ANKS1B), transcript variant 5, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (5) differs in the 5' UTR and coding region, in the 3' UTR and coding region, lacks an alternate in-frame segment, and contains an alternate in-frame exon compared to variant 1. The resulting isoform (e) has a shorter N-terminus, a longer and distinct C-terminus, a missing segment, and an additional segment compared to isoform a. Publication Note: This RefSeq record includes a subset of the publications that are available for this gene. Please see the Gene record to access additional publications. | 1468 |
| ANKS1B | Intronic | NM_001204067 | Homo sapiens ankyrin repeat and sterile alpha motif domain | This gene encodes a multi-domain protein that is predominantly expressed in brain and testis. This protein interacts with amyloid beta protein precursor (AbetaPP) and may have a role in normal brain development, and in the pathogenesis of | 1469 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | containing 1B (ANKS1B), transcript variant 6, mRNA. | Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (6) differs in the 5' UTR and coding region, in the 3' UTR and coding region, and lacks an alternate in-frame exon compared to variant 1. The resulting isoform (f) has a shorter and distinct N-terminus, a longer and distinct C-terminus, and a missing segment compared to isoform a. Publication Note: This RefSeq record includes a subset of the publications that are available for this gene. Please see the Gene record to access additional publications. | |
| ANKS1B | Intronic | NM_001204068 | Homo sapiens ankyrin repeat and sterile alpha motif domain containing 1B (ANKS1B), transcript variant 7, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (7) differs in the 5' UTR and coding region and in the 3' UTR and coding region compared to variant 1. The resulting isoform (g, also known as AIDA-1a) has a shorter and distinct N-terminus and a shorter and distinct C-terminus compared to isoform a. Publication Note: This RefSeq record includes a subset of the publications that are available for this gene. Please see the Gene record to access additional publications. | 1470 |
| ANKS1B | Intronic | NM_001204069 | Homo sapiens ankyrin repeat and sterile alpha motif | This gene encodes a multi-domain protein that is predominantly expressed in brain and testis. This protein interacts with amyloid beta protein precursor (AbetaPP) and may have a role in normal | 1471 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | domain containing 1B (ANKS1B), transcript variant 8, mRNA. | brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (8) differs in the 5' UTR and coding region, in the 3' UTR and coding region, lacks an alternate in-frame exon, and contains an alternate in-frame exon compared to variant 1. The resulting isoform (h) has a shorter and distinct N-terminus, a longer and distinct C-terminus, a missing segment, and an additional segment compared to isoform a. Publication Note: This RefSeq record includes a subset of the publications that are available for this gene. Please see the Gene record to access additional publications. | |
| ANKS1B | Intronic | NM_001204070 | Homo sapiens ankyrin repeat and sterile alpha motif domain containing 1B (ANKS1B), transcript variant 9, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (9) differs in the 5' UTR and coding region, in the 3' UTR and coding region, and lacks an alternate in-frame exon compared to variant 1. The resulting isoform (i, also known as AIDA-1c) has a shorter and distinct N-terminus, a longer and distinct C-terminus, and a missing segment compared to isoform a. Publication Note: This RefSeq record includes a subset of the publications that are available for this gene. Please see the Gene record to access additional publications. | 1472 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| ANKS1B | Intronic | NM_001204079 | Homo sapiens ankyrin repeat and sterile alpha motif domain containing 1B (ANKS1B), transcript variant 10, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (10) differs in the 5' UTR and coding region, in the 3' UTR and coding region, and contains an alternate in-frame exon compared to variant 1. The resulting isoform (j) has a shorter N-terminus, a longer and distinct C-terminus, and an additional segment compared to isoform a. Publication Note: This RefSeq record includes a subset of the publications that are available for this gene. Please see the Gene record to access additional publications. | 1473 |
| ANKS1B | Intronic | NM_001204080 | Homo sapiens ankyrin repeat and sterile alpha motif domain containing 1B (ANKS1B), transcript variant 11, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (11) differs in the 5' UTR and coding region and in the 3' UTR and coding region compared to variant 1. The resulting isoform (k) has a shorter and distinct N-terminus and a longer and distinct C-terminus compared to isoform a. Publication Note: This RefSeq record includes a subset of the publications that are available for this gene. Please see the Gene record to access | 1474 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | additional publications. | |
| ANKS1B | Intronic | NM_001204081 | Homo sapiens ankyrin repeat and sterile alpha motif domain containing 1B (ANKS1B), transcript variant 12, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (12) differs in the 5' UTR and coding region compared to variant 1. The resulting isoform (l) has a shorter and distinct N-terminus compared to isoform a. Publication Note: This RefSeq record includes a subset of the publications that are available for this gene. Please see the Gene record to access additional publications. | 1475 |
| ANKS1B | Intronic | NM_020140 | Homo sapiens ankyrin repeat and sterile alpha motif domain containing 1B (ANKS1B), transcript variant 3, mRNA. | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (3) differs in the 5' UTR and coding region and lacks an alternate in-frame exon compared to variant 1. The resulting isoform (c) has a shorter and distinct N-terminus and lacks an alternate segment compared to isoform a. Publication Note: This RefSeq record includes a subset of the publications that are available for this gene. Please see the Gene record to access additional publications. | 1476 |
| ANK | Intronic | NM_181 | Homo sapiens | This gene encodes a multi-domain protein that is | 147 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| S1B | c | 670 | ankyrin repeat and sterile alpha motif domain containing 1B (ANKS1B), transcript variant 2, mRNA. | predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1;19) translocation. Alternatively spliced transcript variants encoding different isoforms (some with different subcellular localization, PMID:15004329) have been described for this gene. [provided by RefSeq, Aug 2011]. Transcript Variant: This variant (2) differs in the 5' UTR and coding region, in the 3' UTR and coding region, and contains an alternate in-frame exon compared to variant 1. The resulting isoform (b) has a shorter and distinct N-terminus, a longer and distinct C-terminus, and an additional segment compared to isoform a. Publication Note: This RefSeq record includes a subset of the publications that are available for this gene. Please see the Gene record to access additional publications. | 7 |
| OGT | Exonic | NM_181672 | Homo sapiens O-linked N-acetylglucosamine (GlcNAc) transferase (UDP-N-acetylglucosamine:polypeptide -N-acetylglucosaminyl transferase) (OGT), transcript variant 1, mRNA. | This gene encodes a glycosyltransferase that catalyzes the addition of a single N-acetylglucosamine in O-glycosidic linkage to serine or threonine residues. Since both phosphorylation and glycosylation compete for similar serine or threonine residues, the two processes may compete for sites, or they may alter the substrate specificity of nearby sites by steric or electrostatic effects. The protein contains multiple tetratricopeptide repeats that are required for optimal recognition of substrates. Alternatively spliced transcript variants encoding distinct isoforms have been found for this gene. [provided by RefSeq, Oct 2009]. Transcript Variant: This variant (1) encodes the longer isoform (1). | 1478 |
| OGT | Exonic | NM_181673 | Homo sapiens O-linked N-acetylglucosamine (GlcNAc) transferase (UDP-N- | This gene encodes a glycosyltransferase that catalyzes the addition of a single N-acetylglucosamine in O-glycosidic linkage to serine or threonine residues. Since both phosphorylation and glycosylation compete for similar serine or threonine residues, the two processes may compete | 1479 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | acetylglucosamine:polypeptide-N-acetylglucosaminyl transferase) (OGT), transcript variant 2, mRNA. | for sites, or they may alter the substrate specificity of nearby sites by steric or electrostatic effects. The protein contains multiple tetratricopeptide repeats that are required for optimal recognition of substrates. Alternatively spliced transcript variants encoding distinct isoforms have been found for this gene. [provided by RefSeq, Oct 2009]. Transcript Variant: This variant (2) uses an alternate in-frame splice site in the 5' coding region compared to variant 1. This results in a shorter protein (isoform 2) compared to isoform 1. | |
| PALM2 | Intronic | NM_001037293 | Homo sapiens paralemmin 2 (PALM2), transcript variant 2, mRNA. | N/A | 1480 |
| PALM2 | Intronic | NM_053016 | Homo sapiens paralemmin 2 (PALM2), transcript variant 1, mRNA. | N/A | 1481 |
| PALM2-AKAP2 | Intronic | NM_007203 | Homo sapiens PALM2-AKAP2 readthrough (PALM2-AKAP2), transcript variant 1, mRNA. | PALM2-AKAP2 mRNAs are naturally occurring read-through products of the neighboring PALM2 and AKAP2 genes. The significance of these read-through mRNAs and the function the resulting fusion protein products have not yet been determined. Alternative splicing of this gene results in several transcript variants encoding different isoforms, but the full-length nature of some of these variants has not been defined. [provided by RefSeq, Oct 2010]. Transcript Variant: This variant (1) is a longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. | 1482 |
| PALM2-AKAP2 | Intronic | NM_147150 | Homo sapiens PALM2-AKAP2 readthrough | PALM2-AKAP2 mRNAs are naturally occurring read-through products of the neighboring PALM2 and AKAP2 genes. The significance of these read-through mRNAs and the function the resulting | 1483 |

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | (PALM2-AKAP2), transcript variant 2, mRNA. | fusion protein products have not yet been determined. Alternative splicing of this gene results in several transcript variants encoding different isoforms, but the full-length nature of some of these variants has not been defined. [provided by RefSeq, Oct 2010]. Transcript Variant: This variant (2) lacks an in-frame exon near the 3' coding region compared to variant 1. It encodes a shorter isoform (2) but has identical N- and C-termini to isoform 1. | |
| PPFIA2 | Intronic | NM_001220473 | Homo sapiens protein tyrosine phosphatase, receptor type, f polypeptide (PTPRF), interacting protein (liprin), alpha 2 (PPFIA2), transcript variant 2, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (2) has multiple differences in the UTRs and coding region, compared to variant 1. It encodes isoform b, which is shorter and has a distinct C-terminus, compared to isoform a. | 1484 |
| PPFIA2 | Intronic | NM_001220474 | Homo sapiens protein tyrosine phosphatase, receptor type, f polypeptide (PTPRF), interacting protein (liprin), alpha 2 (PPFIA2), transcript variant 3, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this | 1485 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | gene is found to be downregulated by androgens in a prostate cancer cell line. Alternative splicing results in multiple transcript variants encoding different isoforms. [provided by RefSeq, May 2011]. Transcript Variant: This variant (3) has multiple differences in the UTRs and coding region, compared to variant 1. It encodes isoform c, which is shorter and has a distinct C-terminus, compared to isoform a. | |
| PPFIA2 | Intronic | NM_001220475 | Homo sapiens protein tyrosine phosphatase, receptor type, f polypeptide (PTPRF), interacting protein (liprin), alpha 2 (PPFIA2), transcript variant 4, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (4) lacks an in-frame exon in the coding region, compared to variant 1. It encodes isoform d, which is shorter than isoform a. | 1486 |
| PPFIA2 | Intronic | NM_001220476 | Homo sapiens protein tyrosine phosphatase, receptor type, f polypeptide (PTPRF), interacting protein (liprin), alpha 2 (PPFIA2), transcript variant 5, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in | 1487 |

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | a prostate cancer cell line. Alternative splicing results in multiple transcript variants encoding different isoforms. [provided by RefSeq, May 2011]. Transcript Variant: This variant (5) uses an alternate in-frame splice site in the coding region, compared to variant 1. It encodes isoform e, which is shorter than isoform a. | |
| PPFIA2 | Intronic | NM_003625 | Homo sapiens protein tyrosine phosphatase, receptor type, f polypeptide (PTPRF), interacting protein (liprin), alpha 2 (PPFIA2), transcript variant 1, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (1) encodes the longest isoform (a). | 1488 |
| PPFIA2 | Intronic | NM_001220477 | Homo sapiens protein tyrosine phosphatase, receptor type, f polypeptide (PTPRF), interacting protein (liprin), alpha 2 (PPFIA2), transcript variant 6, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (6) has | 1489 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | multiple differences in the 5' UTR and coding region, compared to variant 1. It encodes isoform f, which is shorter and has a distinct N-terminus, compared to isoform a. | |
| PPFIA2 | Intronic | NM_001220478 | Homo sapiens protein tyrosine phosphatase, receptor type, f polypeptide (PTPRF), interacting protein (liprin), alpha 2 (PPFIA2), transcript variant 7, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (7) has multiple differences in the 5' UTR and coding region, compared to variant 1. It encodes isoform g, which is shorter and has a distinct N-terminus, compared to isoform a. | 1490 |
| PPFIA2 | Intronic | NM_001220479 | Homo sapiens protein tyrosine phosphatase, receptor type, f polypeptide (PTPRF), interacting protein (liprin), alpha 2 (PPFIA2), transcript variant 9, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (9) has | 1491 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | multiple differences in the 5' UTR and coding region, compared to variant 1. It encodes isoform h, which is shorter and has a distinct N-terminus, compared to isoform a. | |
| PPFIA2 | Intronic | NM_001220480 | Homo sapiens protein tyrosine phosphatase, receptor type, f polypeptide (PTPRF), interacting protein (liprin), alpha 2 (PPFIA2), transcript variant 10, mRNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (10) has multiple differences in the 5' UTR and coding region, compared to variant 1. It encodes isoform i, which is shorter and has a distinct N-terminus, compared to isoform a. | 1492 |
| PPFIA2 | Intronic | NR_038265 | Homo sapiens protein tyrosine phosphatase, receptor type, f polypeptide (PTPRF), interacting protein (liprin), alpha 2 (PPFIA2), transcript variant 8, non-coding RNA. | The protein encoded by this gene is a member of the LAR protein-tyrosine phosphatase-interacting protein (liprin) family. Liprins interact with members of LAR family of transmembrane protein tyrosine phosphatases, which are known to be important for axon guidance and mammary gland development. It has been proposed that liprins are multivalent proteins that form complex structures and act as scaffolds for the recruitment and anchoring of LAR family of tyrosine phosphatases. This protein is most closely related to PPFIA1, a liprin family member known to interact with the protein phosphatase LAR. The expression of this gene is found to be downregulated by androgens in a prostate cancer cell line. Alternative splicing results in multiple transcript variants encoding different isoforms. [provided by RefSeq, May 2011]. Transcript Variant: This variant (8) is | 1493 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | represented as non-coding due to the presence of an upstream ORF that is predicted to interfere with translation of the longest ORF; translation of the upstream ORF renders the transcript a candidate for nonsense-mediated mRNA decay (NMD). | |
| TRAP1 | Both | NM_016292 | Homo sapiens TNF receptor-associated protein 1 (TRAP1), mRNA. | HSP90 proteins are highly conserved molecular chaperones that have key roles in signal transduction, protein folding, protein degradation, and morphologic evolution. HSP90 proteins normally associate with other cochaperones and play important roles in folding newly synthesized proteins or stabilizing and refolding denatured proteins after stress. TRAP1 is a mitochondrial HSP90 protein. Other HSP90 proteins are found in cytosol (see HSP90AA1; MIM 140571) and endoplasmic reticulum (HSP90B1; MIM 191175) (Chen et al., 2005 [PubMed 16269234]).[supplied by OMIM, Aug 2008]. | 1494 |
| SH3GL3 | Intronic | NM_003027 | Homo sapiens SH3-domain GRB2-like 3 (SH3GL3), transcript variant 1, mRNA. | N/A | 1495 |
| SH3GL3 | Intronic | NR_026799 | Homo sapiens SH3-domain GRB2-like 3 (SH3GL3), transcript variant 2, non-coding RNA. | N/A | 1496 |
| ARMC9 | Both | NM_025139 | Homo sapiens armadillo repeat containing 9 (ARMC9), mRNA. | N/A | 1497 |
| CA10 | Intronic | NM_001082533 | Homo sapiens carbonic anhydrase X (CA10), transcript variant 1, | This gene encodes a protein that belongs to the carbonic anhydrase family of zinc metalloenzymes, which catalyze the reversible hydration of carbon dioxide in various biological processes. The protein encoded by this gene is an acatalytic member of the alpha-carbonic anhydrase subgroup, and it is | 1498 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | thought to play a role in the central nervous system, especially in brain development. Multiple transcript variants encoding the same protein have been found for this gene. [provided by RefSeq, Jul 2008]. Transcript Variant: This variant (1) represents the longest transcript. Variants 1, 2 and 3 encode the same protein. | |
| CA10 | Intronic | NM_001082534 | Homo sapiens carbonic anhydrase X (CA10), transcript variant 3, mRNA. | This gene encodes a protein that belongs to the carbonic anhydrase family of zinc metalloenzymes, which catalyze the reversible hydration of carbon dioxide in various biological processes. The protein encoded by this gene is an acatalytic member of the alpha-carbonic anhydrase subgroup, and it is thought to play a role in the central nervous system, especially in brain development. Multiple transcript variants encoding the same protein have been found for this gene. [provided by RefSeq, Jul 2008]. Transcript Variant: This variant (3) differs in the 5' UTR compared to variant 1. Variants 1, 2 and 3 encode the same protein. | 1499 |
| CA10 | Intronic | NM_020178 | Homo sapiens carbonic anhydrase X (CA10), transcript variant 2, mRNA. | This gene encodes a protein that belongs to the carbonic anhydrase family of zinc metalloenzymes, which catalyze the reversible hydration of carbon dioxide in various biological processes. The protein encoded by this gene is an acatalytic member of the alpha-carbonic anhydrase subgroup, and it is thought to play a role in the central nervous system, especially in brain development. Multiple transcript variants encoding the same protein have been found for this gene. [provided by RefSeq, Jul 2008]. Transcript Variant: This variant (2) differs in the 5' UTR compared to variant 1. Variants 1, 2 and 3 encode the same protein. | 1500 |
| FZD5 | Exonic | NM_003468 | Homo sapiens frizzled family receptor 5 (FZD5), mRNA. | Members of the 'frizzled' gene family encode 7-transmembrane domain proteins that are receptors for Wnt signaling proteins. The FZD5 protein is believed to be the receptor for the Wnt5A ligand. [provided by RefSeq, Jul 2008]. | 1501 |
| MYOC | Both | NM_000261 | Homo sapiens myocilin, trabecular meshwork inducible glucocorticoid | MYOC encodes the protein myocilin, which is believed to have a role in cytoskeletal function. MYOC is expressed in many occular tissues, including the trabecular meshwork, and was revealed to be the trabecular meshwork glucocorticoid-inducible response protein (TIGR). | 1502 |

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | response (MYOC), mRNA. | The trabecular meshwork is a specialized eye tissue essential in regulating intraocular pressure, and mutations in MYOC have been identified as the cause of hereditary juvenile-onset open-angle glaucoma. [provided by RefSeq, Jul 2008]. | |
| HLA-DPA1 | Exonic | NM_001242524 | Homo sapiens major histocompatibility complex, class II, DP alpha 1 (HLA-DPA1), transcript variant 2, mRNA. | HLA-DPA1 belongs to the HLA class II alpha chain paralogues. This class II molecule is a heterodimer consisting of an alpha (DPA) and a beta (DPB) chain, both anchored in the membrane. It plays a central role in the immune system by presenting peptides derived from extracellular proteins. Class II molecules are expressed in antigen presenting cells (APC: B lymphocytes, dendritic cells, macrophages). The alpha chain is approximately 33-35 kDa and its gene contains 5 exons. Exon one encodes the leader peptide, exons 2 and 3 encode the two extracellular domains, exon 4 encodes the transmembrane domain and the cytoplasmic tail. Within the DP molecule both the alpha chain and the beta chain contain the polymorphisms specifying the peptide binding specificities, resulting in up to 4 different molecules. [provided by RefSeq, Jul 2008]. Transcript Variant: This variant (2) differs in the 5' UTR compared to variant 1. Variants 1, 2 and 3 encode the same protein. Publication Note: This RefSeq record includes a subset of the publications that are available for this gene. Please see the Gene record to access additional publications. | 1503 |
| HLA-DPA1 | Exonic | NM_001242525 | Homo sapiens major histocompatibility complex, class II, DP alpha 1 (HLA-DPA1), transcript variant 3, mRNA. | HLA-DPA1 belongs to the HLA class II alpha chain paralogues. This class II molecule is a heterodimer consisting of an alpha (DPA) and a beta (DPB) chain, both anchored in the membrane. It plays a central role in the immune system by presenting peptides derived from extracellular proteins. Class II molecules are expressed in antigen presenting cells (APC: B lymphocytes, dendritic cells, macrophages). The alpha chain is approximately 33-35 kDa and its gene contains 5 exons. Exon one encodes the leader peptide, exons 2 and 3 encode the two extracellular domains, exon 4 encodes the transmembrane domain and the cytoplasmic tail. Within the DP molecule both the alpha chain and the beta chain contain the | 1504 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | polymorphisms specifying the peptide binding specificities, resulting in up to 4 different molecules. [provided by RefSeq, Jul 2008]. Transcript Variant: This variant (3) differs in the 5' UTR compared to variant 1. Variants 1, 2 and 3 encode the same protein. | |
| HLA-DPA1 | Exonic | NM_033554 | Homo sapiens major histocompatibility complex, class II, DP alpha 1 (HLA-DPA1), transcript variant 1, mRNA. | HLA-DPA1 belongs to the HLA class II alpha chain paralogues. This class II molecule is a heterodimer consisting of an alpha (DPA) and a beta (DPB) chain, both anchored in the membrane. It plays a central role in the immune system by presenting peptides derived from extracellular proteins. Class II molecules are expressed in antigen presenting cells (APC: B lymphocytes, dendritic cells, macrophages). The alpha chain is approximately 33-35 kDa and its gene contains 5 exons. Exon one encodes the leader peptide, exons 2 and 3 encode the two extracellular domains, exon 4 encodes the transmembrane domain and the cytoplasmic tail. Within the DP molecule both the alpha chain and the beta chain contain the polymorphisms specifying the peptide binding specificities, resulting in up to 4 different molecules. [provided by RefSeq, Jul 2008]. Transcript Variant: This variant (1) represents the shortest transcript. Variants 1, 2 and 3 encode the same protein. Publication Note: This RefSeq record includes a subset of the publications that are available for this gene. Please see the Gene record to access additional publications. | 1505 |
| ABCC6 | Exonic | NM_001171 | Homo sapiens ATP-binding cassette, sub-family C (CFTR/MRP), member 6 (ABCC6), transcript variant 1, mRNA. | The protein encoded by this gene is a member of the superfamily of ATP-binding cassette (ABC) transporters. ABC proteins transport various molecules across extra- and intra-cellular membranes. ABC genes are divided into seven distinct subfamilies (ABC1, MDR/TAP, MRP, ALD, OABP, GCN20, White). The encoded protein, a member of the MRP subfamily, is involved in multi-drug resistance. Mutations in this gene cause pseudoxanthoma elasticum. Alternatively spliced transcript variants that encode different proteins have been described for this gene. [provided by RefSeq, Jul 2008]. Transcript Variant: This variant (1) represents the longer transcript and | 1506 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | it encodes the longer protein (isoform 1). | |
| ABCC6 | Exonic | NM_001079528 | Homo sapiens ATP-binding cassette, sub-family C (CFTR/MRP), member 6 (ABCC6), transcript variant 2, mRNA. | The protein encoded by this gene is a member of the superfamily of ATP-binding cassette (ABC) transporters. ABC proteins transport various molecules across extra- and intra-cellular membranes. ABC genes are divided into seven distinct subfamilies (ABC1, MDR/TAP, MRP, ALD, OABP, GCN20, White). The encoded protein, a member of the MRP subfamily, is involved in multi-drug resistance. Mutations in this gene cause pseudoxanthoma elasticum. Alternatively spliced transcript variants that encode different proteins have been described for this gene. [provided by RefSeq, Jul 2008]. Transcript Variant: This variant (2) lacks much of the coding region and represents a distinct 3' UTR compared to variant 1. The encoded protein (isoform 2) is much shorter and has a distinct C-terminus compared to isoform 1. The encoded protein is not a transporter, but is thought to play a role in protecting hepatocytes during chronic hepatitis B virus infection. | 1507 |
| ACSM2A | Exonic | NM_001010845 | Homo sapiens acyl-CoA synthetase medium-chain family member 2A (ACSM2A), nuclear gene encoding mitochondrial protein, mRNA. | N/A | 1508 |
| ATP11A | Exonic | NM_015205 | Homo sapiens ATPase, class VI, type 11A (ATP11A), transcript variant 1, mRNA. | The protein encoded by this gene is an integral membrane ATPase. The encoded protein is probably phosphorylated in its intermediate state and likely drives the transport of ions such as calcium across membranes. Two transcript variants encoding different isoforms have been found for this gene. [provided by RefSeq, Jul 2008]. Transcript Variant: This variant (1) represents the longer transcript and encodes isoform a. Sequence Note: This RefSeq record was created from | 1509 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | transcript and genomic sequence data because no single transcript was available for the full length of the gene. The extent of this transcript is supported by transcript alignments. | |
| ATP11A | Exonic | NM_032189 | Homo sapiens ATPase, class VI, type 11A (ATP11A), transcript variant 2, mRNA. | The protein encoded by this gene is an integral membrane ATPase. The encoded protein is probably phosphorylated in its intermediate state and likely drives the transport of ions such as calcium across membranes. Two transcript variants encoding different isoforms have been found for this gene. [provided by RefSeq, Jul 2008]. Transcript Variant: This variant (2) lacks an alternate coding exon and uses an alternate splice site in the 3' portion of the CDS compared to variant 1, that causes a frameshift. The resulting isoform (b) has a longer and distinct C-terminus compared to isoform a. Sequence Note: This RefSeq record was created from transcript and genomic sequence data because no single transcript was available for the full length of the gene. The extent of this transcript is supported by transcript alignments. | 1510 |
| CDKAL1 | Exonic | NM_017774 | Homo sapiens CDK5 regulatory subunit associated protein 1-like 1 (CDKAL1), mRNA. | The protein encoded by this gene is a member of the methylthiotransferase family. The function of this gene is not known. Genome-wide association studies have linked single nucleotide polymorphisms in an intron of this gene with susceptibilty to type 2 diabetes. [provided by RefSeq, May 2010]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1511 |
| CRNKL1 | Both | NM_016652 | Homo sapiens crooked neck pre-mRNA splicing factor-like 1 (Drosophila) (CRNKL1), | The crooked neck (crn) gene of Drosophila is essential for embryogenesis and is thought to be involved in cell cycle progression and pre-mRNA splicing. This gene is similar in sequence to crn and encodes a protein which can localize to pre-mRNA splicing complexes in the nucleus. The encoded protein, which contains many tetratricopeptide | 1512 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | repeats, is required for pre-mRNA splicing. [provided by RefSeq, Jul 2008]. | |
| CTU1 | Exonic | NM_145232 | Homo sapiens cytosolic thiouridylase subunit 1 homolog (S. pombe) (CTU1), mRNA. | N/A | 1513 |
| HLA-DPB1 | Exonic | NM_002121 | Homo sapiens major histocompatibility complex, class II, DP beta 1 (HLA-DPB1), mRNA. | HLA-DPB belongs to the HLA class II beta chain paralogues. This class II molecule is a heterodimer consisting of an alpha (DPA) and a beta chain (DPB), both anchored in the membrane. It plays a central role in the immune system by presenting peptides derived from extracellular proteins. Class II molecules are expressed in antigen presenting cells (APC: B lymphocytes, dendritic cells, macrophages). The beta chain is approximately 26-28 kDa and its gene contains 6 exons. Exon one encodes the leader peptide, exons 2 and 3 encode the two extracellular domains, exon 4 encodes the transmembrane domain and exon 5 encodes the cytoplasmic tail. Within the DP molecule both the alpha chain and the beta chain contain the polymorphisms specifying the peptide binding specificities, resulting in up to 4 different molecules. [provided by RefSeq, Jul 2008]. Sequence Note: This RefSeq record was created from transcript and genomic sequence data to make the sequence consistent with the reference genome assembly. The genomic coordinates used for the transcript record were based on transcript alignments. | 1514 |
| LRRC69 | Intronic | NM_001129890 | Homo sapiens leucine rich repeat containing 69 (LRRC69), mRNA. | N/A | 1515 |
| MACROD2 | Intronic | NM_080676 | Homo sapiens MACRO domain containing 2 | N/A | 1516 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | (MACROD2), transcript variant 1, mRNA. | | |
| MACROD2 | Intronic | NM_001033087 | Homo sapiens MACRO domain containing 2 (MACROD2), transcript variant 2, mRNA. | N/A | 1517 |
| MIR3179-1 | Exonic | NR_036140 | Homo sapiens microRNA 3179-1 (MIR3179-1), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | 1518 |
| MIR3179-2 | Exonic | NR_036143 | Homo sapiens microRNA 3179-2 (MIR3179-2), microRNA. | microRNAs (miRNAs) are short (20-24 nt) non-coding RNAs that are involved in post-transcriptional regulation of gene expression in multicellular organisms by affecting both the stability and translation of mRNAs. miRNAs are | 1519 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | |
| MIR 3179-3 | Exonic | NR_036145 | Homo sapiens microRNA 3179-3 (MIR3179-3), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: | 1520 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | This record represents a predicted microRNA stem-loop as defined by miRBase. Some sequence at the 5' and 3' ends may not be included in the intermediate precursor miRNA produced by Drosha cleavage. | |
| MIR3180-1 | Exonic | NR_036141 | Homo sapiens microRNA 3180-1 (MIR3180-1), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | 1521 |
| MIR3180-2 | Exonic | NR_036142 | Homo sapiens microRNA 3180-2 (MIR3180-2), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the | 1522 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | |
| MIR 3180-3 | Exonic | NR_036 144 | Homo sapiens microRNA 3180-3 (MIR3180-3), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | 1523 |
| MIR 4266 | Exonic | NR_036 224 | Homo sapiens microRNA | microRNAs (miRNAs) are short (20-24 nt) non-coding RNAs that are involved in post- | 1524 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | 4266 (MIR4266), microRNA. | transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | |
| NOMO3 | Exonic | NM_001004067 | Homo sapiens NODAL modulator 3 (NOMO3), mRNA. | This gene encodes a protein originally thought to be related to the collagenase gene family. This gene is one of three highly similar genes in a duplicated region on the short arm of chromosome 16. These three genes encode closely related proteins that may have the same function. The protein encoded by one of these genes has been identified as part of a protein complex that participates in the Nodal signaling pathway during vertebrate development. Mutations in ABCC6, which is located nearby, rather than mutations in this gene are associated with pseudoxanthoma elasticum. [provided by RefSeq, Jul 2008]. | 1525 |
| PCSK2 | Intronic | NM_001201528 | Homo sapiens proprotein convertase subtilisin/kexin type 2 (PCSK2), | This gene encodes a member of the subtilisin-like proprotein convertase family. These enzymes process latent precursor proteins into their biologically active products. The encoded protein plays a critical role in hormone biosynthesis by processing a variety of prohormones including | 1526 |

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | transcript variant 3, mRNA. | proinsulin, proopiomelanocortin and proluteinizing-hormone-releasing hormone. Single nucleotide polymorphisms in this gene may increase susceptibility to myocardial infarction and type 2 diabetes. This gene may also play a role in tumor development and progression. Alternatively spliced transcript variants encoding multiple isoforms have been observed for this gene. [provided by RefSeq, Jan 2011]. Transcript Variant: This variant (3) differs in the 5' UTR and uses an in-frame downstream start codon, compared to variant 1. The encoded isoform (3) has a shorter N-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | |
| PCSK2 | Intronic | NM_001201529 | Homo sapiens proprotein convertase subtilisin/kexin type 2 (PCSK2), transcript variant 2, mRNA. | This gene encodes a member of the subtilisin-like proprotein convertase family. These enzymes process latent precursor proteins into their biologically active products. The encoded protein plays a critical role in hormone biosynthesis by processing a variety of prohormones including proinsulin, proopiomelanocortin and proluteinizing-hormone-releasing hormone. Single nucleotide polymorphisms in this gene may increase susceptibility to myocardial infarction and type 2 diabetes. This gene may also play a role in tumor development and progression. Alternatively spliced transcript variants encoding multiple isoforms have been observed for this gene. [provided by RefSeq, Jan 2011]. Transcript Variant: This variant (2) lacks an exon in the 5' coding region, but maintains the reading frame, compared to variant 1. The encoded isoform (2) is shorter than isoform 1. Sequence Note: This RefSeq record was created from transcript and genomic sequence data to make the sequence consistent with the reference genome assembly. The genomic coordinates used for the | 1527 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | transcript record were based on transcript alignments. Publication Note: This RefSeq record includes a subset of the publications that are available for this gene. Please see the Gene record to access additional publications. | |
| PCSK2 | Intronic | NM_002594 | Homo sapiens proprotein convertase subtilisin/kexin type 2 (PCSK2), transcript variant 1, mRNA. | This gene encodes a member of the subtilisin-like proprotein convertase family. These enzymes process latent precursor proteins into their biologically active products. The encoded protein plays a critical role in hormone biosynthesis by processing a variety of prohormones including proinsulin, proopiomelanocortin and proluteinizing-hormone-releasing hormone. Single nucleotide polymorphisms in this gene may increase susceptibility to myocardial infarction and type 2 diabetes. This gene may also play a role in tumor development and progression. Alternatively spliced transcript variants encoding multiple isoforms have been observed for this gene. [provided by RefSeq, Jan 2011]. Transcript Variant: This variant (1) represents the longest transcript and encodes the longest isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1528 |
| PKD1P1 | Exonic | NR_036447 | Homo sapiens polycystic kidney disease 1 (autosomal dominant) pseudogene 1 (PKD1P1), non-coding RNA. | N/A | 1529 |
| RGPD1 | Intronic | NM_001024457 | Homo sapiens RANBP2-like and GRIP domain | N/A | 1530 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | containing 1 (RGPD1), mRNA. | | |
| SAGE1 | Exonic | NM_018666 | Homo sapiens sarcoma antigen 1 (SAGE1), mRNA. | This gene belongs to a class of genes that are activated in tumors. These genes are expressed in tumors of different histologic types but not in normal tissues, except for spermatogenic cells and, for some, placenta. The proteins encoded by these genes appear to be strictly tumor specific, and hence may be excellent sources of antigens for cancer immunotherapy. This gene is expressed in sarcomas. [provided by RefSeq, Jul 2008]. | 1531 |
| SH3RF3 | Exonic | NM_001099289 | Homo sapiens SH3 domain containing ring finger 3 (SH3RF3), mRNA. | N/A | 1532 |
| SPECC1 | Exonic | NM_001243439 | Homo sapiens sperm antigen with calponin homology and coiled-coil domains 1 (SPECC1), transcript variant 6, mRNA. | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (6) contains an alternate 5' terminal non-coding exon compared to variant 1. Variants 1 and 6 encode the same isoform (1). | 1533 |
| SPECC1 | Exonic | NM_001033553 | Homo sapiens sperm antigen with calponin homology and coiled-coil domains 1 (SPECC1), transcript variant 1, mRNA. | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (1) encodes the longest isoform (1, also known as NSP5beta3beta). Variants 1 and 6 encode the same isoform. | 1534 |

| RefSeq Gene Symbol(s) | Exon overlap | RefSeq Accession Number | mRNA Description | RefSeq Summary | SEQ ID |
|---|---|---|---|---|---|
| SPECC1 | Exonic | NM_152904 | Homo sapiens sperm antigen with calponin homology and coiled-coil domains 1 (SPECC1), transcript variant 3, mRNA. | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (3) contains an alternate 3' terminal exon compared to variant 1. This results in a shorter isoform (3, also known as NSP5beta3alpha) with a distinct C-terminus compared to isoform 1. | 1535 |
| SPECC1 | Exonic | NM_001033554 | Homo sapiens sperm antigen with calponin homology and coiled-coil domains 1 (SPECC1), transcript variant 4, mRNA. | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (4) contains alternate exons at both the 5' and 3' ends compared to variant 1. This results in a shorter isoform (4, also known as NSP5alpha3alpha) with distinct N- and C- termini compared to isoform 1. | 1536 |
| SPECC1 | Exonic | NM_001033555 | Homo sapiens sperm antigen with calponin homology and coiled-coil domains 1 (SPECC1), transcript variant 2, mRNA. | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (2) contains an alternate 5' terminal exon compared to variant 1. This results in a shorter isoform (2, also known as NSP5alpha3beta) with a distinct N-terminus compared to isoform 1. | 1537 |
| SPECC1 | Exonic | NM_001243438 | Homo sapiens sperm antigen | The protein encoded by this gene belongs to the cytospin-A family. It is localized in the nucleus, and | 1538 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | with calponin homology and coiled-coil domains 1 (SPECC1), transcript variant 5, mRNA. | highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, Aug 2011]. Transcript Variant: This variant (5) contains alternate exons at both the 5' and 3' ends, and uses an alternate donor splice site at the penultimate exon compared to variant 1. This results in a shorter isoform (5) with distinct N- and C- termini compared to isoform 1. | |
| TCEA3 | Exonic | NM_003196 | Homo sapiens transcription elongation factor A (SII), 3 (TCEA3), mRNA. | N/A | 1539 |
| XYLT1 | Intronic | NM_022166 | Homo sapiens xylosyltransferase 1 (XYLT1), mRNA. | This locus encodes a xylosyltransferase enzyme. The encoded protein catalyzes transfer of UDP-xylose to serine residues of an acceptor protein substrate. This transfer reaction is necessary for biosynthesis of glycosaminoglycan chains. Mutations in this gene have been associated with increased severity of pseudoxanthoma elasticum.[provided by RefSeq, Nov 2009]. | 1540 |
| ZNF423 | Intronic | NM_015069 | Homo sapiens zinc finger protein 423 (ZNF423), mRNA. | The protein encoded by this gene is a nuclear protein that belongs to the family of Kruppel-like C2H2 zinc finger proteins. It functions as a DNA-binding transcription factor by using distinct zinc fingers in different signaling pathways. Thus, it is thought that this gene may have multiple roles in signal transduction during development. [provided by RefSeq, Jul 2008]. | 1541 |
| ZNF484 | Intronic | NM_001007101 | Homo sapiens zinc finger protein 484 (ZNF484), transcript variant 2, mRNA. | N/A | 1542 |
| ZNF484 | Intronic | NM_031486 | Homo sapiens zinc finger | N/A | 1543 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | protein 484 (ZNF484), transcript variant 1, mRNA. | | |
| BAZ2B | Intronic | NM_013450 | Homo sapiens bromodomain adjacent to zinc finger domain, 2B (BAZ2B), mRNA. | N/A | 1544 |
| FSCB | Exonic | NM_032135 | Homo sapiens fibrous sheath CABYR binding protein (FSCB), mRNA. | N/A | 1545 |
| TMLHE | Intronic | NM_018196 | Homo sapiens trimethyllysine hydroxylase, epsilon (TMLHE), nuclear gene encoding mitochondrial protein, transcript variant 1, mRNA. | This gene encodes the protein trimethyllysine dioxygenase which is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants.[provided by RefSeq, May 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. | 1546 |
| TMLHE | Intronic | NM_001184797 | Homo sapiens trimethyllysine hydroxylase, epsilon (TMLHE), nuclear gene encoding mitochondrial protein, transcript | This gene encodes the protein trimethyllysine dioxygenase which is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants.[provided by RefSeq, May 2010]. Transcript Variant: This | 1547 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | variant 2, mRNA. | variant (2) differs in the 3' UTR and coding region differences, compared to variant 1. The resulting protein (isoform 2) has a distinct C-terminus and is shorter than isoform 1. | |
| ADAM6 | Exonic | NR_002224 | Homo sapiens ADAM metallopeptidase domain 6 (pseudogene) (ADAM6), non-coding RNA. | N/A | 1548 |
| C11orf54 | Exonic | NM_014039 | Homo sapiens chromosome 11 open reading frame 54 (C11orf54), mRNA. | N/A | 1549 |
| CARD8 | Exonic | NM_001184901 | Homo sapiens caspase recruitment domain family, member 8 (CARD8), transcript variant 3, mRNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (3) differs in the 5' UTR and lacks an alternate in-frame exon in the 5' coding region, compared to variant 1. This results in a shorter protein (isoform b), compared to isoform a. Variants 2 and 3 encode the same isoform (b). Sequence Note: This RefSeq record was created from transcript and genomic sequence data to make the sequence consistent with the reference genome assembly. The genomic coordinates used for the transcript record were based on transcript alignments. Publication Note: This RefSeq record | 1550 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | includes a subset of the publications that are available for this gene. Please see the Gene record to access additional publications. | |
| CARD8 | Exonic | NM_001184902 | Homo sapiens caspase recruitment domain family, member 8 (CARD8), transcript variant 4, mRNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (4) differs in the 5' UTR and lacks an alternate exon in the 3' coding region, which results in a frameshift compared to variant 1. This results in a shorter protein (isoform c), compared to isoform a. Variants 4 and 5 encode the same isoform (c). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1551 |
| CARD8 | Exonic | NM_001184903 | Homo sapiens caspase recruitment domain family, member 8 (CARD8), transcript variant 5, mRNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be | 1552 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | associated with a susceptibility to rheumatoid arthritis. Alternatively spliced transcript variants have been described for this gene. [provided by RefSeq, May 2010]. Transcript Variant: This variant (5) differs in the 5' UTR and lacks an alternate exon in the 3' coding region, which results in a frameshift compared to variant 1. This results in a shorter protein (isoform c), compared to isoform a. Variants 4 and 5 encode the same isoform (c). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | |
| CARD8 | Exonic | NM_014959 | Homo sapiens caspase recruitment domain family, member 8 (CARD8), transcript variant 2, mRNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (2) differs in the 5' UTR and lacks an alternate in-frame exon in the 5' coding region, compared to variant 1. This results in a shorter protein (isoform b), compared to isoform a. Variants 2 and 3 encode the same isoform (b). Sequence Note: This RefSeq record was created from transcript and genomic sequence data to make the sequence consistent with the reference genome assembly. The genomic coordinates used for the transcript record were based on transcript | 1553 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | alignments. | |
| CARD8 | Exonic | NR_033 678 | Homo sapiens caspase recruitment domain family, member 8 (CARD8), transcript variant 7, non-coding RNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (7) has multiple differences compared to variant 1. This variant is represented as non-coding because the use of the 5'-most supported translational start codon, as used in variant 1, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1554 |
| CARD8 | Exonic | NR_033 680 | Homo sapiens caspase recruitment domain family, member 8 (CARD8), transcript variant 9, non-coding RNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants | 1555 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | have been described for this gene. [provided by RefSeq, May 2010]. Transcript Variant: This variant (9) has multiple differences compared to variant 1. This variant is represented as non-coding because the use of the 5'-most supported translational start codon, as used in variant 1, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | |
| CARD8 | Exonic | NM_001184904 | Homo sapiens caspase recruitment domain family, member 8 (CARD8), transcript variant 6, mRNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (6) differs in the 5' UTR, 3' coding region, and 3' UTR compared to variant 1. The resulting isoform (d) is shorter than isoform a. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1556 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| CARD8 | Exonic | NM_001184900 | Homo sapiens caspase recruitment domain family, member 8 (CARD8), transcript variant 1, mRNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (1) encodes the longest isoform (a, also referred to as T60). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1557 |
| CARD8 | Exonic | NR_033679 | Homo sapiens caspase recruitment domain family, member 8 (CARD8), transcript variant 8, non-coding RNA. | The protein encoded by this gene belongs to the caspase recruitment domain (CARD)-containing family of proteins, which are involved in pathways leading to activation of caspases or nuclear factor kappa-B (NFKB). This protein may be a component of the inflammasome, a protein complex that plays a role in the activation of proinflammatory caspases. It is thought that this protein acts as an adaptor molecule that negatively regulates NFKB activation, CASP1-dependent IL1B secretion, and apoptosis. Polymorphisms in this gene may be associated with a susceptibility to rheumatoid arthritis. Alternatively spliced transcript variants have been described for this gene. [provided by RefSeq, May 2010]. Transcript Variant: This variant (8) lacks an alternate exon compared to variant 1. This variant is represented as non-coding because the use of the 5'-most supported | 1558 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | translational start codon, as used in variant 1, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | |
| HBG1 | Exonic | NM_000559 | Homo sapiens hemoglobin, gamma A (HBG1), mRNA. | The gamma globin genes (HBG1 and HBG2) are normally expressed in the fetal liver, spleen and bone marrow. Two gamma chains together with two alpha chains constitute fetal hemoglobin (HbF) which is normally replaced by adult hemoglobin (HbA) at birth. In some beta-thalassemias and related conditions, gamma chain production continues into adulthood. The two types of gamma chains differ at residue 136 where glycine is found in the G-gamma product (HBG2) and alanine is found in the A-gamma product (HBG1). The former is predominant at birth. The order of the genes in the beta-globin cluster is: 5'-epsilon -- gamma-G -- gamma-A -- delta -- beta--3'. [provided by RefSeq, Jul 2008]. | 1559 |
| LSM14A | Intronic | NM_001114093 | Homo sapiens LSM14A, SCD6 homolog A (S. cerevisiae) (LSM14A), transcript variant 1, mRNA. | Sm-like proteins were identified in a variety of organisms based on sequence homology with the Sm protein family (see SNRPD2; 601061). Sm-like proteins contain the Sm sequence motif, which consists of 2 regions separated by a linker of variable length that folds as a loop. The Sm-like proteins are thought to form a stable heteromer present in tri-snRNP particles, which are important for pre-mRNA splicing.[supplied by OMIM, Mar 2008]. Transcript Variant: This variant (1) represents the longer transcript and encodes isoform a. While isoforms a and b are of the same length, their C-termini are different. Sequence Note: This RefSeq record was created from transcript and genomic sequence data because no single transcript was available for the full length of the gene. The extent of this transcript is supported by transcript | 1560 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | alignments. | |
| LSM14A | Intronic | NM_015578 | Homo sapiens LSM14A, SCD6 homolog A (S. cerevisiae) (LSM14A), transcript variant 2, mRNA. | Sm-like proteins were identified in a variety of organisms based on sequence homology with the Sm protein family (see SNRPD2; 601061). Sm-like proteins contain the Sm sequence motif, which consists of 2 regions separated by a linker of variable length that folds as a loop. The Sm-like proteins are thought to form a stable heteromer present in tri-snRNP particles, which are important for pre-mRNA splicing.[supplied by OMIM, Mar 2008]. Transcript Variant: This variant (2) lacks an alternate exon compared to variant 1 and encodes isoform b. While isoforms a and b are of the same length, their C-termini are different. Sequence Note: This RefSeq record was created from transcript and genomic sequence data because no single transcript was available for the full length of the gene. The extent of this transcript is supported by transcript alignments. | 1561 |
| MBD3L2 | Exonic | NM_144614 | Homo sapiens methyl-CpG binding domain protein 3-like 2 (MBD3L2), mRNA. | This gene encodes a protein that is related to methyl-CpG-binding proteins but lacks the methyl-CpG binding domain. The protein has been found in germ cell tumors and some somatic tissues. [provided by RefSeq, Jul 2008]. | 1562 |
| MBD3L3 | Exonic | NM_001164425 | Homo sapiens methyl-CpG binding domain protein 3-like 3 (MBD3L3), mRNA. | N/A | 1563 |
| MBD3L4 | Exonic | NM_001164419 | Homo sapiens methyl-CpG binding domain protein 3-like 4 (MBD3L4), mRNA. | This gene encodes a member of a family of proteins that are related to methyl-CpG-binding proteins but lack the methyl-CpG binding domain. There is no definitive support for transcription of this locus, and the transcript structure is inferred from other family members. [provided by RefSeq, Aug 2009]. Sequence Note: The RefSeq transcript and protein were derived from genomic sequence to make the sequence consistent with the reference genome assembly. The genomic coordinates used for the transcript record were based on alignments. | 1564 |
| MBD3L5 | Exonic | NM_001136507 | Homo sapiens methyl-CpG | N/A | 1565 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | binding domain protein 3-like 5 (MBD3L5), mRNA. | | |
| ZFP14 | Intronic | NM_020917 | Homo sapiens zinc finger protein 14 homolog (mouse) (ZFP14), mRNA. | N/A | 1566 |
| ZNF804B | Intronic | NM_181646 | Homo sapiens zinc finger protein 804B (ZNF804B), mRNA. | N/A | 1567 |
| AGBL1 | Exonic | NM_152336 | Homo sapiens ATP/GTP binding protein-like 1 (AGBL1), mRNA. | N/A | 1568 |
| ARHGAP15 | Intronic | NM_018460 | Homo sapiens Rho GTPase activating protein 15 (ARHGAP15), mRNA. | RHO GTPases (see ARHA; MIM 165390) regulate diverse biologic processes, and their activity is regulated by RHO GTPase-activating proteins (GAPs), such as ARHGAP15 (Seoh et al., 2003 [PubMed 12650940]).[supplied by OMIM, Mar 2008]. | 1569 |
| BHMT2 | Exonic | NM_001178005 | Homo sapiens betaine--homocysteine S-methyltransferase 2 (BHMT2), transcript variant 2, mRNA. | Homocysteine is a sulfur-containing amino acid that plays a crucial role in methylation reactions. Transfer of the methyl group from betaine to homocysteine creates methionine, which donates the methyl group to methylate DNA, proteins, lipids, and other intracellular metabolites. The protein encoded by this gene is one of two methyl transferases that can catalyze the transfer of the methyl group from betaine to homocysteine. Anomalies in homocysteine metabolism have been implicated in disorders ranging from vascular disease to neural tube birth defects such as spina bifida. Alternatively spliced transcript variants encoding different isoforms have been found for this gene. [provided by RefSeq, May 2010]. Transcript Variant: This variant (2) lacks an in- | 1570 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | frame exon in the CDS, as compared to variant 1. The resulting isoform (2) lacks an internal segment, as compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | |
| BHMT2 | Exonic | NM_017614 | Homo sapiens betaine--homocysteine S-methyltransferase 2 (BHMT2), transcript variant 1, mRNA. | Homocysteine is a sulfur-containing amino acid that plays a crucial role in methylation reactions. Transfer of the methyl group from betaine to homocysteine creates methionine, which donates the methyl group to methylate DNA, proteins, lipids, and other intracellular metabolites. The protein encoded by this gene is one of two methyl transferases that can catalyze the transfer of the methyl group from betaine to homocysteine. Anomalies in homocysteine metabolism have been implicated in disorders ranging from vascular disease to neural tube birth defects such as spina bifida. Alternatively spliced transcript variants encoding different isoforms have been found for this gene. [provided by RefSeq, May 2010]. Transcript Variant: This variant (1) encodes the longer isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. | 1571 |
| C6orf99 | Exonic | NM_001195032 | Homo sapiens chromosome 6 open reading frame 99 (C6orf99), mRNA. | N/A | 1572 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| C7orf60 | Exonic | NM_152556 | Homo sapiens chromosome 7 open reading frame 60 (C7orf60), mRNA. | N/A | 1573 |
| CCDC66 | Intronic | NM_001012506 | Homo sapiens coiled-coil domain containing 66 (CCDC66), transcript variant 2, mRNA. | N/A | 1574 |
| CCDC66 | Intronic | NM_001141947 | Homo sapiens coiled-coil domain containing 66 (CCDC66), transcript variant 1, mRNA. | N/A | 1575 |
| CCDC66 | Intronic | NR_024460 | Homo sapiens coiled-coil domain containing 66 (CCDC66), transcript variant 3, non-coding RNA. | N/A | 1576 |
| CDH19 | Exonic | NM_021153 | Homo sapiens cadherin 19, type 2 (CDH19), mRNA. | This gene is a type II classical cadherin from the cadherin superfamily and one of three cadherin 7-like genes located in a cluster on chromosome 18. The encoded membrane protein is a calcium dependent cell-cell adhesion glycoprotein comprised of five extracellular cadherin repeats, a transmembrane region and a highly conserved cytoplasmic tail. Type II (atypical) cadherins are defined based on their lack of a HAV cell adhesion recognition sequence specific to type I cadherins. Since disturbance of intracellular adhesion is a prerequisite for invasion and metastasis of tumor cells, cadherins are considered prime candidates for tumor suppressor genes. [provided by RefSeq, Jul | 1577 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | 2008]. | |
| COL4A2 | Exonic | NM_001846 | Homo sapiens collagen, type IV, alpha 2 (COL4A2), mRNA. | This gene encodes one of the six subunits of type IV collagen, the major structural component of basement membranes. The C-terminal portion of the protein, known as canstatin, is an inhibitor of angiogenesis and tumor growth. Like the other members of the type IV collagen gene family, this gene is organized in a head-to-head conformation with another type IV collagen gene so that each gene pair shares a common promoter. [provided by RefSeq, Jul 2008]. | 1578 |
| MAN2A1 | Intronic | NM_002372 | Homo sapiens mannosidase, alpha, class 2A, member 1 (MAN2A1), mRNA. | This gene encodes a protein which is a member of family 38 of the glycosyl hydrolases. The protein is located in the Golgi and catalyzes the final hydrolytic step in the asparagine-linked oligosaccharide (N-glycan) maturation pathway. Mutations in the mouse homolog of this gene have been shown to cause a systemic autoimmune disease similar to human systemic lupus erythematosus. [provided by RefSeq, Jul 2008]. | 1579 |
| MIR548C | Intronic | NR_030347 | Homo sapiens microRNA 548c (MIR548C), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the | 1580 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | 5' and 3' ends may not be included in the intermediate precursor miRNA produced by Drosha cleavage. | |
| MIR 548Z | Intronic | NR_037515 | Homo sapiens microRNA 548z (MIR548Z), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. | 1581 |
| OR2T29 | Exonic | NM_001004694 | Homo sapiens olfactory receptor, family 2, subfamily T, member 29 (OR2T29), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by | 1582 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | RefSeq, Jul 2008]. Sequence Note: The RefSeq transcript and protein were derived from genomic sequence to make the sequence consistent with the reference genome assembly. The genomic coordinates used for the transcript record were based on homologous alignments. | |
| PHF17 | Exonic | NM_024900 | Homo sapiens PHD finger protein 17 (PHF17), transcript variant S, mRNA. | N/A | 1583 |
| PHF17 | Exonic | NM_199320 | Homo sapiens PHD finger protein 17 (PHF17), transcript variant L, mRNA. | N/A | 1584 |
| PRSS35 | Intronic | NM_001170423 | Homo sapiens protease, serine, 35 (PRSS35), transcript variant 1, mRNA. | N/A | 1585 |
| PRSS35 | Intronic | NM_153362 | Homo sapiens protease, serine, 35 (PRSS35), transcript variant 2, mRNA. | N/A | 1586 |
| SNRPN | Exonic | NM_022806 | Homo sapiens small nuclear ribonucleoprotein polypeptide N (SNRPN), transcript variant 3, mRNA. | The protein encoded by this gene is one polypeptide of a small nuclear ribonucleoprotein complex and belongs to the snRNP SMB/SMN family. The protein plays a role in pre-mRNA processing, possibly tissue-specific alternative splicing events. Although individual snRNPs are believed to recognize specific nucleic acid sequences through RNA-RNA base pairing, the specific role of this family member is unknown. The protein arises from a bicistronic transcript that | 1587 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | also encodes a protein identified as the SNRPN upstream reading frame (SNURF). Multiple transcription initiation sites have been identified and extensive alternative splicing occurs in the 5' untranslated region. Additional splice variants have been described but sequences for the complete transcripts have not been determined. The 5' UTR of this gene has been identified as an imprinting center. Alternative splicing or deletion caused by a translocation event in this paternally-expressed region is responsible for Angelman syndrome or Prader-Willi syndrome due to parental imprint switch failure. [provided by RefSeq, Jul 2008]. Transcript Variant: This variant (3) lacks exon 1 but utilizes upstream, non-coding exons u1B, u2 and u4. Alternative splicing takes place only in the 5' UTR, resulting in variants that all share exons 2-10, encoding identical proteins. | |
| SNRPN | Exonic | NM_022807 | Homo sapiens small nuclear ribonucleoprotein polypeptide N (SNRPN), transcript variant 4, mRNA. | The protein encoded by this gene is one polypeptide of a small nuclear ribonucleoprotein complex and belongs to the snRNP SMB/SMN family. The protein plays a role in pre-mRNA processing, possibly tissue-specific alternative splicing events. Although individual snRNPs are believed to recognize specific nucleic acid sequences through RNA-RNA base pairing, the specific role of this family member is unknown. The protein arises from a bicistronic transcript that also encodes a protein identified as the SNRPN upstream reading frame (SNURF). Multiple transcription initiation sites have been identified and extensive alternative splicing occurs in the 5' untranslated region. Additional splice variants have been described but sequences for the complete transcripts have not been determined. The 5' UTR of this gene has been identified as an imprinting center. Alternative splicing or deletion caused by a translocation event in this paternally-expressed region is responsible for Angelman syndrome or Prader-Willi syndrome due to parental imprint switch failure. [provided by RefSeq, Jul 2008]. Transcript Variant: This variant (4) lacks exon 1 but utilizes upstream, non-coding exons u1B' (downstream alternative splice donor site for u1B), | 1588 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | u1B*, u2 and u4. Alternative splicing takes place only in the 5' UTR, resulting in variants that all share exons 2-10, encoding identical proteins. | |
| SNRPN | Exonic | NM_022808 | Homo sapiens small nuclear ribonucleoprotein polypeptide N (SNRPN), transcript variant 5, mRNA. | The protein encoded by this gene is one polypeptide of a small nuclear ribonucleoprotein complex and belongs to the snRNP SMB/SMN family. The protein plays a role in pre-mRNA processing, possibly tissue-specific alternative splicing events. Although individual snRNPs are believed to recognize specific nucleic acid sequences through RNA-RNA base pairing, the specific role of this family member is unknown. The protein arises from a bicistronic transcript that also encodes a protein identified as the SNRPN upstream reading frame (SNURF). Multiple transcription initiation sites have been identified and extensive alternative splicing occurs in the 5' untranslated region. Additional splice variants have been described but sequences for the complete transcripts have not been determined. The 5' UTR of this gene has been identified as an imprinting center. Alternative splicing or deletion caused by a translocation event in this paternally-expressed region is responsible for Angelman syndrome or Prader-Willi syndrome due to parental imprint switch failure. [provided by RefSeq, Jul 2008]. Transcript Variant: This variant (5) lacks exon 1 but utilizes upstream, non-coding exons u1B' (downstream alternative splice donor site for u1B), u2 and u4. Alternative splicing takes place only in the 5' UTR, resulting in variants that all share exons 2-10, encoding identical proteins. | 1589 |
| SNRPN | Exonic | NM_022805 | Homo sapiens small nuclear ribonucleoprotein polypeptide N (SNRPN), transcript variant 2, mRNA. | The protein encoded by this gene is one polypeptide of a small nuclear ribonucleoprotein complex and belongs to the snRNP SMB/SMN family. The protein plays a role in pre-mRNA processing, possibly tissue-specific alternative splicing events. Although individual snRNPs are believed to recognize specific nucleic acid sequences through RNA-RNA base pairing, the specific role of this family member is unknown. The protein arises from a bicistronic transcript that also encodes a protein identified as the SNRPN upstream reading frame (SNURF). Multiple | 1590 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | transcription initiation sites have been identified and extensive alternative splicing occurs in the 5' untranslated region. Additional splice variants have been described but sequences for the complete transcripts have not been determined. The 5' UTR of this gene has been identified as an imprinting center. Alternative splicing or deletion caused by a translocation event in this paternally-expressed region is responsible for Angelman syndrome or Prader-Willi syndrome due to parental imprint switch failure. [provided by RefSeq, Jul 2008]. Transcript Variant: This variant (2) lacks exon 1 but utilizes upstream, non-coding exons u1A, u2 and u4. Alternative splicing takes place only in the 5' UTR, resulting in variants that all share exons 2-10, encoding identical proteins. | |
| SNRPN | Exonic | NM_003097 | Homo sapiens small nuclear ribonucleoprote in polypeptide N (SNRPN), transcript variant 1, mRNA. | The protein encoded by this gene is one polypeptide of a small nuclear ribonucleoprotein complex and belongs to the snRNP SMB/SMN family. The protein plays a role in pre-mRNA processing, possibly tissue-specific alternative splicing events. Although individual snRNPs are believed to recognize specific nucleic acid sequences through RNA-RNA base pairing, the specific role of this family member is unknown. The protein arises from a bicistronic transcript that also encodes a protein identified as the SNRPN upstream reading frame (SNURF). Multiple transcription initiation sites have been identified and extensive alternative splicing occurs in the 5' untranslated region. Additional splice variants have been described but sequences for the complete transcripts have not been determined. The 5' UTR of this gene has been identified as an imprinting center. Alternative splicing or deletion caused by a translocation event in this paternally-expressed region is responsible for Angelman syndrome or Prader-Willi syndrome due to parental imprint switch failure. [provided by RefSeq, Jul 2008]. Transcript Variant: This variant (1) utilizes alternative exon 1 and represents the predominant variant. Since this variant alone contains exon 1, it is the only one which also contains the complete open reading frame for SNURF. Alternative | 1591 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | splicing takes place only in the 5' UTR, resulting in variants that all share exons 2-10, encoding identical proteins. | |
| ZMAT5 | Exonic | NM_001003692 | Homo sapiens zinc finger, matrin-type 5 (ZMAT5), transcript variant 2, mRNA. | N/A | 1592 |
| ZMAT5 | Exonic | NM_019103 | Homo sapiens zinc finger, matrin-type 5 (ZMAT5), transcript variant 1, mRNA. | N/A | 1593 |
| ARHGEF38 | Exonic | NM_001242729 | Homo sapiens Rho guanine nucleotide exchange factor (GEF) 38 (ARHGEF38), transcript variant 1, mRNA. | N/A | 1594 |
| ARHGEF38 | Exonic | NM_017700 | Homo sapiens Rho guanine nucleotide exchange factor (GEF) 38 (ARHGEF38), transcript variant 2, mRNA. | N/A | 1595 |
| ARL15 | Both | NM_019087 | Homo sapiens ADP-ribosylation factor-like 15 (ARL15), mRNA. | N/A | 1596 |
| COMMD10 | Both | NM_016144 | Homo sapiens COMM domain | N/A | 1597 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | containing 10 (COMMD10), mRNA. | | |
| IQCA1 | Both | NM_024726 | Homo sapiens IQ motif containing with AAA domain 1 (IQCA1), mRNA. | N/A | 1598 |
| PHC2 | Both | NM_004427 | Homo sapiens polyhomeotic homolog 2 (Drosophila) (PHC2), transcript variant 2, mRNA. | In Drosophila melanogaster, the 'Polycomb' group (PcG) of genes are part of a cellular memory system that is responsible for the stable inheritance of gene activity. PcG proteins form a large multimeric, chromatin-associated protein complex. The protein encoded by this gene has homology to the Drosophila PcG protein 'polyhomeotic' (Ph) and is known to heterodimerize with EDR1 and colocalize with BMI1 in interphase nuclei of human cells. The specific function in human cells has not yet been determined. Two transcript variants encoding different isoforms have been found for this gene. [provided by RefSeq, Jul 2008]. Transcript Variant: This variant (2) differs in the 5' UTR and coding region compared to variant 1. The resulting isoform (b) has a shorter N-terminus compared to isoform a. | 1599 |
| PHC2 | Both | NM_198040 | Homo sapiens polyhomeotic homolog 2 (Drosophila) (PHC2), transcript variant 1, mRNA. | In Drosophila melanogaster, the 'Polycomb' group (PcG) of genes are part of a cellular memory system that is responsible for the stable inheritance of gene activity. PcG proteins form a large multimeric, chromatin-associated protein complex. The protein encoded by this gene has homology to the Drosophila PcG protein 'polyhomeotic' (Ph) and is known to heterodimerize with EDR1 and colocalize with BMI1 in interphase nuclei of human cells. The specific function in human cells has not yet been determined. Two transcript variants encoding different isoforms have been found for this gene. [provided by RefSeq, Jul 2008]. Transcript Variant: This variant (1) represents the longer transcript and encodes the longer isoform (a). | 1600 |
| RGL1 | Both | NM_015149 | Homo sapiens ral guanine nucleotide dissociation | N/A | 1601 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | stimulator-like 1 (RGL1), mRNA. | | |
| SLC43A2 | Both | NM_152346 | Homo sapiens solute carrier family 43, member 2 (SLC43A2), mRNA. | System L amino acid transporters, such as SLC43A2, mediate sodium-independent transport of bulky neutral amino acids across cell membranes (Bodoy et al., 2005 [PubMed 15659399]).[supplied by OMIM, Mar 2008]. | 1602 |
| MANEA | Intronic | NM_024641 | Homo sapiens mannosidase, endo-alpha (MANEA), mRNA. | N-glycosylation of proteins is initiated in the endoplasmic reticulum (ER) by the transfer of the preassembled oligosaccharide glucose-3-mannose-9-N-acetylglucosamine-2 from dolichyl pyrophosphate to acceptor sites on the target protein by an oligosaccharyltransferase complex. This core oligosaccharide is sequentially processed by several ER glycosidases and by an endomannosidase (E.C. 3.2.1.130), such as MANEA, in the Golgi. MANEA catalyzes the release of mono-, di-, and triglucosylmannose oligosaccharides by cleaving the alpha-1,2-mannosidic bond that links them to high-mannose glycans (Hamilton et al., 2005 [PubMed 15677381]).[supplied by OMIM, Sep 2008]. | 1603 |
| AUTS2 | Both | NM_001127231 | Homo sapiens autism susceptibility candidate 2 (AUTS2), transcript variant 2, mRNA. | N/A | 1604 |
| AUTS2 | Both | NM_015570 | Homo sapiens autism susceptibility candidate 2 (AUTS2), transcript variant 1, mRNA. | N/A | 1605 |
| AUTS2 | Both | NM_001127232 | Homo sapiens autism susceptibility candidate 2 | N/A | 1606 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | (AUTS2), transcript variant 3, mRNA. | | |
| EGFEM1P | Both | NR_021485 | Homo sapiens EGF-like and EMI domain containing 1, pseudogene (EGFEM1P), non-coding RNA. | N/A | 1607 |
| KCNQ5 | Intronic | NM_001160130 | Homo sapiens potassium voltage-gated channel, KQT-like subfamily, member 5 (KCNQ5), transcript variant 2, mRNA. | This gene is a member of the KCNQ potassium channel gene family that is differentially expressed in subregions of the brain and in skeletal muscle. The protein encoded by this gene yields currents that activate slowly with depolarization and can form heteromeric channels with the protein encoded by the KCNQ3 gene. Currents expressed from this protein have voltage dependences and inhibitor sensitivities in common with M-currents. They are also inhibited by M1 muscarinic receptor activation. Multiple transcript variants encoding different isoforms have been found for this gene. [provided by RefSeq, May 2009]. Transcript Variant: This variant (2) lacks two alternate in-frame exons in the central coding region, compared to variant 4. The resulting isoform (2), also known as II, lacks an internal segment compared to isoform 4. Sequence Note: This RefSeq record was created from transcript and genomic sequence data to make the sequence consistent with the reference genome assembly. The genomic coordinates used for the transcript record were based on transcript alignments. | 1608 |
| KCNQ5 | Intronic | NM_001160132 | Homo sapiens potassium voltage-gated channel, KQT-like subfamily, member 5 (KCNQ5), transcript variant 3, | This gene is a member of the KCNQ potassium channel gene family that is differentially expressed in subregions of the brain and in skeletal muscle. The protein encoded by this gene yields currents that activate slowly with depolarization and can form heteromeric channels with the protein encoded by the KCNQ3 gene. Currents expressed from this protein have voltage dependences and inhibitor sensitivities in common with M-currents. They are | 1609 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | mRNA. | also inhibited by M1 muscarinic receptor activation. Multiple transcript variants encoding different isoforms have been found for this gene. [provided by RefSeq, May 2009]. Transcript Variant: This variant (3) lacks an alternate in-frame exon in the central coding region, compared to variant 4. The resulting isoform (3), also known as III, lacks an internal segment compared to isoform 4. Sequence Note: The RefSeq transcript and protein were derived from genomic sequence to make the sequence consistent with the reference genome assembly. The genomic coordinates used for the transcript record were based on alignments. | |
| KCNQ5 | Intronic | NM_001160133 | Homo sapiens potassium voltage-gated channel, KQT-like subfamily, member 5 (KCNQ5), transcript variant 4, mRNA. | This gene is a member of the KCNQ potassium channel gene family that is differentially expressed in subregions of the brain and in skeletal muscle. The protein encoded by this gene yields currents that activate slowly with depolarization and can form heteromeric channels with the protein encoded by the KCNQ3 gene. Currents expressed from this protein have voltage dependences and inhibitor sensitivities in common with M-currents. They are also inhibited by M1 muscarinic receptor activation. Multiple transcript variants encoding different isoforms have been found for this gene. [provided by RefSeq, May 2009]. Transcript Variant: This variant (4) represents the longest transcript and encodes the longest isoform (4). Sequence Note: The RefSeq transcript and protein were derived from genomic sequence to make the sequence consistent with the reference genome assembly. The genomic coordinates used for the transcript record were based on alignments. | 1610 |
| KCNQ5 | Intronic | NM_001160134 | Homo sapiens potassium voltage-gated channel, KQT-like subfamily, member 5 (KCNQ5), transcript variant 5, mRNA. | This gene is a member of the KCNQ potassium channel gene family that is differentially expressed in subregions of the brain and in skeletal muscle. The protein encoded by this gene yields currents that activate slowly with depolarization and can form heteromeric channels with the protein encoded by the KCNQ3 gene. Currents expressed from this protein have voltage dependences and inhibitor sensitivities in common with M-currents. They are also inhibited by M1 muscarinic receptor activation. Multiple transcript variants encoding different | 1611 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | | isoforms have been found for this gene. [provided by RefSeq, May 2009]. Transcript Variant: This variant (5) lacks three alternate in-frame exons in the central coding region, compared to variant 4. The resulting isoform (5) lacks an internal segment, compared to isoform 4. Sequence Note: This RefSeq record was created from transcript and genomic sequence data to make the sequence consistent with the reference genome assembly. The genomic coordinates used for the transcript record were based on transcript alignments. | |
| KCNQ5 | Intronic | NM_019842 | Homo sapiens potassium voltage-gated channel, KQT-like subfamily, member 5 (KCNQ5), transcript variant 1, mRNA. | This gene is a member of the KCNQ potassium channel gene family that is differentially expressed in subregions of the brain and in skeletal muscle. The protein encoded by this gene yields currents that activate slowly with depolarization and can form heteromeric channels with the protein encoded by the KCNQ3 gene. Currents expressed from this protein have voltage dependences and inhibitor sensitivities in common with M-currents. They are also inhibited by M1 muscarinic receptor activation. Multiple transcript variants encoding different isoforms have been found for this gene. [provided by RefSeq, May 2009]. Transcript Variant: This variant (1) lacks an alternate in-frame exon in the central coding region, compared to variant 4. The resulting isoform (1) lacks an internal segment, compared to isoform 4. Sequence Note: This RefSeq record was created from transcript and genomic sequence data to make the sequence consistent with the reference genome assembly. The genomic coordinates used for the transcript record were based on transcript alignments. | 1612 |
| PGCP | Intronic | NM_016134 | Homo sapiens plasma glutamate carboxypeptidase (PGCP), mRNA. | N/A | 1613 |
| LOC100132832 | Exonic | NR_028058 | Homo sapiens PMS2 postmeiotic segregation increased 2 (S. | N/A | 1614 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| | | | cerevisiae) pseudogene (LOC100132832), non-coding RNA. | | |
| LOC100294145 | Exonic | NR_037177 | Homo sapiens uncharacterized LOC100294145 (LOC100294145), transcript variant 1, non-coding RNA. | N/A | 1615 |
| LOC100294145 | Exonic | NR_037178 | Homo sapiens uncharacterized LOC100294145 (LOC100294145), transcript variant 2, non-coding RNA. | N/A | 1616 |
| LOC283194 | Exonic | NR_033853 | Homo sapiens uncharacterized LOC283194 (LOC283194), non-coding RNA. | N/A | 1617 |
| LOC285074 | Exonic | NR_026846 | Homo sapiens anaphase promoting complex subunit 1 pseudogene (LOC285074), non-coding RNA. | N/A | 1618 |
| LOC442459 | Both | NR_024608 | Homo sapiens X-ray repair complementing defective repair pseudogene (LOC442459), non-coding RNA. | N/A | 1619 |

Figure 11B (Continued)

| Figure 11B | | | | | |
|---|---|---|---|---|---|
| RefSeq Gene Symbol(s) | Exon overlap | RefSeq Accession Number | mRNA Description | RefSeq Summary | SEQ ID |
| LOC729852 | Both | NR_034084 | Homo sapiens uncharacterized LOC729852 (LOC729852), non-coding RNA. | N/A | 1620 |

Figure 11B (Continued)

| Figure 11C | | | | |
|---|---|---|---|---|
| RefSeq Gene Symbol | CNV Gene Region | RefSeq Accession Number | RefSeq Gene Description/Definition | SEQ ID |
| ATRNL1 | intronic | NM_207303 | Homo sapiens attractin-like 1 (ATRNL1), mRNA. | 2003 |
| CNTNAP2 | intronic | NM_014141 | Homo sapiens contactin associated protein-like 2 (CNTNAP2), mRNA. | 2004 |
| MIR548T | intronic | NR_036093 | Homo sapiens microRNA 548t (MIR548T), microRNA. | 2005 |
| ZC3H6 | intronic | NM_198581 | Homo sapiens zinc finger CCCH-type containing 6 (ZC3H6), mRNA. | 2006 |
| DCC | intronic | NM_005215 | Homo sapiens deleted in colorectal carcinoma (DCC), mRNA. | 2007 |
| C20orf26 | both | NM_001167816 | Homo sapiens chromosome 20 open reading frame 26 (C20orf26), transcript variant 2, mRNA. | 2008 |
| C20orf26 | both | NM_015585 | Homo sapiens chromosome 20 open reading frame 26 (C20orf26), transcript variant 1, mRNA. | 2009 |
| CRNKL1 | both | NM_016652 | Homo sapiens crooked neck pre-mRNA splicing factor-like 1 (Drosophila) (CRNKL1), mRNA. | 2010 |
| FGF12 | intronic | NM_021032 | Homo sapiens fibroblast growth factor 12 (FGF12), transcript variant 1, mRNA. | 2011 |
| FGF12 | intronic | NM_004113 | Homo sapiens fibroblast growth factor 12 (FGF12), transcript variant 2, mRNA. | 2012 |
| FGF10 | exonic | NM_004465 | Homo sapiens fibroblast growth factor 10 (FGF10), mRNA. | 2013 |
| LRRIQ3 | both | NM_001105659 | Homo sapiens leucine-rich repeats and IQ motif containing 3 (LRRIQ3), mRNA. | 2014 |
| SENP5 | both | NM_152699 | Homo sapiens SUMO1/sentrin specific peptidase 5 (SENP5), mRNA. | 2015 |
| PAK2 | exonic | NM_002577 | Homo sapiens p21 protein (Cdc42/Rac)-activated kinase 2 (PAK2), mRNA. | 2016 |
| GADL1 | both | NM_207359 | Homo sapiens glutamate decarboxylase-like 1 (GADL1), mRNA. | 2017 |
| MGAT4C | intronic | NM_013244 | Homo sapiens mannosyl (alpha-1,3-)-glycoprotein beta-1,4-N-acetylglucosaminyltransferase, isozyme C (putative) (MGAT4C), mRNA. | 2018 |
| PLCL1 | both | NM_006226 | Homo sapiens phospholipase C-like 1 (PLCL1), mRNA. | 2019 |
| MTHFD1L | both | NM_001242767 | Homo sapiens methylenetetrahydrofolate dehydrogenase (NADP+ dependent) 1-like (MTHFD1L), nuclear gene encoding mitochondrial protein, transcript variant 1, mRNA. | 2020 |
| MTHFD1L | both | NM_015440 | Homo sapiens methylenetetrahydrofolate dehydrogenase (NADP+ dependent) 1-like (MTHFD1L), nuclear gene encoding mitochondrial protein, transcript variant 2, mRNA. | 2021 |
| MTHFD1L | both | NM_001242768 | Homo sapiens methylenetetrahydrofolate dehydrogenase (NADP+ dependent) 1-like (MTHFD1L), transcript variant 3, mRNA. | 2022 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| RNF144B | both | NM_182757 | Homo sapiens ring finger protein 144B (RNF144B), mRNA. | 2023 |
| FLJ33630 | intronic | NR_015360 | Homo sapiens uncharacterized LOC644873 (FLJ33630), non-coding RNA. | 2024 |
| DPP6 | intronic | NM_001936 | Homo sapiens dipeptidyl-peptidase 6 (DPP6), transcript variant 2, mRNA. | 2025 |
| DPP6 | intronic | NM_001039350 | Homo sapiens dipeptidyl-peptidase 6 (DPP6), transcript variant 3, mRNA. | 2026 |
| DPP6 | intronic | NM_130797 | Homo sapiens dipeptidyl-peptidase 6 (DPP6), transcript variant 1, mRNA. | 2027 |
| LRP1 | exonic | NM_002332 | Homo sapiens low density lipoprotein receptor-related protein 1 (LRP1), mRNA. | 2028 |
| SHMT2 | exonic | NM_005412 | Homo sapiens serine hydroxymethyltransferase 2 (mitochondrial) (SHMT2), nuclear gene encoding mitochondrial protein, transcript variant 1, mRNA. | 2029 |
| NDUFA4L2 | exonic | NM_020142 | Homo sapiens NADH dehydrogenase (ubiquinone) 1 alpha subcomplex, 4-like 2 (NDUFA4L2), mRNA. | 2030 |
| SHMT2 | exonic | NR_029416 | Homo sapiens serine hydroxymethyltransferase 2 (mitochondrial) (SHMT2), transcript variant 7, non-coding RNA. | 2031 |
| SHMT2 | exonic | NR_029415 | Homo sapiens serine hydroxymethyltransferase 2 (mitochondrial) (SHMT2), transcript variant 6, non-coding RNA. | 2032 |
| SHMT2 | exonic | NM_001166358 | Homo sapiens serine hydroxymethyltransferase 2 (mitochondrial) (SHMT2), transcript variant 4, mRNA. | 2033 |
| SHMT2 | exonic | NM_001166357 | Homo sapiens serine hydroxymethyltransferase 2 (mitochondrial) (SHMT2), transcript variant 3, mRNA. | 2034 |
| SHMT2 | exonic | NM_001166356 | Homo sapiens serine hydroxymethyltransferase 2 (mitochondrial) (SHMT2), nuclear gene encoding mitochondrial protein, transcript variant 2, mRNA. | 2035 |
| NXPH4 | exonic | NM_007224 | Homo sapiens neurexophilin 4 (NXPH4), mRNA. | 2036 |
| SHMT2 | exonic | NM_001166359 | Homo sapiens serine hydroxymethyltransferase 2 (mitochondrial) (SHMT2), transcript variant 5, mRNA. | 2037 |
| SHMT2 | exonic | NR_029417 | Homo sapiens serine hydroxymethyltransferase 2 (mitochondrial) (SHMT2), transcript variant 8, non-coding RNA. | 2038 |
| ULK1 | exonic | NM_003565 | Homo sapiens unc-51-like kinase 1 (C. elegans) (ULK1), mRNA. | 2039 |
| GSTTP2 | exonic | NR_003082 | Homo sapiens glutathione S-transferase theta pseudogene 2 (GSTTP2), non-coding RNA. | 2040 |
| NLRP4 | exonic | NM_134444 | Homo sapiens NLR family, pyrin domain containing 4 (NLRP4), mRNA. | 2041 |
| NLRP7 | exonic | NM_139176 | Homo sapiens NLR family, pyrin domain containing 7 (NLRP7), transcript variant 1, mRNA. | 2042 |
| NLRP7 | exonic | NM_206828 | Homo sapiens NLR family, pyrin domain containing 7 (NLRP7), transcript variant 2, mRNA. | 2043 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| NLRP7 | exonic | NM_001127255 | Homo sapiens NLR family, pyrin domain containing 7 (NLRP7), transcript variant 3, mRNA. | 2044 |
| ALDH1A3 | exonic | NM_000693 | Homo sapiens aldehyde dehydrogenase 1 family, member A3 (ALDH1A3), mRNA. | 2045 |
| RTTN | both | NM_173630 | Homo sapiens rotatin (RTTN), mRNA. | 2046 |
| RBFOX1 | intronic | NM_001142333 | Homo sapiens RNA binding protein, fox-1 homolog (C. elegans) 1 (RBFOX1), transcript variant 5, mRNA. | 2047 |
| RBFOX1 | intronic | NM_018723 | Homo sapiens RNA binding protein, fox-1 homolog (C. elegans) 1 (RBFOX1), transcript variant 4, mRNA. | 2048 |
| RBFOX1 | intronic | NM_001142334 | Homo sapiens RNA binding protein, fox-1 homolog (C. elegans) 1 (RBFOX1), transcript variant 6, mRNA. | 2049 |
| FBXO18 | both | NM_001258452 | Homo sapiens F-box protein, helicase, 18 (FBXO18), transcript variant 3, mRNA. | 2050 |
| FBXO18 | both | NM_001258453 | Homo sapiens F-box protein, helicase, 18 (FBXO18), transcript variant 4, mRNA. | 2051 |
| FBXO18 | both | NM_032807 | Homo sapiens F-box protein, helicase, 18 (FBXO18), transcript variant 1, mRNA. | 2052 |
| FBXO18 | both | NM_178150 | Homo sapiens F-box protein, helicase, 18 (FBXO18), transcript variant 2, mRNA. | 2053 |
| FBXW11 | both | NM_012300 | Homo sapiens F-box and WD repeat domain containing 11 (FBXW11), transcript variant 3, mRNA. | 2054 |
| FBXW11 | both | NM_033645 | Homo sapiens F-box and WD repeat domain containing 11 (FBXW11), transcript variant 1, mRNA. | 2055 |
| FBXW11 | both | NM_033644 | Homo sapiens F-box and WD repeat domain containing 11 (FBXW11), transcript variant 2, mRNA. | 2056 |
| ERC2 | exonic | NM_015576 | Homo sapiens ELKS/RAB6-interacting/CAST family member 2 (ERC2), mRNA. | 2057 |
| GABRE | exonic | NM_004961 | Homo sapiens gamma-aminobutyric acid (GABA) A receptor, epsilon (GABRE), mRNA. | 2058 |
| KIF7 | exonic | NM_198525 | Homo sapiens kinesin family member 7 (KIF7), mRNA. | 2059 |
| JAG2 | exonic | NM_002226 | Homo sapiens jagged 2 (JAG2), transcript variant 1, mRNA. | 2060 |
| JAG2 | exonic | NM_145159 | Homo sapiens jagged 2 (JAG2), transcript variant 2, mRNA. | 2061 |
| SRGAP2 | exonic | NM_015326 | Homo sapiens SLIT-ROBO Rho GTPase activating protein 2 (SRGAP2), transcript variant 1, mRNA. | 2062 |
| SRGAP2 | exonic | NM_001170637 | Homo sapiens SLIT-ROBO Rho GTPase activating protein 2 (SRGAP2), transcript variant 3, mRNA. | 2063 |
| SRGAP2 | exonic | NM_001042758 | Homo sapiens SLIT-ROBO Rho GTPase activating protein 2 (SRGAP2), transcript variant 2, mRNA. | 2064 |
| CTSE | exonic | NM_001910 | Homo sapiens cathepsin E (CTSE), transcript variant 1, mRNA. | 2065 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| CTSE | exonic | NM_148964 | Homo sapiens cathepsin E (CTSE), transcript variant 2, mRNA. | 2066 |
| LMLN | exonic | NR_026786 | Homo sapiens leishmanolysin-like (metallopeptidase M8 family) (LMLN), transcript variant 3, non-coding RNA. | 2067 |
| LMLN | exonic | NM_001136049 | Homo sapiens leishmanolysin-like (metallopeptidase M8 family) (LMLN), transcript variant 1, mRNA. | 2068 |
| LMLN | exonic | NR_026787 | Homo sapiens leishmanolysin-like (metallopeptidase M8 family) (LMLN), transcript variant 4, non-coding RNA. | 2069 |
| LMLN | exonic | NM_033029 | Homo sapiens leishmanolysin-like (metallopeptidase M8 family) (LMLN), transcript variant 2, mRNA. | 2070 |
| LRCH3 | exonic | NM_032773 | Homo sapiens leucine-rich repeats and calponin homology (CH) domain containing 3 (LRCH3), mRNA. | 2071 |
| RPL35A | exonic | NM_000996 | Homo sapiens ribosomal protein L35a (RPL35A), mRNA. | 2072 |
| IQCG | exonic | NM_001134435 | Homo sapiens IQ motif containing G (IQCG), transcript variant 2, mRNA. | 2073 |
| IQCG | exonic | NM_032263 | Homo sapiens IQ motif containing G (IQCG), transcript variant 1, mRNA. | 2074 |
| UBE2D3 | exonic | NM_003340 | Homo sapiens ubiquitin-conjugating enzyme E2D 3 (UBE2D3), transcript variant 1, mRNA. | 2075 |
| UBE2D3 | exonic | NM_181887 | Homo sapiens ubiquitin-conjugating enzyme E2D 3 (UBE2D3), transcript variant 3, mRNA. | 2076 |
| UBE2D3 | exonic | NM_181893 | Homo sapiens ubiquitin-conjugating enzyme E2D 3 (UBE2D3), transcript variant 9, mRNA. | 2077 |
| UBE2D3 | exonic | NM_181892 | Homo sapiens ubiquitin-conjugating enzyme E2D 3 (UBE2D3), transcript variant 8, mRNA. | 2078 |
| UBE2D3 | exonic | NM_181891 | Homo sapiens ubiquitin-conjugating enzyme E2D 3 (UBE2D3), transcript variant 7, mRNA. | 2079 |
| UBE2D3 | exonic | NM_181890 | Homo sapiens ubiquitin-conjugating enzyme E2D 3 (UBE2D3), transcript variant 6, mRNA. | 2080 |
| UBE2D3 | exonic | NM_181888 | Homo sapiens ubiquitin-conjugating enzyme E2D 3 (UBE2D3), transcript variant 4, mRNA. | 2081 |
| UBE2D3 | exonic | NM_181886 | Homo sapiens ubiquitin-conjugating enzyme E2D 3 (UBE2D3), transcript variant 2, mRNA. | 2082 |
| UBE2D3 | exonic | NM_181889 | Homo sapiens ubiquitin-conjugating enzyme E2D 3 (UBE2D3), transcript variant 5, mRNA. | 2083 |
| LGI1 | intronic | NM_005097 | Homo sapiens leucine-rich, glioma inactivated 1 (LGI1), mRNA. | 2084 |
| ANKRD16 | exonic | NM_019046 | Homo sapiens ankyrin repeat domain 16 (ANKRD16), transcript variant 1, mRNA. | 2085 |
| ANKRD16 | exonic | NM_001009941 | Homo sapiens ankyrin repeat domain 16 (ANKRD16), transcript variant 2, mRNA. | 2086 |
| ANKRD16 | exonic | NM_001009943 | Homo sapiens ankyrin repeat domain 16 (ANKRD16), transcript variant 4, mRNA. | 2087 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| NRG1 | intronic | NM_013962 | Homo sapiens neuregulin 1 (NRG1), transcript variant GGF2, mRNA. | 2088 |
| NRG1 | intronic | NM_001160008 | Homo sapiens neuregulin 1 (NRG1), transcript variant HRG-beta2b, mRNA. | 2089 |
| NRG1 | intronic | NM_001160007 | Homo sapiens neuregulin 1 (NRG1), transcript variant HRG-gamma3, mRNA. | 2090 |
| NRG1 | intronic | NM_001160005 | Homo sapiens neuregulin 1 (NRG1), transcript variant HRG-beta3b, mRNA. | 2091 |
| NRG1 | intronic | NM_001160004 | Homo sapiens neuregulin 1 (NRG1), transcript variant ndf43b, mRNA. | 2092 |
| NRG1 | intronic | NM_013964 | Homo sapiens neuregulin 1 (NRG1), transcript variant HRG-alpha, mRNA. | 2093 |
| NRG1 | intronic | NM_004495 | Homo sapiens neuregulin 1 (NRG1), transcript variant HRG-gamma, mRNA. | 2094 |
| NRG1 | intronic | NM_013956 | Homo sapiens neuregulin 1 (NRG1), transcript variant HRG-beta1, mRNA. | 2095 |
| NRG1 | intronic | NM_001160002 | Homo sapiens neuregulin 1 (NRG1), transcript variant HRG-gamma2, mRNA. | 2096 |
| NRG1 | intronic | NM_013960 | Homo sapiens neuregulin 1 (NRG1), transcript variant ndf43, mRNA. | 2097 |
| NRG1 | intronic | NM_013958 | Homo sapiens neuregulin 1 (NRG1), transcript variant HRG-beta3, mRNA. | 2098 |
| NRG1 | intronic | NM_013957 | Homo sapiens neuregulin 1 (NRG1), transcript variant HRG-beta2, mRNA. | 2099 |
| NRG3 | intronic | NM_001165972 | Homo sapiens neuregulin 3 (NRG3), transcript variant 2, mRNA. | 2100 |
| NRG3 | intronic | NM_001010848 | Homo sapiens neuregulin 3 (NRG3), transcript variant 1, mRNA. | 2101 |
| NRG3 | intronic | NM_001165973 | Homo sapiens neuregulin 3 (NRG3), transcript variant 3, mRNA. | 2102 |
| NTF3 | both | NM_001102654 | Homo sapiens neurotrophin 3 (NTF3), transcript variant 1, mRNA. | 2103 |
| MANBA | exonic | NM_005908 | Homo sapiens mannosidase, beta A, lysosomal (MANBA), mRNA. | 2104 |
| TACR3 | exonic | NM_001059 | Homo sapiens tachykinin receptor 3 (TACR3), mRNA. | 2105 |
| SLC39A8 | exonic | NM_001135146 | Homo sapiens solute carrier family 39 (zinc transporter), member 8 (SLC39A8), transcript variant 2, mRNA. | 2106 |
| SLC39A8 | exonic | NM_001135147 | Homo sapiens solute carrier family 39 (zinc transporter), member 8 (SLC39A8), transcript variant 3, mRNA. | 2107 |
| SLC39A8 | exonic | NM_001135148 | Homo sapiens solute carrier family 39 (zinc transporter), member 8 (SLC39A8), transcript variant 4, mRNA. | 2108 |
| NFKB1 | exonic | NM_001165412 | Homo sapiens nuclear factor of kappa light polypeptide gene enhancer in B-cells 1 (NFKB1), transcript variant 2, mRNA. | 2109 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| NFKB1 | exonic | NM_003998 | Homo sapiens nuclear factor of kappa light polypeptide gene enhancer in B-cells 1 (NFKB1), transcript variant 1, mRNA. | 2110 |
| SLC39A8 | exonic | NM_022154 | Homo sapiens solute carrier family 39 (zinc transporter), member 8 (SLC39A8), transcript variant 1, mRNA. | 2111 |
| CENPE | exonic | NM_001813 | Homo sapiens centromere protein E, 312kDa (CENPE), mRNA. | 2112 |
| SLC9B2 | exonic | NM_178833 | Homo sapiens solute carrier family 9, subfamily B (NHA2, cation proton antiporter 2), member 2 (SLC9B2), nuclear gene encoding mitochondrial protein, mRNA. | 2113 |
| SLC9B1 | exonic | NM_139173 | Homo sapiens solute carrier family 9, subfamily B (NHA1, cation proton antiporter 1), member 1 (SLC9B1), nuclear gene encoding mitochondrial protein, transcript variant 1, mRNA. | 2114 |
| SLC9B1 | exonic | NM_001100874 | Homo sapiens solute carrier family 9, subfamily B (NHA1, cation proton antiporter 1), member 1 (SLC9B1), nuclear gene encoding mitochondrial protein, transcript variant 2, mRNA. | 2115 |
| SLC9B1 | exonic | NR_047515 | Homo sapiens solute carrier family 9, subfamily B (NHA1, cation proton antiporter 1), member 1 (SLC9B1), transcript variant 4, non-coding RNA. | 2116 |
| SLC9B1 | exonic | NR_047513 | Homo sapiens solute carrier family 9, subfamily B (NHA1, cation proton antiporter 1), member 1 (SLC9B1), transcript variant 3, non-coding RNA. | 2117 |
| CISD2 | exonic | NM_001008388 | Homo sapiens CDGSH iron sulfur domain 2 (CISD2), mRNA. | 2118 |
| BDH2 | exonic | NM_020139 | Homo sapiens 3-hydroxybutyrate dehydrogenase, type 2 (BDH2), mRNA. | 2119 |
| MGAM | exonic | NM_004668 | Homo sapiens maltase-glucoamylase (alpha-glucosidase) (MGAM), mRNA. | 2120 |
| PCDHA8 | exonic | NM_018911 | Homo sapiens protocadherin alpha 8 (PCDHA8), transcript variant 1, mRNA. | 2121 |
| PCDHA6 | exonic | NM_018909 | Homo sapiens protocadherin alpha 6 (PCDHA6), transcript variant 1, mRNA. | 2122 |
| PCDHA5 | exonic | NM_018908 | Homo sapiens protocadherin alpha 5 (PCDHA5), transcript variant 1, mRNA. | 2123 |
| PCDHA9 | exonic | NM_031857 | Homo sapiens protocadherin alpha 9 (PCDHA9), transcript variant 1, mRNA. | 2124 |
| PCDHA7 | exonic | NM_018910 | Homo sapiens protocadherin alpha 7 (PCDHA7), transcript variant 1, mRNA. | 2125 |
| PCDHA3 | exonic | NM_018906 | Homo sapiens protocadherin alpha 3 (PCDHA3), transcript variant 1, mRNA. | 2126 |
| PCDHA6 | exonic | NM_031849 | Homo sapiens protocadherin alpha 6 (PCDHA6), transcript variant 3, mRNA. | 2127 |
| PCDHA2 | exonic | NM_018905 | Homo sapiens protocadherin alpha 2 (PCDHA2), transcript variant 1, mRNA. | 2128 |
| PCDHA10 | exonic | NM_031860 | Homo sapiens protocadherin alpha 10 (PCDHA10), transcript variant 3, mRNA. | 2129 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| PCDHA1 | exonic | NM_031411 | Homo sapiens protocadherin alpha 1 (PCDHA1), transcript variant 3, mRNA. | 2130 |
| PCDHA1 | exonic | NM_018900 | Homo sapiens protocadherin alpha 1 (PCDHA1), transcript variant 1, mRNA. | 2131 |
| PCDHA4 | exonic | NM_018907 | Homo sapiens protocadherin alpha 4 (PCDHA4), transcript variant 1, mRNA. | 2132 |
| PCDHA10 | exonic | NM_018901 | Homo sapiens protocadherin alpha 10 (PCDHA10), transcript variant 1, mRNA. | 2133 |
| PCDHA9 | exonic | NM_014005 | Homo sapiens protocadherin alpha 9 (PCDHA9), transcript variant 2, mRNA. | 2134 |
| PCDHA10 | exonic | NM_031859 | Homo sapiens protocadherin alpha 10 (PCDHA10), transcript variant 2, mRNA. | 2135 |
| PCDHA8 | exonic | NM_031856 | Homo sapiens protocadherin alpha 8 (PCDHA8), transcript variant 2, mRNA. | 2136 |
| PARVB | exonic | NM_013327 | Homo sapiens parvin, beta (PARVB), transcript variant 2, mRNA. | 2137 |
| PARVB | exonic | NM_001243386 | Homo sapiens parvin, beta (PARVB), transcript variant 4, mRNA. | 2138 |
| PARVB | exonic | NM_001243385 | Homo sapiens parvin, beta (PARVB), transcript variant 3, mRNA. | 2139 |
| PARVB | exonic | NM_001003828 | Homo sapiens parvin, beta (PARVB), transcript variant 1, mRNA. | 2140 |
| PTPRO | both | NM_002848 | Homo sapiens protein tyrosine phosphatase, receptor type, O (PTPRO), transcript variant 2, mRNA. | 2141 |
| PTPRO | both | NM_030667 | Homo sapiens protein tyrosine phosphatase, receptor type, O (PTPRO), transcript variant 1, mRNA. | 2142 |
| SLC25A24 | both | NM_013386 | Homo sapiens solute carrier family 25 (mitochondrial carrier; phosphate carrier), member 24 (SLC25A24), nuclear gene encoding mitochondrial protein, transcript variant 1, mRNA. | 2143 |
| SLC25A24 | both | NM_213651 | Homo sapiens solute carrier family 25 (mitochondrial carrier; phosphate carrier), member 24 (SLC25A24), nuclear gene encoding mitochondrial protein, transcript variant 2, mRNA. | 2144 |
| SLC38A6 | both | NR_033344 | Homo sapiens solute carrier family 38, member 6 (SLC38A6), transcript variant 3, non-coding RNA. | 2145 |
| SLC38A6 | both | NM_153811 | Homo sapiens solute carrier family 38, member 6 (SLC38A6), transcript variant 2, mRNA. | 2146 |
| SLC38A6 | both | NM_001172702 | Homo sapiens solute carrier family 38, member 6 (SLC38A6), transcript variant 1, mRNA. | 2147 |
| CORIN | exonic | NM_006587 | Homo sapiens corin, serine peptidase (CORIN), mRNA. | 2148 |
| DDX11 | both | NM_152438 | Homo sapiens DEAD/H (Asp-Glu-Ala-Asp/His) box helicase 11 (DDX11), transcript variant 3, mRNA. | 2149 |
| DDX11 | both | NM_004399 | Homo sapiens DEAD/H (Asp-Glu-Ala-Asp/His) box helicase 11 (DDX11), transcript variant 2, mRNA. | 2150 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| DDX11 | both | NM_030653 | Homo sapiens DEAD/H (Asp-Glu-Ala-Asp/His) box helicase 11 (DDX11), transcript variant 1, mRNA. | 2151 |
| DDX11 | both | NM_001257144 | Homo sapiens DEAD/H (Asp-Glu-Ala-Asp/His) box helicase 11 (DDX11), transcript variant 4, mRNA. | 2152 |
| DDX11 | both | NM_001257145 | Homo sapiens DEAD/H (Asp-Glu-Ala-Asp/His) box helicase 11 (DDX11), transcript variant 5, mRNA. | 2153 |
| DDX11-AS1 | exonic | NR_038927 | Homo sapiens DDX11 antisense RNA 1 (DDX11-AS1), non-coding RNA. | 2154 |
| CFH | exonic | NM_000186 | Homo sapiens complement factor H (CFH), nuclear gene encoding mitochondrial protein, transcript variant 1, mRNA. | 2155 |
| CFHR3 | exonic | NM_001166624 | Homo sapiens complement factor H-related 3 (CFHR3), transcript variant 2, mRNA. | 2156 |
| CFHR3 | exonic | NM_021023 | Homo sapiens complement factor H-related 3 (CFHR3), transcript variant 1, mRNA. | 2157 |
| CFHR1 | exonic | NM_002113 | Homo sapiens complement factor H-related 1 (CFHR1), mRNA. | 2158 |
| CFHR4 | exonic | NM_001201551 | Homo sapiens complement factor H-related 4 (CFHR4), transcript variant 2, mRNA. | 2159 |
| CFHR4 | exonic | NM_006684 | Homo sapiens complement factor H-related 4 (CFHR4), transcript variant 3, mRNA. | 2160 |
| CFHR4 | exonic | NM_001201550 | Homo sapiens complement factor H-related 4 (CFHR4), transcript variant 1, mRNA. | 2161 |
| KATNAL2 | exonic | NM_031303 | Homo sapiens katanin p60 subunit A-like 2 (KATNAL2), mRNA. | 2162 |
| KCNA7 | exonic | NM_031886 | Homo sapiens potassium voltage-gated channel, shaker-related subfamily, member 7 (KCNA7), mRNA. | 2163 |
| NTF4 | exonic | NM_006179 | Homo sapiens neurotrophin 4 (NTF4), mRNA. | 2164 |
| LOC255130 | both | NR_034081 | Homo sapiens uncharacterized LOC255130 (LOC255130), non-coding RNA. | 2165 |
| MLL3 | both | NM_170606 | Homo sapiens myeloid/lymphoid or mixed-lineage leukemia 3 (MLL3), mRNA. | 2166 |
| FABP5P3 | exonic | NR_002935 | Homo sapiens fatty acid binding protein 5 pseudogene 3 (FABP5P3), non-coding RNA. | 2167 |
| LOC100128822 | exonic | NR_027387 | Homo sapiens uncharacterized LOC100128822 (LOC100128822), non-coding RNA. | 2168 |
| ZNF396 | both | NM_145756 | Homo sapiens zinc finger protein 396 (ZNF396), mRNA. | 2169 |
| PITPNM3 | exonic | NM_031220 | Homo sapiens PITPNM family member 3 (PITPNM3), transcript variant 1, mRNA. | 2170 |
| PITPNM3 | exonic | NM_001165966 | Homo sapiens PITPNM family member 3 (PITPNM3), transcript variant 2, mRNA. | 2171 |
| PITPN | introni | NM_012 | Homo sapiens phosphatidylinositol transfer protein, cytoplasmic 1 | 21 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| C1 | c | 417 | (PITPNC1), transcript variant 1, mRNA. | 72 |
| PITPNC1 | intronic | NM_181671 | Homo sapiens phosphatidylinositol transfer protein, cytoplasmic 1 (PITPNC1), transcript variant 2, mRNA. | 2173 |
| ACTG1P4 | exonic | NR_024438 | Homo sapiens actin, gamma 1 pseudogene 4 (ACTG1P4), non-coding RNA. | 2174 |
| AMY2B | both | NM_020978 | Homo sapiens amylase, alpha 2B (pancreatic) (AMY2B), mRNA. | 2175 |
| AMY1A | exonic | NM_004038 | Homo sapiens amylase, alpha 1A (salivary) (AMY1A), transcript variant 1, mRNA. | 2176 |
| AMY1A | exonic | NM_001008221 | Homo sapiens amylase, alpha 1A (salivary) (AMY1A), transcript variant 2, mRNA. | 2177 |
| AMY2A | exonic | NM_000699 | Homo sapiens amylase, alpha 2A (pancreatic) (AMY2A), mRNA. | 2178 |
| AMY1C | exonic | NM_001008219 | Homo sapiens amylase, alpha 1C (salivary) (AMY1C), mRNA. | 2179 |
| AMY1B | exonic | NM_001008218 | Homo sapiens amylase, alpha 1B (salivary) (AMY1B), mRNA. | 2180 |
| RNPC3 | exonic | NM_017619 | Homo sapiens RNA-binding region (RNP1, RRM) containing 3 (RNPC3), mRNA. | 2181 |
| MEGF10 | both | NM_032446 | Homo sapiens multiple EGF-like-domains 10 (MEGF10), transcript variant 1, mRNA. | 2182 |
| MEGF10 | both | NM_001256545 | Homo sapiens multiple EGF-like-domains 10 (MEGF10), transcript variant 2, mRNA. | 2183 |
| ZNF317 | exonic | NM_020933 | Homo sapiens zinc finger protein 317 (ZNF317), transcript variant 1, mRNA. | 2184 |
| ZNF317 | exonic | NM_001190791 | Homo sapiens zinc finger protein 317 (ZNF317), transcript variant 1, mRNA. | 2185 |
| TRIQK | both | NM_001171798 | Homo sapiens triple QxxK/R motif containing (TRIQK), transcript variant 4, mRNA. | 2186 |
| TRIQK | both | NM_001171795 | Homo sapiens triple QxxK/R motif containing (TRIQK), transcript variant 3, mRNA. | 2187 |
| TRIQK | both | NM_001191036 | Homo sapiens triple QxxK/R motif containing (TRIQK), transcript variant 7, mRNA. | 2188 |
| TRIQK | both | NM_001171796 | Homo sapiens triple QxxK/R motif containing (TRIQK), transcript variant 1, mRNA. | 2189 |
| TRIQK | both | NM_001171797 | Homo sapiens triple QxxK/R motif containing (TRIQK), transcript variant 2, mRNA. | 2190 |
| TRIQK | both | NM_001191035 | Homo sapiens triple QxxK/R motif containing (TRIQK), transcript variant 6, mRNA. | 2191 |
| TRIQK | both | NM_001171799 | Homo sapiens triple QxxK/R motif containing (TRIQK), transcript variant 5, mRNA. | 2192 |
| CERK | exonic | NM_022766 | Homo sapiens ceramide kinase (CERK), mRNA. | 2193 |
| CTSL2 | exonic | NM_001 | Homo sapiens cathepsin L2 (CTSL2), transcript variant 2, mRNA. | 21 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| | | 201575 | | 94 |
| CTSL2 | exonic | NM_001333 | Homo sapiens cathepsin L2 (CTSL2), transcript variant 1, mRNA. | 2195 |
| FAM35A | exonic | NM_019054 | Homo sapiens family with sequence similarity 35, member A (FAM35A), mRNA. | 2196 |
| LOC728190 | exonic | NR_024397 | Homo sapiens uncharacterized LOC728190 (LOC728190), non-coding RNA. | 2197 |
| FAM22A | exonic | NM_001099338 | Homo sapiens family with sequence similarity 22, member A (FAM22A), mRNA. | 2198 |
| LOC439994 | exonic | NR_029408 | Homo sapiens uncharacterized LOC439994 (LOC439994), non-coding RNA. | 2199 |
| FAM22D | exonic | NM_001009610 | Homo sapiens family with sequence similarity 22, member D (FAM22D), mRNA. | 2200 |
| LOC728218 | exonic | NR_046091 | Homo sapiens uncharacterized LOC728218 (LOC728218), non-coding RNA. | 2201 |
| MAS1 | exonic | NM_002377 | Homo sapiens MAS1 oncogene (MAS1), mRNA. | 2202 |
| METTL21C | both | NM_001010977 | Homo sapiens methyltransferase like 21C (METTL21C), mRNA. | 2203 |
| MNX1 | exonic | NM_001165255 | Homo sapiens motor neuron and pancreas homeobox 1 (MNX1), transcript variant 2, mRNA. | 2204 |
| MNX1 | exonic | NM_005515 | Homo sapiens motor neuron and pancreas homeobox 1 (MNX1), transcript variant 1, mRNA. | 2205 |
| NSL1 | exonic | NM_001042549 | Homo sapiens NSL1, MIND kinetochore complex component, homolog (S. cerevisiae) (NSL1), transcript variant 2, mRNA. | 2206 |
| NSL1 | exonic | NM_015471 | Homo sapiens NSL1, MIND kinetochore complex component, homolog (S. cerevisiae) (NSL1), transcript variant 1, mRNA. | 2207 |
| PIGZ | exonic | NM_025163 | Homo sapiens phosphatidylinositol glycan anchor biosynthesis, class Z (PIGZ), mRNA. | 2208 |
| PKD1L3 | exonic | NM_181536 | Homo sapiens polycystic kidney disease 1-like 3 (PKD1L3), mRNA. | 2209 |
| PROSC | exonic | NM_007198 | Homo sapiens proline synthetase co-transcribed homolog (bacterial) (PROSC), mRNA. | 2210 |
| RALYL | both | NM_173848 | Homo sapiens RALY RNA binding protein-like (RALYL), transcript variant 3, mRNA. | 2211 |
| RALYL | both | NM_001100393 | Homo sapiens RALY RNA binding protein-like (RALYL), transcript variant 4, mRNA. | 2212 |
| RALYL | both | NM_001100392 | Homo sapiens RALY RNA binding protein-like (RALYL), transcript variant 2, mRNA. | 2213 |
| RALYL | both | NM_001100391 | Homo sapiens RALY RNA binding protein-like (RALYL), transcript variant 1, mRNA. | 2214 |
| RASA3 | exonic | NM_007368 | Homo sapiens RAS p21 protein activator 3 (RASA3), mRNA. | 2215 |
| RBM2 | both | NM_018 | Homo sapiens RNA binding motif protein 27 (RBM27), mRNA. | 22 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| 7 | | 989 | | 16 |
| RBM25 | intronic | NM_021239 | Homo sapiens RNA binding motif protein 25 (RBM25), mRNA. | 2217 |
| TARS | exonic | NM_001258438 | Homo sapiens threonyl-tRNA synthetase (TARS), transcript variant 3, mRNA. | 2218 |
| TARS | exonic | NM_152295 | Homo sapiens threonyl-tRNA synthetase (TARS), transcript variant 1, mRNA. | 2219 |
| TARS | exonic | NR_047676 | Homo sapiens threonyl-tRNA synthetase (TARS), transcript variant 4, non-coding RNA. | 2220 |
| TARS | exonic | NR_047677 | Homo sapiens threonyl-tRNA synthetase (TARS), transcript variant 5, non-coding RNA. | 2221 |
| TARS | exonic | NR_047678 | Homo sapiens threonyl-tRNA synthetase (TARS), transcript variant 6, non-coding RNA. | 2222 |
| TARS | exonic | NM_001258437 | Homo sapiens threonyl-tRNA synthetase (TARS), transcript variant 2, mRNA. | 2223 |
| TAAR1 | exonic | NM_138327 | Homo sapiens trace amine associated receptor 1 (TAAR1), mRNA. | 2224 |
| TPTE2P3 | exonic | NR_002793 | Homo sapiens transmembrane phosphoinositide 3-phosphatase and tensin homolog 2 pseudogene 3 (TPTE2P3), non-coding RNA. | 2225 |
| TRAF3 | exonic | NM_001199427 | Homo sapiens TNF receptor-associated factor 3 (TRAF3), transcript variant 4, mRNA. | 2226 |
| TRAF3 | exonic | NM_003300 | Homo sapiens TNF receptor-associated factor 3 (TRAF3), transcript variant 3, mRNA. | 2227 |
| TRAF3 | exonic | NM_145726 | Homo sapiens TNF receptor-associated factor 3 (TRAF3), transcript variant 2, mRNA. | 2228 |
| TRAF3 | exonic | NM_145725 | Homo sapiens TNF receptor-associated factor 3 (TRAF3), transcript variant 1, mRNA. | 2229 |
| ZBTB20 | exonic | NM_001164345 | Homo sapiens zinc finger and BTB domain containing 20 (ZBTB20), transcript variant 5, mRNA. | 2230 |
| ZBTB20 | exonic | NM_001164344 | Homo sapiens zinc finger and BTB domain containing 20 (ZBTB20), transcript variant 4, mRNA. | 2231 |
| ZBTB20 | exonic | NM_015642 | Homo sapiens zinc finger and BTB domain containing 20 (ZBTB20), transcript variant 2, mRNA. | 2232 |
| ZBTB20 | exonic | NM_001164343 | Homo sapiens zinc finger and BTB domain containing 20 (ZBTB20), transcript variant 3, mRNA. | 2233 |
| FAM70B | both | NM_182614 | Homo sapiens family with sequence similarity 70, member B (FAM70B), mRNA. | 2234 |
| GAS6 | exonic | NM_001143946 | Homo sapiens growth arrest-specific 6 (GAS6), transcript variant 3, mRNA. | 2235 |
| GAS6 | exonic | NM_000820 | Homo sapiens growth arrest-specific 6 (GAS6), transcript variant 1, mRNA. | 2236 |
| GAS6-AS1 | exonic | NR_044995 | Homo sapiens GAS6 antisense RNA 1 (GAS6-AS1), non-coding RNA. | 2237 |
| GAS6 | exonic | NM_001 | Homo sapiens growth arrest-specific 6 (GAS6), transcript variant 2, | 22 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| | | 143945 | mRNA. | 38 |
| ACYP2 | both | NM_138448 | Homo sapiens acylphosphatase 2, muscle type (ACYP2), mRNA. | 2239 |
| TSPYL6 | exonic | NM_001003937 | Homo sapiens TSPY-like 6 (TSPYL6), mRNA. | 2240 |
| AKR1B15 | exonic | NM_001080538 | Homo sapiens aldo-keto reductase family 1, member B15 (AKR1B15), mRNA. | 2241 |
| ATP12A | exonic | NM_001185085 | Homo sapiens ATPase, H+/K+ transporting, nongastric, alpha polypeptide (ATP12A), transcript variant 1, mRNA. | 2242 |
| ATP12A | exonic | NM_001676 | Homo sapiens ATPase, H+/K+ transporting, nongastric, alpha polypeptide (ATP12A), transcript variant 2, mRNA. | 2243 |
| BLVRA | exonic | NM_000712 | Homo sapiens biliverdin reductase A (BLVRA), transcript variant 1, mRNA. | 2244 |
| BLVRA | exonic | NM_001253823 | Homo sapiens biliverdin reductase A (BLVRA), transcript variant 2, mRNA. | 2245 |
| C16orf74 | exonic | NM_206967 | Homo sapiens chromosome 16 open reading frame 74 (C16orf74), mRNA. | 2246 |
| MIR1910 | exonic | NR_031731 | Homo sapiens microRNA 1910 (MIR1910), microRNA. | 2247 |
| VGLL4 | both | NM_014667 | Homo sapiens vestigial like 4 (Drosophila) (VGLL4), transcript variant 2, mRNA. | 2248 |
| TAMM41 | exonic | NM_138807 | Homo sapiens TAM41, mitochondrial translocator assembly and maintenance protein, homolog (S. cerevisiae) (TAMM41), nuclear gene encoding mitochondrial protein, mRNA. | 2249 |
| COL24A1 | exonic | NM_152890 | Homo sapiens collagen, type XXIV, alpha 1 (COL24A1), mRNA. | 2250 |
| DCTN4 | both | NM_001135643 | Homo sapiens dynactin 4 (p62) (DCTN4), transcript variant 1, mRNA. | 2251 |
| DCTN4 | both | NM_001135644 | Homo sapiens dynactin 4 (p62) (DCTN4), transcript variant 3, mRNA. | 2252 |
| DCTN4 | both | NM_016221 | Homo sapiens dynactin 4 (p62) (DCTN4), transcript variant 2, mRNA. | 2253 |
| DGKB | both | NM_145695 | Homo sapiens diacylglycerol kinase, beta 90kDa (DGKB), transcript variant 2, mRNA. | 2254 |
| DGKB | both | NM_004080 | Homo sapiens diacylglycerol kinase, beta 90kDa (DGKB), transcript variant 1, mRNA. | 2255 |
| DLG2 | both | NM_001142699 | Homo sapiens discs, large homolog 2 (Drosophila) (DLG2), transcript variant 1, mRNA. | 2256 |
| F7 | exonic | NM_001267554 | Homo sapiens coagulation factor VII (serum prothrombin conversion accelerator) (F7), transcript variant 3, mRNA. | 2257 |
| F7 | exonic | NM_019616 | Homo sapiens coagulation factor VII (serum prothrombin conversion accelerator) (F7), transcript variant 2, mRNA. | 2258 |
| F7 | exonic | NM_000131 | Homo sapiens coagulation factor VII (serum prothrombin conversion accelerator) (F7), transcript variant 1, mRNA. | 2259 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| F7 | exonic | NR_051961 | Homo sapiens coagulation factor VII (serum prothrombin conversion accelerator) (F7), transcript variant 4, non-coding RNA. | 2260 |
| MGC21881 | exonic | NR_015363 | Homo sapiens uncharacterized locus MGC21881 (MGC21881), non-coding RNA. | 2261 |
| LOC653501 | exonic | NR_003528 | Homo sapiens zinc finger protein 658 pseudogene (LOC653501), non-coding RNA. | 2262 |
| CNTNAP3 | exonic | NM_033655 | Homo sapiens contactin associated protein-like 3 (CNTNAP3), mRNA. | 2263 |
| ZNF658 | exonic | NM_033160 | Homo sapiens zinc finger protein 658 (ZNF658), mRNA. | 2264 |
| AQP7P3 | exonic | NR_026558 | Homo sapiens aquaporin 7 pseudogene 3 (AQP7P3), non-coding RNA. | 2265 |
| ANKRD20A2 | exonic | NM_001012421 | Homo sapiens ankyrin repeat domain 20 family, member A2 (ANKRD20A2), mRNA. | 2266 |
| ANKRD20A3 | exonic | NM_001012419 | Homo sapiens ankyrin repeat domain 20 family, member A3 (ANKRD20A3), mRNA. | 2267 |
| ZNF658B | exonic | NR_027861 | Homo sapiens zinc finger protein 658B, pseudogene (ZNF658B), non-coding RNA. | 2268 |
| SPATA31A1 | | NM_001085452 | Homo sapiens SPATA31 subfamily A, member 1 (SPATA31A1), mRNA. | 2269 |
| SPATA31A2 | | NM_001040065 | Homo sapiens SPATA31 subfamily A, member 2 (SPATA31A2), mRNA. | 2270 |
| FAM74A1 | exonic | NR_026803 | Homo sapiens family with sequence similarity 74, member A1 (FAM74A1), non-coding RNA. | 2271 |
| SPATA31A3 | | NM_001083124 | Homo sapiens SPATA31 subfamily A, member 3 (SPATA31A3), mRNA. | 2272 |
| FAM74A3 | exonic | NR_026801 | Homo sapiens family with sequence similarity 74, member A3 (FAM74A3), non-coding RNA. | 2273 |
| SPATA31A5 | | NM_001113541 | Homo sapiens SPATA31 subfamily A, member 5 (SPATA31A5), mRNA. | 2274 |
| SPATA31A7 | | NM_015667 | Homo sapiens SPATA31 subfamily A, member 7 (SPATA31A7), mRNA. | 2275 |
| SPATA31A4 | | NM_001242613 | Homo sapiens SPATA31 subfamily A, member 4 (SPATA31A4), mRNA. | 2276 |
| KGFLP2 | exonic | NR_003670 | Homo sapiens keratinocyte growth factor-like protein 2 (KGFLP2), non-coding RNA. | 2277 |
| LOC643648 | exonic | NR_046203 | Homo sapiens uncharacterized LOC643648 (LOC643648), non-coding RNA. | 2278 |
| FAM95B1 | exonic | NR_026759 | Homo sapiens family with sequence similarity 95, member B1 (FAM95B1), non-coding RNA. | 2279 |
| FOXD4L4 | exonic | NM_199244 | Homo sapiens forkhead box D4-like 4 (FOXD4L4), mRNA. | 2280 |
| FOXD4L2 | exonic | NM_001099279 | Homo sapiens forkhead box D4-like 2 (FOXD4L2), mRNA. | 2281 |

| RefSeq Gene Symbol | CNV Gene Region | RefSeq Accession Number | RefSeq Gene Description/Definition | SEQ ID |
|---|---|---|---|---|
| LOC286297 | exonic | NR_046175 | Homo sapiens uncharacterized LOC286297 (LOC286297), non-coding RNA. | 2282 |
| LOC642929 | exonic | NR_027472 | Homo sapiens general transcription factor II, i pseudogene (LOC642929), non-coding RNA. | 2283 |
| SPATA31A6 | | NM_001145196 | Homo sapiens SPATA31 subfamily A, member 6 (SPATA31A6), mRNA. | 2284 |
| CNTNAP3B | exonic | NM_001201380 | Homo sapiens contactin associated protein-like 3B (CNTNAP3B), mRNA. | 2285 |
| FAM27C | exonic | NR_027421 | Homo sapiens family with sequence similarity 27, member C (FAM27C), non-coding RNA. | 2286 |
| IL1RAPL1 | both | NM_014271 | Homo sapiens interleukin 1 receptor accessory protein-like 1 (IL1RAPL1), mRNA. | 2287 |
| IL1RAPL2 | intronic | NM_017416 | Homo sapiens interleukin 1 receptor accessory protein-like 2 (IL1RAPL2), mRNA. | 2288 |
| GNB1 | exonic | NM_002074 | Homo sapiens guanine nucleotide binding protein (G protein), beta polypeptide 1 (GNB1), mRNA. | 2289 |
| KIAA1751 | exonic | NM_001080484 | Homo sapiens KIAA1751 (KIAA1751), mRNA. | 2290 |
| TMEM52 | exonic | NM_178545 | Homo sapiens transmembrane protein 52 (TMEM52), mRNA. | 2291 |
| CALML6 | exonic | NM_138705 | Homo sapiens calmodulin-like 6 (CALML6), mRNA. | 2292 |
| KLRC2 | exonic | NM_002260 | Homo sapiens killer cell lectin-like receptor subfamily C, member 2 (KLRC2), mRNA. | 2293 |
| KLRC1 | exonic | NM_002259 | Homo sapiens killer cell lectin-like receptor subfamily C, member 1 (KLRC1), transcript variant 1, mRNA. | 2294 |
| KLRC1 | exonic | NM_213658 | Homo sapiens killer cell lectin-like receptor subfamily C, member 1 (KLRC1), transcript variant 3, mRNA. | 2295 |
| KLRC1 | exonic | NM_213657 | Homo sapiens killer cell lectin-like receptor subfamily C, member 1 (KLRC1), transcript variant 4, mRNA. | 2296 |
| KLRC1 | exonic | NM_007328 | Homo sapiens killer cell lectin-like receptor subfamily C, member 1 (KLRC1), transcript variant 2, mRNA. | 2297 |
| KLRC3 | exonic | NM_002261 | Homo sapiens killer cell lectin-like receptor subfamily C, member 3 (KLRC3), transcript variant 1, mRNA. | 2298 |
| KLRC3 | exonic | NM_007333 | Homo sapiens killer cell lectin-like receptor subfamily C, member 3 (KLRC3), transcript variant 2, mRNA. | 2299 |
| ZNF707 | exonic | NM_001100599 | Homo sapiens zinc finger protein 707 (ZNF707), transcript variant 3, mRNA. | 2300 |
| BREA2 | exonic | NR_015445 | Homo sapiens breast cancer estrogen-induced apoptosis 2 (BREA2), non-coding RNA. | 2301 |
| ZNF707 | exonic | NM_001100598 | Homo sapiens zinc finger protein 707 (ZNF707), transcript variant 2, mRNA. | 2302 |
| CCDC166 | exonic | NM_001162914 | Homo sapiens coiled-coil domain containing 166 (CCDC166), mRNA. | 2303 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| ZNF707 | exonic | NM_173831 | Homo sapiens zinc finger protein 707 (ZNF707), transcript variant 1, mRNA. | 2304 |
| GRM5 | intronic | NM_000842 | Homo sapiens glutamate receptor, metabotropic 5 (GRM5), transcript variant b, mRNA. | 2305 |
| GRM5 | intronic | NM_001143831 | Homo sapiens glutamate receptor, metabotropic 5 (GRM5), transcript variant a, mRNA. | 2306 |
| KANSL1 | both | NM_015443 | Homo sapiens KAT8 regulatory NSL complex subunit 1 (KANSL1), transcript variant 2, mRNA. | 2307 |
| KANSL1 | both | NM_001193466 | Homo sapiens KAT8 regulatory NSL complex subunit 1 (KANSL1), transcript variant 1, mRNA. | 2308 |
| KANSL1 | both | NM_001193465 | Homo sapiens KAT8 regulatory NSL complex subunit 1 (KANSL1), transcript variant 3, mRNA. | 2309 |
| KANSL1-AS1 | exonic | NR_034172 | Homo sapiens KANSL1 antisense RNA 1 (KANSL1-AS1), non-coding RNA. | 2310 |
| ADK | intronic | NM_006721 | Homo sapiens adenosine kinase (ADK), transcript variant 2, mRNA. | 2311 |
| ADK | intronic | NM_001123 | Homo sapiens adenosine kinase (ADK), transcript variant 1, mRNA. | 2312 |
| ADK | intronic | NM_001202449 | Homo sapiens adenosine kinase (ADK), transcript variant 3, mRNA. | 2313 |
| ADK | intronic | NM_001202450 | Homo sapiens adenosine kinase (ADK), transcript variant 4, mRNA. | 2314 |
| BICC1 | both | NM_001080512 | Homo sapiens bicaudal C homolog 1 (Drosophila) (BICC1), mRNA. | 2315 |
| FAM133CP | exonic | NR_027508 | Homo sapiens family with sequence similarity 133, member C, pseudogene (FAM133CP), non-coding RNA. | 2316 |
| NLGN1 | intronic | NM_014932 | Homo sapiens neuroligin 1 (NLGN1), mRNA. | 2317 |
| PRTN3 | exonic | NM_002777 | Homo sapiens proteinase 3 (PRTN3), mRNA. | 2318 |
| MATN2 | intronic | NM_030583 | Homo sapiens matrilin 2 (MATN2), transcript variant 2, mRNA. | 2319 |
| MATN2 | intronic | NM_002380 | Homo sapiens matrilin 2 (MATN2), transcript variant 1, mRNA. | 2320 |
| SGK1 | exonic | NM_001143676 | Homo sapiens serum/glucocorticoid regulated kinase 1 (SGK1), transcript variant 2, mRNA. | 2321 |
| ALLC | intronic | NM_018436 | Homo sapiens allantoicase (ALLC), transcript variant 1, mRNA. | 2322 |
| PCBD2 | intronic | NM_032151 | Homo sapiens pterin-4 alpha-carbinolamine dehydratase/dimerization cofactor of hepatocyte nuclear factor 1 alpha (TCF1) 2 (PCBD2), mRNA. | 2323 |
| SPAG16 | both | NM_024532 | Homo sapiens sperm associated antigen 16 (SPAG16), transcript variant 1, mRNA. | 2324 |
| SPAG16 | both | NR_0476 | Homo sapiens sperm associated antigen 16 (SPAG16), transcript | 23 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| 6 | | 59 | variant 3, non-coding RNA. | 25 |
| SPAG16 | both | NR_047660 | Homo sapiens sperm associated antigen 16 (SPAG16), transcript variant 4, non-coding RNA. | 2326 |
| PUF60 | exonic | NM_014281 | Homo sapiens poly-U binding splicing factor 60KDa (PUF60), transcript variant 2, mRNA. | 2327 |
| PUF60 | exonic | NM_001136033 | Homo sapiens poly-U binding splicing factor 60KDa (PUF60), transcript variant 3, mRNA. | 2328 |
| PUF60 | exonic | NM_078480 | Homo sapiens poly-U binding splicing factor 60KDa (PUF60), transcript variant 1, mRNA. | 2329 |
| PUF60 | exonic | NM_001271100 | Homo sapiens poly-U binding splicing factor 60KDa (PUF60), transcript variant 8, mRNA. | 2330 |
| PUF60 | exonic | NM_001271096 | Homo sapiens poly-U binding splicing factor 60KDa (PUF60), transcript variant 4, mRNA. | 2331 |
| PUF60 | exonic | NM_001271099 | Homo sapiens poly-U binding splicing factor 60KDa (PUF60), transcript variant 7, mRNA. | 2332 |
| PUF60 | exonic | NM_001271098 | Homo sapiens poly-U binding splicing factor 60KDa (PUF60), transcript variant 6, mRNA. | 2333 |
| PUF60 | exonic | NM_001271097 | Homo sapiens poly-U binding splicing factor 60KDa (PUF60), transcript variant 5, mRNA. | 2334 |
| STAU2 | both | NM_001164381 | Homo sapiens staufen, RNA binding protein, homolog 2 (Drosophila) (STAU2), transcript variant 2, mRNA. | 2335 |
| STAU2 | both | NM_001164383 | Homo sapiens staufen, RNA binding protein, homolog 2 (Drosophila) (STAU2), transcript variant 4, mRNA. | 2336 |
| STAU2 | both | NM_001164382 | Homo sapiens staufen, RNA binding protein, homolog 2 (Drosophila) (STAU2), transcript variant 3, mRNA. | 2337 |
| STAU2 | both | NM_001164380 | Homo sapiens staufen, RNA binding protein, homolog 2 (Drosophila) (STAU2), transcript variant 1, mRNA. | 2338 |
| STAU2 | both | NM_001164384 | Homo sapiens staufen, RNA binding protein, homolog 2 (Drosophila) (STAU2), transcript variant 6, mRNA. | 2339 |
| STAU2 | both | NM_001164385 | Homo sapiens staufen, RNA binding protein, homolog 2 (Drosophila) (STAU2), transcript variant 7, mRNA. | 2340 |
| STAU2 | both | NM_014393 | Homo sapiens staufen, RNA binding protein, homolog 2 (Drosophila) (STAU2), transcript variant 5, mRNA. | 2341 |
| CNBD1 | intronic | NM_173538 | Homo sapiens cyclic nucleotide binding domain containing 1 (CNBD1), mRNA. | 2342 |
| MIR5694 | exonic | NR_049879 | Homo sapiens microRNA 5694 (MIR5694), microRNA. | 2343 |
| WDR11 | exonic | NM_018117 | Homo sapiens WD repeat domain 11 (WDR11), mRNA. | 2344 |
| RNF130 | exonic | NM_018434 | Homo sapiens ring finger protein 130 (RNF130), mRNA. | 2345 |
| VIMP | exonic | NM_203472 | Homo sapiens VCP-interacting membrane protein (VIMP), transcript variant 1, mRNA. | 2346 |
| VIMP | exonic | NM_018 | Homo sapiens VCP-interacting membrane protein (VIMP), | 23 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| | | 445 | transcript variant 2, mRNA. | 47 |
| HKR1 | intronic | NM_181786 | Homo sapiens HKR1, GLI-Kruppel zinc finger family member (HKR1), mRNA. | 2348 |
| SEPT14 | exonic | NM_207366 | Homo sapiens septin 14 (SEPT14), mRNA. | 2349 |
| STK31 | intronic | NM_001260505 | Homo sapiens serine/threonine kinase 31 (STK31), transcript variant 5, mRNA. | 2350 |
| STK31 | intronic | NM_031414 | Homo sapiens serine/threonine kinase 31 (STK31), transcript variant 1, mRNA. | 2351 |
| STK31 | intronic | NM_001260504 | Homo sapiens serine/threonine kinase 31 (STK31), transcript variant 4, mRNA. | 2352 |
| STK31 | intronic | NM_032944 | Homo sapiens serine/threonine kinase 31 (STK31), transcript variant 2, mRNA. | 2353 |
| STK31 | intronic | NR_048542 | Homo sapiens serine/threonine kinase 31 (STK31), transcript variant 3, non-coding RNA. | 2354 |
| TSHZ2 | intronic | NM_173485 | Homo sapiens teashirt zinc finger homeobox 2 (TSHZ2), transcript variant 1, mRNA. | 2355 |
| ZNF585B | intronic | NM_152279 | Homo sapiens zinc finger protein 585B (ZNF585B), mRNA. | 2356 |
| BCOR | intronic | NM_001123384 | Homo sapiens BCL6 corepressor (BCOR), transcript variant 4, mRNA. | 2357 |
| BCOR | intronic | NM_001123383 | Homo sapiens BCL6 corepressor (BCOR), transcript variant 3, mRNA. | 2358 |
| CRB1 | intronic | NM_001193640 | Homo sapiens crumbs homolog 1 (Drosophila) (CRB1), transcript variant 2, mRNA. | 2359 |
| CRB1 | intronic | NM_201253 | Homo sapiens crumbs homolog 1 (Drosophila) (CRB1), transcript variant 1, mRNA. | 2360 |
| CRB1 | intronic | NM_001257965 | Homo sapiens crumbs homolog 1 (Drosophila) (CRB1), transcript variant 3, mRNA. | 2361 |
| CRB1 | intronic | NM_001257966 | Homo sapiens crumbs homolog 1 (Drosophila) (CRB1), transcript variant 4, mRNA. | 2362 |
| CRB1 | intronic | NR_047563 | Homo sapiens crumbs homolog 1 (Drosophila) (CRB1), transcript variant 5, non-coding RNA. | 2363 |
| CRB1 | intronic | NR_047564 | Homo sapiens crumbs homolog 1 (Drosophila) (CRB1), transcript variant 6, non-coding RNA. | 2364 |
| PLD1 | intronic | NM_002662 | Homo sapiens phospholipase D1, phosphatidylcholine-specific (PLD1), transcript variant 1, mRNA. | 2365 |
| PLD1 | intronic | NM_001130081 | Homo sapiens phospholipase D1, phosphatidylcholine-specific (PLD1), transcript variant 2, mRNA. | 2366 |
| PSD3 | intronic | NM_015310 | Homo sapiens pleckstrin and Sec7 domain containing 3 (PSD3), transcript variant 1, mRNA. | 2367 |
| RGS6 | intronic | NM_001204418 | Homo sapiens regulator of G-protein signaling 6 (RGS6), transcript variant 4, mRNA. | 2368 |
| RGS6 | intronic | NM_001 | Homo sapiens regulator of G-protein signaling 6 (RGS6), transcript | 23 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| | c | 204417 | variant 3, mRNA. | 69 |
| RGS6 | intronic | NM_001204416 | Homo sapiens regulator of G-protein signaling 6 (RGS6), transcript variant 1, mRNA. | 2370 |
| RGS6 | intronic | NM_001204424 | Homo sapiens regulator of G-protein signaling 6 (RGS6), transcript variant 10, mRNA. | 2371 |
| RGS6 | intronic | NM_004296 | Homo sapiens regulator of G-protein signaling 6 (RGS6), transcript variant 2, mRNA. | 2372 |
| RGS6 | intronic | NM_001204421 | Homo sapiens regulator of G-protein signaling 6 (RGS6), transcript variant 7, mRNA. | 2373 |
| RGS6 | intronic | NM_001204420 | Homo sapiens regulator of G-protein signaling 6 (RGS6), transcript variant 6, mRNA. | 2374 |
| RGS6 | intronic | NM_001204423 | Homo sapiens regulator of G-protein signaling 6 (RGS6), transcript variant 9, mRNA. | 2375 |
| RGS6 | intronic | NM_001204422 | Homo sapiens regulator of G-protein signaling 6 (RGS6), transcript variant 8, mRNA. | 2376 |
| RGS6 | intronic | NM_001204419 | Homo sapiens regulator of G-protein signaling 6 (RGS6), transcript variant 5, mRNA. | 2377 |
| RIMS1 | intronic | NM_014989 | Homo sapiens regulating synaptic membrane exocytosis 1 (RIMS1), transcript variant 1, mRNA. | 2378 |
| ZNF624 | intronic | NM_020787 | Homo sapiens zinc finger protein 624 (ZNF624), mRNA. | 2379 |
| ADAMTS20 | intronic | NM_025003 | Homo sapiens ADAM metallopeptidase with thrombospondin type 1 motif, 20 (ADAMTS20), mRNA. | 2380 |
| CAMTA1 | intronic | NM_015215 | Homo sapiens calmodulin binding transcription activator 1 (CAMTA1), transcript variant 1, mRNA. | 2381 |
| CAMTA1 | intronic | NM_001195563 | Homo sapiens calmodulin binding transcription activator 1 (CAMTA1), transcript variant 2, mRNA. | 2382 |
| CAMTA1 | intronic | NR_038934 | Homo sapiens calmodulin binding transcription activator 1 (CAMTA1), transcript variant 4, non-coding RNA. | 2383 |
| CAMTA1 | intronic | NM_001242701 | Homo sapiens calmodulin binding transcription activator 1 (CAMTA1), transcript variant 3, mRNA. | 2384 |
| CDH13 | intronic | NM_001257 | Homo sapiens cadherin 13, H-cadherin (heart) (CDH13), transcript variant 1, mRNA. | 2385 |
| CDH13 | intronic | NM_001220490 | Homo sapiens cadherin 13, H-cadherin (heart) (CDH13), transcript variant 4, mRNA. | 2386 |
| CDH13 | intronic | NM_001220489 | Homo sapiens cadherin 13, H-cadherin (heart) (CDH13), transcript variant 3, mRNA. | 2387 |
| CDH13 | intronic | NM_001220488 | Homo sapiens cadherin 13, H-cadherin (heart) (CDH13), transcript variant 2, mRNA. | 2388 |
| CDH13 | intronic | NM_001220492 | Homo sapiens cadherin 13, H-cadherin (heart) (CDH13), transcript variant 6, mRNA. | 2389 |
| CDH13 | intronic | NM_001220491 | Homo sapiens cadherin 13, H-cadherin (heart) (CDH13), transcript variant 5, mRNA. | 2390 |
| CRY1 | intronic | NM_004 | Homo sapiens cryptochrome 1 (photolyase-like) (CRY1), mRNA. | 23 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| | c | 075 | | 91 |
| CUX1 | intronic | NM_181500 | Homo sapiens cut-like homeobox 1 (CUX1), transcript variant 3, mRNA. | 2392 |
| CUX1 | intronic | NM_001202545 | Homo sapiens cut-like homeobox 1 (CUX1), transcript variant 6, mRNA. | 2393 |
| CUX1 | intronic | NM_001202544 | Homo sapiens cut-like homeobox 1 (CUX1), transcript variant 5, mRNA. | 2394 |
| CUX1 | intronic | NM_001202546 | Homo sapiens cut-like homeobox 1 (CUX1), transcript variant 7, mRNA. | 2395 |
| CUX1 | intronic | NM_001913 | Homo sapiens cut-like homeobox 1 (CUX1), transcript variant 2, mRNA. | 2396 |
| CUX1 | intronic | NM_181552 | Homo sapiens cut-like homeobox 1 (CUX1), transcript variant 1, mRNA. | 2397 |
| CUX1 | intronic | NM_001202543 | Homo sapiens cut-like homeobox 1 (CUX1), transcript variant 4, mRNA. | 2398 |
| CYP4F12 | both | NM_023944 | Homo sapiens cytochrome P450, family 4, subfamily F, polypeptide 12 (CYP4F12), mRNA. | 2399 |
| DLGAP2 | intronic | NM_004745 | Homo sapiens discs, large (Drosophila) homolog-associated protein 2 (DLGAP2), mRNA. | 2400 |
| FMNL2 | intronic | NM_052905 | Homo sapiens formin-like 2 (FMNL2), mRNA. | 2401 |
| GPR98 | intronic | NR_003149 | Homo sapiens G protein-coupled receptor 98 (GPR98), transcript variant 2, non-coding RNA. | 2402 |
| GPR98 | intronic | NM_032119 | Homo sapiens G protein-coupled receptor 98 (GPR98), transcript variant 1, mRNA. | 2403 |
| GRIN2A | intronic | NM_000833 | Homo sapiens glutamate receptor, ionotropic, N-methyl D-aspartate 2A (GRIN2A), transcript variant 2, mRNA. | 2404 |
| GRIN2A | intronic | NM_001134408 | Homo sapiens glutamate receptor, ionotropic, N-methyl D-aspartate 2A (GRIN2A), transcript variant 3, mRNA. | 2405 |
| GRIN2A | intronic | NM_001134407 | Homo sapiens glutamate receptor, ionotropic, N-methyl D-aspartate 2A (GRIN2A), transcript variant 1, mRNA. | 2406 |
| MAGI3 | intronic | NM_001142782 | Homo sapiens membrane associated guanylate kinase, WW and PDZ domain containing 3 (MAGI3), transcript variant 1, mRNA. | 2407 |
| MAGI3 | intronic | NM_152900 | Homo sapiens membrane associated guanylate kinase, WW and PDZ domain containing 3 (MAGI3), transcript variant 2, mRNA. | 2408 |
| MAP2 | intronic | NM_001039538 | Homo sapiens microtubule-associated protein 2 (MAP2), transcript variant 5, mRNA. | 2409 |
| MOB3B | intronic | NM_024761 | Homo sapiens MOB kinase activator 3B (MOB3B), mRNA. | 2410 |
| NKAIN3 | intronic | NM_173688 | Homo sapiens Na+/K+ transporting ATPase interacting 3 (NKAIN3), mRNA. | 2411 |
| NRXN3 | intronic | NM_004796 | Homo sapiens neurexin 3 (NRXN3), transcript variant 1, mRNA. | 2412 |
| NRXN | intronic | NM_001 | Homo sapiens neurexin 3 (NRXN3), transcript variant 3, mRNA. | 24 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| 3 | c | 105250 | | 13 |
| NRXN3 | intronic | NM_138970 | Homo sapiens neurexin 3 (NRXN3), transcript variant 2, mRNA. | 2414 |
| PHACTR2 | intronic | NM_001100166 | Homo sapiens phosphatase and actin regulator 2 (PHACTR2), transcript variant 4, mRNA. | 2415 |
| PHACTR2 | intronic | NM_014721 | Homo sapiens phosphatase and actin regulator 2 (PHACTR2), transcript variant 3, mRNA. | 2416 |
| RASSF3 | intronic | NM_178169 | Homo sapiens Ras association (RalGDS/AF-6) domain family member 3 (RASSF3), transcript variant 1, mRNA. | 2417 |
| RASSF3 | intronic | NR_040718 | Homo sapiens Ras association (RalGDS/AF-6) domain family member 3 (RASSF3), transcript variant 2, non-coding RNA. | 2418 |
| RPS6KC1 | intronic | NM_001136138 | Homo sapiens ribosomal protein S6 kinase, 52kDa, polypeptide 1 (RPS6KC1), transcript variant 2, mRNA. | 2419 |
| RPS6KC1 | intronic | NM_012424 | Homo sapiens ribosomal protein S6 kinase, 52kDa, polypeptide 1 (RPS6KC1), transcript variant 1, mRNA. | 2420 |
| SPON1 | intronic | NM_006108 | Homo sapiens spondin 1, extracellular matrix protein (SPON1), mRNA. | 2421 |
| STXBP5L | intronic | NM_014980 | Homo sapiens syntaxin binding protein 5-like (STXBP5L), mRNA. | 2422 |
| STX8 | intronic | NR_033656 | Homo sapiens syntaxin 8 (STX8), transcript variant 2, non-coding RNA. | 2423 |
| STX8 | intronic | NM_004853 | Homo sapiens syntaxin 8 (STX8), transcript variant 1, mRNA. | 2424 |
| SYT1 | intronic | NM_001135805 | Homo sapiens synaptotagmin I (SYT1), transcript variant 2, mRNA. | 2425 |
| SYT1 | intronic | NM_005639 | Homo sapiens synaptotagmin I (SYT1), transcript variant 1, mRNA. | 2426 |
| TNFRSF1A | intronic | NM_001065 | Homo sapiens tumor necrosis factor receptor superfamily, member 1A (TNFRSF1A), mRNA. | 2427 |
| ADAMTS3 | intronic | NM_014243 | Homo sapiens ADAM metallopeptidase with thrombospondin type 1 motif, 3 (ADAMTS3), mRNA. | 2428 |
| BAIAP2L1 | intronic | NM_018842 | Homo sapiens BAI1-associated protein 2-like 1 (BAIAP2L1), mRNA. | 2429 |
| C11orf49 | intronic | NM_024113 | Homo sapiens chromosome 11 open reading frame 49 (C11orf49), transcript variant 3, mRNA. | 2430 |
| C11orf49 | intronic | NM_001003678 | Homo sapiens chromosome 11 open reading frame 49 (C11orf49), transcript variant 4, mRNA. | 2431 |
| C11orf49 | intronic | NM_001003677 | Homo sapiens chromosome 11 open reading frame 49 (C11orf49), transcript variant 2, mRNA. | 2432 |
| C11orf49 | intronic | NM_001003676 | Homo sapiens chromosome 11 open reading frame 49 (C11orf49), transcript variant 1, mRNA. | 2433 |
| CACNA2D1 | intronic | NM_000722 | Homo sapiens calcium channel, voltage-dependent, alpha 2/delta subunit 1 (CACNA2D1), mRNA. | 2434 |
| CACN | exonic | NM_001 | Homo sapiens calcium channel, voltage-dependent, N type, alpha | 24 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| A1B | | 243812 | 1B subunit (CACNA1B), transcript variant 2, mRNA. | 35 |
| CACNA1B | exonic | NM_000718 | Homo sapiens calcium channel, voltage-dependent, N type, alpha 1B subunit (CACNA1B), transcript variant 1, mRNA. | 2436 |
| EFNA5 | intronic | NM_001962 | Homo sapiens ephrin-A5 (EFNA5), mRNA. | 2437 |
| EPHA3 | exonic | NM_005233 | Homo sapiens EPH receptor A3 (EPHA3), transcript variant 1, mRNA. | 2438 |
| EPHA3 | exonic | NM_182644 | Homo sapiens EPH receptor A3 (EPHA3), transcript variant 2, mRNA. | 2439 |
| GALNT13 | intronic | NM_052917 | Homo sapiens UDP-N-acetyl-alpha-D-galactosamine:polypeptide N-acetylgalactosaminyltransferase 13 (GalNAc-T13) (GALNT13), mRNA. | 2440 |
| IGSF21 | intronic | NM_032880 | Homo sapiens immunoglobin superfamily, member 21 (IGSF21), mRNA. | 2441 |
| LRRFIP1 | intronic | NM_001137550 | Homo sapiens leucine rich repeat (in FLII) interacting protein 1 (LRRFIP1), transcript variant 1, mRNA. | 2442 |
| MECP2 | intronic | NM_001110792 | Homo sapiens methyl CpG binding protein 2 (Rett syndrome) (MECP2), transcript variant 2, mRNA. | 2443 |
| MECP2 | intronic | NM_004992 | Homo sapiens methyl CpG binding protein 2 (Rett syndrome) (MECP2), transcript variant 1, mRNA. | 2444 |
| RGS7 | exonic | NM_002924 | Homo sapiens regulator of G-protein signaling 7 (RGS7), mRNA. | 2445 |
| MIR3123 | exonic | NR_036069 | Homo sapiens microRNA 3123 (MIR3123), microRNA. | 2446 |
| NFIC | intronic | NM_001245004 | Homo sapiens nuclear factor I/C (CCAAT-binding transcription factor) (NFIC), transcript variant 3, mRNA. | 2447 |
| NFIC | intronic | NM_001245005 | Homo sapiens nuclear factor I/C (CCAAT-binding transcription factor) (NFIC), transcript variant 4, mRNA. | 2448 |
| NFIC | intronic | NM_005597 | Homo sapiens nuclear factor I/C (CCAAT-binding transcription factor) (NFIC), transcript variant 5, mRNA. | 2449 |
| NFIC | intronic | NM_205843 | Homo sapiens nuclear factor I/C (CCAAT-binding transcription factor) (NFIC), transcript variant 2, mRNA. | 2450 |
| NFIC | intronic | NM_001245002 | Homo sapiens nuclear factor I/C (CCAAT-binding transcription factor) (NFIC), transcript variant 1, mRNA. | 2451 |
| PTPRD | intronic | NM_001171025 | Homo sapiens protein tyrosine phosphatase, receptor type, D (PTPRD), transcript variant 6, mRNA. | 2452 |
| PTPRD | intronic | NM_002839 | Homo sapiens protein tyrosine phosphatase, receptor type, D (PTPRD), transcript variant 1, mRNA. | 2453 |
| PTPRD | intronic | NM_130393 | Homo sapiens protein tyrosine phosphatase, receptor type, D (PTPRD), transcript variant 4, mRNA. | 2454 |
| PTPRD | intronic | NM_130392 | Homo sapiens protein tyrosine phosphatase, receptor type, D (PTPRD), transcript variant 3, mRNA. | 2455 |
| PTPRD | intronic | NM_130391 | Homo sapiens protein tyrosine phosphatase, receptor type, D (PTPRD), transcript variant 2, mRNA. | 2456 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| PTPRD | intronic | NM_001040712 | Homo sapiens protein tyrosine phosphatase, receptor type, D (PTPRD), transcript variant 5, mRNA. | 2457 |
| RORA | intronic | NM_134261 | Homo sapiens RAR-related orphan receptor A (RORA), transcript variant 1, mRNA. | 2458 |
| SCAMP1 | intronic | NM_004866 | Homo sapiens secretory carrier membrane protein 1 (SCAMP1), mRNA. | 2459 |
| TMEM117 | intronic | NM_032256 | Homo sapiens transmembrane protein 117 (TMEM117), mRNA. | 2460 |
| WBSCR17 | intronic | NM_022479 | Homo sapiens Williams-Beuren syndrome chromosome region 17 (WBSCR17), mRNA. | 2461 |
| GNG12-AS1 | intronic | NR_040077 | Homo sapiens GNG12 antisense RNA 1 (GNG12-AS1), non-coding RNA. | 2462 |
| WLS | intronic | NM_001193334 | Homo sapiens wntless homolog (Drosophila) (WLS), transcript variant 3, mRNA. | 2463 |
| WLS | intronic | NM_024911 | Homo sapiens wntless homolog (Drosophila) (WLS), transcript variant 1, mRNA. | 2464 |
| WLS | intronic | NM_001002292 | Homo sapiens wntless homolog (Drosophila) (WLS), transcript variant 2, mRNA. | 2465 |
| XKR4 | intronic | NM_052898 | Homo sapiens XK, Kell blood group complex subunit-related family, member 4 (XKR4), mRNA. | 2466 |
| CREBRF | exonic | NM_153607 | Homo sapiens CREB3 regulatory factor (CREBRF), transcript variant 1, mRNA. | 2467 |
| C4orf19 | exonic | NM_001104629 | Homo sapiens chromosome 4 open reading frame 19 (C4orf19), transcript variant 1, mRNA. | 2468 |
| RELL1 | exonic | NM_001085399 | Homo sapiens RELT-like 1 (RELL1), transcript variant 2, mRNA. | 2469 |
| C4orf19 | exonic | NM_018302 | Homo sapiens chromosome 4 open reading frame 19 (C4orf19), transcript variant 2, mRNA. | 2470 |
| PREPL | exonic | NM_001042385 | Homo sapiens prolyl endopeptidase-like (PREPL), transcript variant 4, mRNA. | 2471 |
| PREPL | exonic | NM_001171617 | Homo sapiens prolyl endopeptidase-like (PREPL), transcript variant 7, mRNA. | 2472 |
| PREPL | exonic | NM_001042386 | Homo sapiens prolyl endopeptidase-like (PREPL), transcript variant 5, mRNA. | 2473 |
| PREPL | exonic | NM_001171603 | Homo sapiens prolyl endopeptidase-like (PREPL), transcript variant 2, mRNA. | 2474 |
| PREPL | exonic | NM_001171613 | Homo sapiens prolyl endopeptidase-like (PREPL), transcript variant 6, mRNA. | 2475 |
| PREPL | exonic | NM_001171606 | Homo sapiens prolyl endopeptidase-like (PREPL), transcript variant 3, mRNA. | 2476 |
| PREPL | exonic | NM_006036 | Homo sapiens prolyl endopeptidase-like (PREPL), transcript variant 1, mRNA. | 2477 |
| CAMKMT | exonic | NM_024766 | Homo sapiens calmodulin-lysine N-methyltransferase (CAMKMT), mRNA. | 2478 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| SLC3A1 | exonic | NM_000341 | Homo sapiens solute carrier family 3 (cystine, dibasic and neutral amino acid transporters, activator of cystine, dibasic and neutral amino acid transport), member 1 (SLC3A1), mRNA. | 2479 |
| DNAH10 | exonic | NM_207437 | Homo sapiens dynein, axonemal, heavy chain 10 (DNAH10), mRNA. | 2480 |
| DNAH12 | exonic | NM_178504 | Homo sapiens dynein, axonemal, heavy chain 12 (DNAH12), transcript variant 1, mRNA. | 2481 |
| DNAH8 | exonic | NM_001206927 | Homo sapiens dynein, axonemal, heavy chain 8 (DNAH8), mRNA. | 2482 |
| DNAJC18 | exonic | NM_152686 | Homo sapiens DnaJ (Hsp40) homolog, subfamily C, member 18 (DNAJC18), mRNA. | 2483 |
| FHIT | exonic | NM_001166243 | Homo sapiens fragile histidine triad (FHIT), transcript variant 2, mRNA. | 2484 |
| FHIT | exonic | NM_002012 | Homo sapiens fragile histidine triad (FHIT), transcript variant 1, mRNA. | 2485 |
| LPP | exonic | NM_001167672 | Homo sapiens LIM domain containing preferred translocation partner in lipoma (LPP), transcript variant 3, mRNA. | 2486 |
| LPP | exonic | NM_001167671 | Homo sapiens LIM domain containing preferred translocation partner in lipoma (LPP), transcript variant 2, mRNA. | 2487 |
| LPP | exonic | NM_005578 | Homo sapiens LIM domain containing preferred translocation partner in lipoma (LPP), transcript variant 1, mRNA. | 2488 |
| FLJ42393 | exonic | NR_024413 | Homo sapiens uncharacterized LOC401105 (FLJ42393), non-coding RNA. | 2489 |
| LOC648691 | exonic | NR_027426 | Homo sapiens uncharacterized LOC648691 (LOC648691), non-coding RNA. | 2490 |
| VPREB1 | exonic | NM_007128 | Homo sapiens pre-B lymphocyte 1 (VPREB1), mRNA. | 2491 |
| LOC96610 | exonic | NR_027293 | Homo sapiens BMS1 homolog, ribosome assembly protein (yeast) pseudogene (LOC96610), non-coding RNA. | 2492 |
| PRAME | exonic | NM_006115 | Homo sapiens preferentially expressed antigen in melanoma (PRAME), transcript variant 1, mRNA. | 2493 |
| ZNF280A | exonic | NM_080740 | Homo sapiens zinc finger protein 280A (ZNF280A), mRNA. | 2494 |
| ZNF280B | exonic | NM_080764 | Homo sapiens zinc finger protein 280B (ZNF280B), mRNA. | 2495 |
| PRAME | exonic | NM_206956 | Homo sapiens preferentially expressed antigen in melanoma (PRAME), transcript variant 5, mRNA. | 2496 |
| PRAME | exonic | NM_206955 | Homo sapiens preferentially expressed antigen in melanoma (PRAME), transcript variant 4, mRNA. | 2497 |
| PRAME | exonic | NM_206954 | Homo sapiens preferentially expressed antigen in melanoma (PRAME), transcript variant 3, mRNA. | 2498 |
| PRAME | exonic | NM_206953 | Homo sapiens preferentially expressed antigen in melanoma (PRAME), transcript variant 2, mRNA. | 2499 |
| GGTL | exonic | NM_199 | Homo sapiens gamma-glutamyltransferase light chain 2 | 25 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| C2 | | 127 | (GGTLC2), transcript variant 1, mRNA. | 00 |
| POM121L1P | exonic | NR_024591 | Homo sapiens POM121 transmembrane nucleoporin-like 1, pseudogene (POM121L1P), non-coding RNA. | 2501 |
| MIR650 | exonic | NR_030755 | Homo sapiens microRNA 650 (MIR650), microRNA. | 2502 |
| IGLL5 | exonic | NM_001178126 | Homo sapiens immunoglobulin lambda-like polypeptide 5 (IGLL5), transcript variant 1, mRNA. | 2503 |
| IGLL5 | exonic | NM_001256296 | Homo sapiens immunoglobulin lambda-like polypeptide 5 (IGLL5), transcript variant 2, mRNA. | 2504 |
| GNG4 | exonic | NM_004485 | Homo sapiens guanine nucleotide binding protein (G protein), gamma 4 (GNG4), transcript variant 3, mRNA. | 2505 |
| GNG4 | exonic | NM_001098722 | Homo sapiens guanine nucleotide binding protein (G protein), gamma 4 (GNG4), transcript variant 1, mRNA. | 2506 |
| GNG4 | exonic | NM_001098721 | Homo sapiens guanine nucleotide binding protein (G protein), gamma 4 (GNG4), transcript variant 2, mRNA. | 2507 |
| B3GALNT2 | exonic | NM_152490 | Homo sapiens beta-1,3-N-acetylgalactosaminyltransferase 2 (B3GALNT2), mRNA. | 2508 |
| TBCE | exonic | NM_003193 | Homo sapiens tubulin folding cofactor E (TBCE), transcript variant 2, mRNA. | 2509 |
| TBCE | exonic | NM_001079515 | Homo sapiens tubulin folding cofactor E (TBCE), transcript variant 1, mRNA. | 2510 |
| HTR1E | exonic | NM_000865 | Homo sapiens 5-hydroxytryptamine (serotonin) receptor 1E, G protein-coupled (HTR1E), mRNA. | 2511 |
| IKBKB | exonic | NM_001190720 | Homo sapiens inhibitor of kappa light polypeptide gene enhancer in B-cells, kinase beta (IKBKB), transcript variant 2, mRNA. | 2512 |
| IKBKB | exonic | NM_001242778 | Homo sapiens inhibitor of kappa light polypeptide gene enhancer in B-cells, kinase beta (IKBKB), transcript variant 7, mRNA. | 2513 |
| IKBKB | exonic | NR_033819 | Homo sapiens inhibitor of kappa light polypeptide gene enhancer in B-cells, kinase beta (IKBKB), transcript variant 6, non-coding RNA. | 2514 |
| IKBKB | exonic | NM_001556 | Homo sapiens inhibitor of kappa light polypeptide gene enhancer in B-cells, kinase beta (IKBKB), transcript variant 1, mRNA. | 2515 |
| IKBKB | exonic | NR_040009 | Homo sapiens inhibitor of kappa light polypeptide gene enhancer in B-cells, kinase beta (IKBKB), transcript variant 8, non-coding RNA. | 2516 |
| IKBKB | exonic | NR_033818 | Homo sapiens inhibitor of kappa light polypeptide gene enhancer in B-cells, kinase beta (IKBKB), transcript variant 5, non-coding RNA. | 2517 |
| ITGAM | exonic | NM_001145808 | Homo sapiens integrin, alpha M (complement component 3 receptor 3 subunit) (ITGAM), transcript variant 1, mRNA. | 2518 |
| ITGAM | exonic | NM_000632 | Homo sapiens integrin, alpha M (complement component 3 receptor 3 subunit) (ITGAM), transcript variant 2, mRNA. | 2519 |
| KCNN3 | exonic | NM_170782 | Homo sapiens potassium intermediate/small conductance calcium-activated channel, subfamily N, member 3 (KCNN3), transcript | 2520 |

| RefSeq Gene Symbol | CNV Gene Region | RefSeq Accession Number | RefSeq Gene Description/Definition | SEQ ID |
|---|---|---|---|---|
| | | | variant 2, mRNA. | |
| KCNN3 | exonic | NM_002249 | Homo sapiens potassium intermediate/small conductance calcium-activated channel, subfamily N, member 3 (KCNN3), transcript variant 1, mRNA. | 2521 |
| KCNN3 | exonic | NM_001204087 | Homo sapiens potassium intermediate/small conductance calcium-activated channel, subfamily N, member 3 (KCNN3), transcript variant 3, mRNA. | 2522 |
| KYNU | exonic | NM_003937 | Homo sapiens kynureninase (KYNU), transcript variant 1, mRNA. | 2523 |
| KYNU | exonic | NM_001199241 | Homo sapiens kynureninase (KYNU), transcript variant 3, mRNA. | 2524 |
| KYNU | exonic | NM_001032998 | Homo sapiens kynureninase (KYNU), transcript variant 2, mRNA. | 2525 |
| KCNMA1 | exonic | NM_001161352 | Homo sapiens potassium large conductance calcium-activated channel, subfamily M, alpha member 1 (KCNMA1), transcript variant 3, mRNA. | 2526 |
| KCNMA1 | exonic | NM_001161353 | Homo sapiens potassium large conductance calcium-activated channel, subfamily M, alpha member 1 (KCNMA1), transcript variant 4, mRNA. | 2527 |
| KCNMA1 | exonic | NM_002247 | Homo sapiens potassium large conductance calcium-activated channel, subfamily M, alpha member 1 (KCNMA1), transcript variant 2, mRNA. | 2528 |
| KCNMA1 | exonic | NM_001014797 | Homo sapiens potassium large conductance calcium-activated channel, subfamily M, alpha member 1 (KCNMA1), transcript variant 1, mRNA. | 2529 |
| KCNMA1 | exonic | NM_001271518 | Homo sapiens potassium large conductance calcium-activated channel, subfamily M, alpha member 1 (KCNMA1), transcript variant 5, mRNA. | 2530 |
| KCNMA1 | exonic | NM_001271519 | Homo sapiens potassium large conductance calcium-activated channel, subfamily M, alpha member 1 (KCNMA1), transcript variant 6, mRNA. | 2531 |
| DLG5 | exonic | NM_004747 | Homo sapiens discs, large homolog 5 (Drosophila) (DLG5), mRNA. | 2532 |
| POLR3A | exonic | NM_007055 | Homo sapiens polymerase (RNA) III (DNA directed) polypeptide A, 155kDa (POLR3A), mRNA. | 2533 |
| KCNMA1 | exonic | NM_001271520 | Homo sapiens potassium large conductance calcium-activated channel, subfamily M, alpha member 1 (KCNMA1), transcript variant 7, mRNA. | 2534 |
| KCNMA1 | exonic | NM_001271521 | Homo sapiens potassium large conductance calcium-activated channel, subfamily M, alpha member 1 (KCNMA1), transcript variant 8, mRNA. | 2535 |
| KCNMA1 | exonic | NM_001271522 | Homo sapiens potassium large conductance calcium-activated channel, subfamily M, alpha member 1 (KCNMA1), transcript variant 9, mRNA. | 2536 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| LOC100128292 | exonic | NR_024585 | Homo sapiens uncharacterized LOC100128292 (LOC100128292), non-coding RNA. | 2537 |
| RPS24 | exonic | NM_001142285 | Homo sapiens ribosomal protein S24 (RPS24), transcript variant d, mRNA. | 2538 |
| RPS24 | exonic | NM_001142284 | Homo sapiens ribosomal protein S24 (RPS24), transcript variant b, mRNA. | 2539 |
| RPS24 | exonic | NM_001142283 | Homo sapiens ribosomal protein S24 (RPS24), transcript variant e, mRNA. | 2540 |
| RPS24 | exonic | NM_033022 | Homo sapiens ribosomal protein S24 (RPS24), transcript variant a, mRNA. | 2541 |
| RPS24 | exonic | NM_001026 | Homo sapiens ribosomal protein S24 (RPS24), transcript variant c, mRNA. | 2542 |
| RPS24 | exonic | NM_001142282 | Homo sapiens ribosomal protein S24 (RPS24), transcript variant f, mRNA. | 2543 |
| GPR20 | exonic | NM_005293 | Homo sapiens G protein-coupled receptor 20 (GPR20), mRNA. | 2544 |
| LOC731779 | exonic | NR_024441 | Homo sapiens uncharacterized LOC731779 (LOC731779), non-coding RNA. | 2545 |
| PTP4A3 | exonic | NM_032611 | Homo sapiens protein tyrosine phosphatase type IVA, member 3 (PTP4A3), transcript variant 1, mRNA. | 2546 |
| PTP4A3 | exonic | NM_007079 | Homo sapiens protein tyrosine phosphatase type IVA, member 3 (PTP4A3), transcript variant 2, mRNA. | 2547 |
| LRP2 | exonic | NM_004525 | Homo sapiens low density lipoprotein receptor-related protein 2 (LRP2), mRNA. | 2548 |
| LRRK2 | exonic | NM_198578 | Homo sapiens leucine-rich repeat kinase 2 (LRRK2), mRNA. | 2549 |
| PCM1 | exonic | NM_006197 | Homo sapiens pericentriolar material 1 (PCM1), mRNA. | 2550 |
| MTUS1 | exonic | NM_001001925 | Homo sapiens microtubule associated tumor suppressor 1 (MTUS1), transcript variant 2, mRNA. | 2551 |
| MTUS1 | exonic | NM_001001924 | Homo sapiens microtubule associated tumor suppressor 1 (MTUS1), transcript variant 1, mRNA. | 2552 |
| FGL1 | exonic | NM_004467 | Homo sapiens fibrinogen-like 1 (FGL1), transcript variant 1, mRNA. | 2553 |
| FGL1 | exonic | NM_201553 | Homo sapiens fibrinogen-like 1 (FGL1), transcript variant 4, mRNA. | 2554 |
| FGL1 | exonic | NM_201552 | Homo sapiens fibrinogen-like 1 (FGL1), transcript variant 3, mRNA. | 2555 |
| FGL1 | exonic | NM_147203 | Homo sapiens fibrinogen-like 1 (FGL1), transcript variant 2, mRNA. | 2556 |
| MYO3B | intronic | NR_045683 | Homo sapiens myosin IIIB (MYO3B), transcript variant 4, non-coding RNA. | 2557 |
| MYO3 | introni | NM_001 | Homo sapiens myosin IIIB (MYO3B), transcript variant 1, mRNA. | 25 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| B | c | 083615 | | 58 |
| MYO3B | intronic | NR_045682 | Homo sapiens myosin IIIB (MYO3B), transcript variant 3, non-coding RNA. | 2559 |
| MYO3B | intronic | NM_138995 | Homo sapiens myosin IIIB (MYO3B), transcript variant 2, mRNA. | 2560 |
| MYO3B | intronic | NR_045684 | Homo sapiens myosin IIIB (MYO3B), transcript variant 5, non-coding RNA. | 2561 |
| PLOD3 | exonic | NM_001084 | Homo sapiens procollagen-lysine, 2-oxoglutarate 5-dioxygenase 3 (PLOD3), mRNA. | 2562 |
| MOGAT3 | exonic | NM_178176 | Homo sapiens monoacylglycerol O-acyltransferase 3 (MOGAT3), mRNA. | 2563 |
| ZNHIT1 | exonic | NM_006349 | Homo sapiens zinc finger, HIT-type containing 1 (ZNHIT1), mRNA. | 2564 |
| PPIL4 | exonic | NM_139126 | Homo sapiens peptidylprolyl isomerase (cyclophilin)-like 4 (PPIL4), mRNA. | 2565 |
| PTPRA | exonic | NM_080840 | Homo sapiens protein tyrosine phosphatase, receptor type, A (PTPRA), transcript variant 2, mRNA. | 2566 |
| PTPRA | exonic | NM_002836 | Homo sapiens protein tyrosine phosphatase, receptor type, A (PTPRA), transcript variant 1, mRNA. | 2567 |
| PTPRA | exonic | NM_080841 | Homo sapiens protein tyrosine phosphatase, receptor type, A (PTPRA), transcript variant 3, mRNA. | 2568 |
| PTPRC | exonic | NM_080921 | Homo sapiens protein tyrosine phosphatase, receptor type, C (PTPRC), transcript variant 2, mRNA. | 2569 |
| PTPRC | exonic | NM_002838 | Homo sapiens protein tyrosine phosphatase, receptor type, C (PTPRC), transcript variant 1, mRNA. | 2570 |
| FAM193A | exonic | NM_001256666 | Homo sapiens family with sequence similarity 193, member A (FAM193A), transcript variant 2, mRNA. | 2571 |
| FAM193A | exonic | NM_001256667 | Homo sapiens family with sequence similarity 193, member A (FAM193A), transcript variant 4, mRNA. | 2572 |
| FAM193A | exonic | NM_001256668 | Homo sapiens family with sequence similarity 193, member A (FAM193A), transcript variant 5, mRNA. | 2573 |
| FAM193A | exonic | NM_003704 | Homo sapiens family with sequence similarity 193, member A (FAM193A), transcript variant 1, mRNA. | 2574 |
| FAM193A | exonic | NR_046336 | Homo sapiens family with sequence similarity 193, member A (FAM193A), transcript variant 6, non-coding RNA. | 2575 |
| FAM193A | exonic | NR_046335 | Homo sapiens family with sequence similarity 193, member A (FAM193A), transcript variant 3, non-coding RNA. | 2576 |
| RNF4 | exonic | NM_002938 | Homo sapiens ring finger protein 4 (RNF4), transcript variant 2, mRNA. | 2577 |
| RNF4 | exonic | NM_001185009 | Homo sapiens ring finger protein 4 (RNF4), transcript variant 1, mRNA. | 2578 |
| RNF4 | exonic | NM_001185010 | Homo sapiens ring finger protein 4 (RNF4), transcript variant 3, mRNA. | 2579 |
| ROCK | exonic | NM_005 | Homo sapiens Rho-associated, coiled-coil containing protein kinase | 25 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| 1 | | 406 | 1 (ROCK1), mRNA. | 80 |
| RNF217 | exonic | NM_152553 | Homo sapiens ring finger protein 217 (RNF217), mRNA. | 2581 |
| SFRP1 | exonic | NM_003012 | Homo sapiens secreted frizzled-related protein 1 (SFRP1), mRNA. | 2582 |
| SRF | exonic | NM_003131 | Homo sapiens serum response factor (c-fos serum response element-binding transcription factor) (SRF), mRNA. | 2583 |
| ISLR2 | exonic | NM_020851 | Homo sapiens immunoglobulin superfamily containing leucine-rich repeat 2 (ISLR2), transcript variant 2, mRNA. | 2584 |
| LOC283731 | exonic | NR_027073 | Homo sapiens uncharacterized LOC283731 (LOC283731), non-coding RNA. | 2585 |
| ISLR2 | exonic | NM_001130138 | Homo sapiens immunoglobulin superfamily containing leucine-rich repeat 2 (ISLR2), transcript variant 4, mRNA. | 2586 |
| ISLR2 | exonic | NM_001130137 | Homo sapiens immunoglobulin superfamily containing leucine-rich repeat 2 (ISLR2), transcript variant 3, mRNA. | 2587 |
| ISLR2 | exonic | NM_001130136 | Homo sapiens immunoglobulin superfamily containing leucine-rich repeat 2 (ISLR2), transcript variant 1, mRNA. | 2588 |
| STRA6 | exonic | NM_001199041 | Homo sapiens stimulated by retinoic acid gene 6 homolog (mouse) (STRA6), transcript variant 7, mRNA. | 2589 |
| STRA6 | exonic | NM_001142619 | Homo sapiens stimulated by retinoic acid gene 6 homolog (mouse) (STRA6), transcript variant 4, mRNA. | 2590 |
| STRA6 | exonic | NM_001199040 | Homo sapiens stimulated by retinoic acid gene 6 homolog (mouse) (STRA6), transcript variant 6, mRNA. | 2591 |
| STRA6 | exonic | NM_001142618 | Homo sapiens stimulated by retinoic acid gene 6 homolog (mouse) (STRA6), transcript variant 3, mRNA. | 2592 |
| STRA6 | exonic | NM_001142617 | Homo sapiens stimulated by retinoic acid gene 6 homolog (mouse) (STRA6), transcript variant 1, mRNA. | 2593 |
| STRA6 | exonic | NM_022369 | Homo sapiens stimulated by retinoic acid gene 6 homolog (mouse) (STRA6), transcript variant 2, mRNA. | 2594 |
| ISLR | exonic | NM_201526 | Homo sapiens immunoglobulin superfamily containing leucine-rich repeat (ISLR), transcript variant 2, mRNA. | 2595 |
| ISLR | exonic | NM_005545 | Homo sapiens immunoglobulin superfamily containing leucine-rich repeat (ISLR), transcript variant 1, mRNA. | 2596 |
| STRA6 | exonic | NM_001142620 | Homo sapiens stimulated by retinoic acid gene 6 homolog (mouse) (STRA6), transcript variant 5, mRNA. | 2597 |
| STRA6 | exonic | NM_001199042 | Homo sapiens stimulated by retinoic acid gene 6 homolog (mouse) (STRA6), transcript variant 8, mRNA. | 2598 |
| SMYD3 | exonic | NM_022743 | Homo sapiens SET and MYND domain containing 3 (SMYD3), transcript variant 2, mRNA. | 2599 |
| SMYD3 | exonic | NM_001167740 | Homo sapiens SET and MYND domain containing 3 (SMYD3), transcript variant 1, mRNA. | 2600 |
| CNST | exonic | NM_001139459 | Homo sapiens consortin, connexin sorting protein (CNST), transcript variant 2, mRNA. | 2601 |
| CNST | exonic | NM_152 | Homo sapiens consortin, connexin sorting protein (CNST), | 26 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| | | 609 | transcript variant 1, mRNA. | 02 |
| TFB2M | exonic | NM_022366 | Homo sapiens transcription factor B2, mitochondrial (TFB2M), nuclear gene encoding mitochondrial protein, mRNA. | 2603 |
| LOC255654 | exonic | NR_040002 | Homo sapiens uncharacterized LOC255654 (LOC255654), non-coding RNA. | 2604 |
| TRPM4 | exonic | NM_001195227 | Homo sapiens transient receptor potential cation channel, subfamily M, member 4 (TRPM4), transcript variant 2, mRNA. | 2605 |
| TRPM4 | exonic | NM_017636 | Homo sapiens transient receptor potential cation channel, subfamily M, member 4 (TRPM4), transcript variant 1, mRNA. | 2606 |
| USP14 | exonic | NM_005151 | Homo sapiens ubiquitin specific peptidase 14 (tRNA-guanine transglycosylase) (USP14), transcript variant 1, mRNA. | 2607 |
| USP14 | exonic | NM_001037334 | Homo sapiens ubiquitin specific peptidase 14 (tRNA-guanine transglycosylase) (USP14), transcript variant 2, mRNA. | 2608 |
| BOLL | exonic | NM_033030 | Homo sapiens bol, boule-like (Drosophila) (BOLL), transcript variant 2, mRNA. | 2609 |
| BOLL | exonic | NM_197970 | Homo sapiens bol, boule-like (Drosophila) (BOLL), transcript variant 1, mRNA. | 2610 |
| TBK1 | exonic | NM_013254 | Homo sapiens TANK-binding kinase 1 (TBK1), mRNA. | 2611 |
| XPOT | exonic | NM_007235 | Homo sapiens exportin, tRNA (XPOT), mRNA. | 2612 |
| MIR548H4 | exonic | NR_031680 | Homo sapiens microRNA 548h-4 (MIR548H4), microRNA. | 2613 |
| AHI1 | exonic | NM_017651 | Homo sapiens Abelson helper integration site 1 (AHI1), transcript variant 2, mRNA. | 2614 |
| AHI1 | exonic | NM_001134831 | Homo sapiens Abelson helper integration site 1 (AHI1), transcript variant 1, mRNA. | 2615 |
| LINC00271 | exonic | NR_026805 | Homo sapiens long intergenic non-protein coding RNA 271 (LINC00271), non-coding RNA. | 2616 |
| AHI1 | exonic | NM_001134832 | Homo sapiens Abelson helper integration site 1 (AHI1), transcript variant 4, mRNA. | 2617 |
| AHI1 | exonic | NM_001134830 | Homo sapiens Abelson helper integration site 1 (AHI1), transcript variant 3, mRNA. | 2618 |
| ZFHX3 | exonic | NM_001164766 | Homo sapiens zinc finger homeobox 3 (ZFHX3), transcript variant B, mRNA. | 2619 |
| ZFHX3 | exonic | NM_006885 | Homo sapiens zinc finger homeobox 3 (ZFHX3), transcript variant A, mRNA. | 2620 |
| HTA | exonic | NR_027756 | Homo sapiens uncharacterized LOC283902 (HTA), non-coding RNA. | 2621 |
| LOC100506172 | exonic | NR_038234 | Homo sapiens uncharacterized LOC100506172 (LOC100506172), non-coding RNA. | 2622 |
| HDAC9 | exonic | NM_001204144 | Homo sapiens histone deacetylase 9 (HDAC9), transcript variant 6, mRNA. | 2623 |

Figure 11C (Continued)

| Figure 11C | | | | |
|---|---|---|---|---|
| RefSeq Gene Symbol | CNV Gene Region | RefSeq Accession Number | RefSeq Gene Description/Definition | SEQ ID |
| ERG | exonic | NM_001243432 | Homo sapiens v-ets erythroblastosis virus E26 oncogene homolog (avian) (ERG), transcript variant 7, mRNA. | 2624 |
| ERG | exonic | NM_001243428 | Homo sapiens v-ets erythroblastosis virus E26 oncogene homolog (avian) (ERG), transcript variant 5, mRNA. | 2625 |
| ERG | exonic | NM_004449 | Homo sapiens v-ets erythroblastosis virus E26 oncogene homolog (avian) (ERG), transcript variant 2, mRNA. | 2626 |
| ERG | exonic | NM_001136154 | Homo sapiens v-ets erythroblastosis virus E26 oncogene homolog (avian) (ERG), transcript variant 3, mRNA. | 2627 |
| ERG | exonic | NM_001243429 | Homo sapiens v-ets erythroblastosis virus E26 oncogene homolog (avian) (ERG), transcript variant 6, mRNA. | 2628 |
| DSCR4 | exonic | NM_005867 | Homo sapiens Down syndrome critical region gene 4 (DSCR4), mRNA. | 2629 |
| DSCR8 | exonic | NR_026842 | Homo sapiens Down syndrome critical region gene 8 (DSCR8), transcript variant 2, non-coding RNA. | 2630 |
| DSCR8 | exonic | NR_026841 | Homo sapiens Down syndrome critical region gene 8 (DSCR8), transcript variant 1, non-coding RNA. | 2631 |
| DSCR8 | exonic | NR_026839 | Homo sapiens Down syndrome critical region gene 8 (DSCR8), transcript variant 3, non-coding RNA. | 2632 |
| DSCR8 | exonic | NR_026840 | Homo sapiens Down syndrome critical region gene 8 (DSCR8), transcript variant 5, non-coding RNA. | 2633 |
| DSCR8 | exonic | NR_026838 | Homo sapiens Down syndrome critical region gene 8 (DSCR8), transcript variant 4, non-coding RNA. | 2634 |
| DSCR10 | exonic | NR_027695 | Homo sapiens Down syndrome critical region gene 10 (non-protein coding) (DSCR10), non-coding RNA. | 2635 |
| KCNJ15 | exonic | NM_002243 | Homo sapiens potassium inwardly-rectifying channel, subfamily J, member 15 (KCNJ15), transcript variant 2, mRNA. | 2636 |
| KCNJ15 | exonic | NM_170737 | Homo sapiens potassium inwardly-rectifying channel, subfamily J, member 15 (KCNJ15), transcript variant 3, mRNA. | 2637 |
| KCNJ15 | exonic | NM_170736 | Homo sapiens potassium inwardly-rectifying channel, subfamily J, member 15 (KCNJ15), transcript variant 1, mRNA. | 2638 |
| ERG | exonic | NM_182918 | Homo sapiens v-ets erythroblastosis virus E26 oncogene homolog (avian) (ERG), transcript variant 1, mRNA. | 2639 |
| ERG | exonic | NM_001136155 | Homo sapiens v-ets erythroblastosis virus E26 oncogene homolog (avian) (ERG), transcript variant 4, mRNA. | 2640 |

Figure 11C (Continued)

| Figure 11D | | | | |
|---|---|---|---|---|
| RefSeq Gene Symbol(s) | Exon overlap | RefSeq Accession Number | mRNA Description | SEQ ID |
| SLC16A1 | exonic | NM_001166496 | Homo sapiens solute carrier family 16 (monocarboxylate transporter), member 1 (SLC16A1), transcript variant 2, mRNA. | 918 |
| SLC16A1 | exonic | NM_003051 | Homo sapiens solute carrier family 16 (monocarboxylate transporter), member 1 (SLC16A1), transcript variant 1, mRNA. | 919 |
| DAP3 | exonic | NM_001199849 | Homo sapiens death associated protein 3 (DAP3), transcript variant 3, mRNA. | 920 |
| DAP3 | exonic | NM_001199850 | Homo sapiens death associated protein 3 (DAP3), transcript variant 4, mRNA. | 921 |
| DAP3 | exonic | NM_001199851 | Homo sapiens death associated protein 3 (DAP3), transcript variant 5, mRNA. | 922 |
| DAP3 | exonic | NM_004632 | Homo sapiens death associated protein 3 (DAP3), transcript variant 2, mRNA. | 923 |
| DAP3 | exonic | NM_033657 | Homo sapiens death associated protein 3 (DAP3), transcript variant 1, mRNA. | 924 |
| MSTO2P | exonic | NR_024117 | Homo sapiens misato family member 2, pseudogene (MSTO2P), non-coding RNA. | 925 |
| GON4L | exonic | NM_001037533 | Homo sapiens gon-4-like (C. elegans) (GON4L), transcript variant 1, mRNA. | 926 |
| GON4L | intronic | NM_032292 | Homo sapiens gon-4-like (C. elegans) (GON4L), transcript variant 2, mRNA. | 927 |
| LINC00486 | exonic | NR_027099 | Homo sapiens long intergenic non-protein coding RNA 486 (LINC00486), transcript variant 2, non-coding RNA. | 928 |
| LOC100271832 | exonic | NR_027097 | Homo sapiens uncharacterized LOC100271832 (LOC100271832), non-coding RNA. | 929 |
| LTBP1 | exonic | NM_206943 | Homo sapiens latent transforming growth factor beta binding protein 1 (LTBP1), transcript variant 1, mRNA. | 930 |
| LTBP1 | intronic | NM_000627 | Homo sapiens latent transforming growth factor beta binding protein 1 (LTBP1), transcript variant 2, mRNA. | 931 |
| LTBP1 | intronic | NM_001166264 | Homo sapiens latent transforming growth factor beta binding protein 1 (LTBP1), transcript variant 4, mRNA. | 932 |
| LTBP1 | intronic | NM_001166265 | Homo sapiens latent transforming growth factor beta binding protein 1 (LTBP1), transcript variant 3, mRNA. | 933 |
| LTBP1 | intronic | NM_001166266 | Homo sapiens latent transforming growth factor beta binding protein 1 (LTBP1), transcript variant 5, mRNA. | 934 |
| LINC00486 | intronic | NR_027098 | Homo sapiens long intergenic non-protein coding RNA 486 (LINC00486), transcript variant 1, non-coding RNA. | 935 |
| LINC00486 | intronic | NR_027100 | Homo sapiens long intergenic non-protein coding RNA 486 (LINC00486), transcript variant 3, non-coding RNA. | 936 |
| SLC3A1 | exonic | NM_000341 | Homo sapiens solute carrier family 3 (amino acid transporter heavy chain), member 1 (SLC3A1), mRNA. | 937 |
| PREPL | exonic | NM_001042385 | Homo sapiens prolyl endopeptidase-like (PREPL), transcript variant 4, mRNA. | 938 |

Figure 11D

| Figure 11D | | | | |
|---|---|---|---|---|
| RefSeq Gene Symbol(s) | Exon overlap | RefSeq Accession Number | mRNA Description | SEQ ID |
| PREPL | exonic | NM_001042386 | Homo sapiens prolyl endopeptidase-like (PREPL), transcript variant 5, mRNA. | 939 |
| PREPL | exonic | NM_006036 | Homo sapiens prolyl endopeptidase-like (PREPL), transcript variant 1, mRNA. | 940 |
| PREPL | exonic | NM_001171606 | Homo sapiens prolyl endopeptidase-like (PREPL), transcript variant 3, mRNA. | 941 |
| PREPL | exonic | NM_001171613 | Homo sapiens prolyl endopeptidase-like (PREPL), transcript variant 6, mRNA. | 942 |
| PREPL | exonic | NM_001171603 | Homo sapiens prolyl endopeptidase-like (PREPL), transcript variant 2, mRNA. | 943 |
| PREPL | exonic | NM_001171617 | Homo sapiens prolyl endopeptidase-like (PREPL), transcript variant 7, mRNA. | 944 |
| SPAG16 | intronic | NM_024532 | Homo sapiens sperm associated antigen 16 (SPAG16), transcript variant 1, mRNA. | 945 |
| SPAG16 | intronic | NR_047659 | Homo sapiens sperm associated antigen 16 (SPAG16), transcript variant 3, non-coding RNA. | 946 |
| SPAG16 | intronic | NR_047660 | Homo sapiens sperm associated antigen 16 (SPAG16), transcript variant 4, non-coding RNA. | 947 |
| SPAG16 | intronic | NM_001025436 | Homo sapiens sperm associated antigen 16 (SPAG16), transcript variant 2, mRNA. | 948 |
| ATG7 | intronic | NM_001136031 | Homo sapiens autophagy related 7 (ATG7), transcript variant 2, mRNA. | 949 |
| ATG7 | intronic | NM_001144912 | Homo sapiens autophagy related 7 (ATG7), transcript variant 3, mRNA. | 950 |
| ATG7 | intronic | NM_006395 | Homo sapiens autophagy related 7 (ATG7), transcript variant 1, mRNA. | 951 |
| SLC26A6 | exonic | NM_001040454 | Homo sapiens solute carrier family 26 (anion exchanger), member 6 (SLC26A6), transcript variant 4, mRNA. | 952 |
| SLC26A6 | exonic | NM_022911 | Homo sapiens solute carrier family 26 (anion exchanger), member 6 (SLC26A6), transcript variant 1, mRNA. | 953 |
| SLC26A6 | exonic | NM_134263 | Homo sapiens solute carrier family 26 (anion exchanger), member 6 (SLC26A6), transcript variant 2, mRNA. | 954 |
| SLC26A6 | exonic | NM_134426 | Homo sapiens solute carrier family 26 (anion exchanger), member 6 (SLC26A6), transcript variant 3, mRNA. | 955 |
| CELSR3 | exonic | NM_001407 | Homo sapiens cadherin, EGF LAG seven-pass G-type receptor 3 (CELSR3), mRNA. | 956 |
| MIR4793 | exonic | NR_039956 | Homo sapiens microRNA 4793 (MIR4793), microRNA. | 957 |
| PPM1L | intronic | NM_139245 | Homo sapiens protein phosphatase, Mg2+/Mn2+ dependent, 1L (PPM1L), mRNA. | 958 |
| TNIK | exonic | NM_001161560 | Homo sapiens TRAF2 and NCK interacting kinase (TNIK), transcript variant 2, mRNA. | 959 |
| TNIK | exonic | NM_001161561 | Homo sapiens TRAF2 and NCK interacting kinase (TNIK), transcript variant 3, mRNA. | 960 |
| TNIK | exonic | NM_00116 | Homo sapiens TRAF2 and NCK interacting kinase (TNIK), | 96 |

Figure 11D (Continued)

| Figure 11D | | | | |
|---|---|---|---|---|
| RefSeq Gene Symbol(s) | Exon overlap | RefSeq Accession Number | mRNA Description | SEQ ID |
| | c | 1562 | transcript variant 4, mRNA. | 1 |
| TNIK | exonic | NM_001161563 | Homo sapiens TRAF2 and NCK interacting kinase (TNIK), transcript variant 5, mRNA. | 962 |
| TNIK | exonic | NM_001161564 | Homo sapiens TRAF2 and NCK interacting kinase (TNIK), transcript variant 6, mRNA. | 963 |
| TNIK | exonic | NM_001161565 | Homo sapiens TRAF2 and NCK interacting kinase (TNIK), transcript variant 7, mRNA. | 964 |
| TNIK | exonic | NM_001161566 | Homo sapiens TRAF2 and NCK interacting kinase (TNIK), transcript variant 8, mRNA. | 965 |
| TNIK | exonic | NM_015028 | Homo sapiens TRAF2 and NCK interacting kinase (TNIK), transcript variant 1, mRNA. | 966 |
| TNIK | exonic | NR_027767 | Homo sapiens TRAF2 and NCK interacting kinase (TNIK), transcript variant 9, non-coding RNA. | 967 |
| PLD1 | exonic | NM_001130081 | Homo sapiens phospholipase D1, phosphatidylcholine-specific (PLD1), transcript variant 2, mRNA. | 968 |
| PLD1 | exonic | NM_002662 | Homo sapiens phospholipase D1, phosphatidylcholine-specific (PLD1), transcript variant 1, mRNA. | 969 |
| RBM47 | intronic | NM_001098634 | Homo sapiens RNA binding motif protein 47 (RBM47), transcript variant 1, mRNA. | 970 |
| RBM47 | intronic | NM_019027 | Homo sapiens RNA binding motif protein 47 (RBM47), transcript variant 2, mRNA. | 971 |
| NPFFR2 | exonic | NM_004885 | Homo sapiens neuropeptide FF receptor 2 (NPFFR2), transcript variant 1, mRNA. | 972 |
| NPFFR2 | exonic | NM_001144756 | Homo sapiens neuropeptide FF receptor 2 (NPFFR2), transcript variant 3, mRNA. | 973 |
| NPFFR2 | exonic | NM_053036 | Homo sapiens neuropeptide FF receptor 2 (NPFFR2), transcript variant 2, mRNA. | 974 |
| CCSER1 | intronic | NM_001145065 | Homo sapiens coiled-coil serine-rich protein 1 (CCSER1), transcript variant 1, mRNA. | 975 |
| CCSER1 | intronic | NM_207491 | Homo sapiens coiled-coil serine-rich protein 1 (CCSER1), transcript variant 2, mRNA. | 976 |
| CDH12 | intronic | NM_004061 | Homo sapiens cadherin 12, type 2 (N-cadherin 2) (CDH12), mRNA. | 977 |
| GSTA2 | exonic | NM_000846 | Homo sapiens glutathione S-transferase alpha 2 (GSTA2), mRNA. | 978 |
| PARK2 | intronic | NM_004562 | Homo sapiens parkinson protein 2, E3 ubiquitin protein ligase (parkin) (PARK2), transcript variant 1, mRNA. | 979 |
| PARK2 | intronic | NM_013987 | Homo sapiens parkinson protein 2, E3 ubiquitin protein ligase (parkin) (PARK2), transcript variant 2, mRNA. | 980 |
| PARK2 | intronic | NM_013988 | Homo sapiens parkinson protein 2, E3 ubiquitin protein ligase (parkin) (PARK2), transcript variant 3, mRNA. | 981 |
| SDK1 | intronic | NM_152744 | Homo sapiens sidekick cell adhesion molecule 1 (SDK1), transcript variant 1, mRNA. | 982 |
| SDK1 | intronic | NM_001079653 | Homo sapiens sidekick cell adhesion molecule 1 (SDK1), transcript variant 2, mRNA. | 983 |

Figure 11D (Continued)

| Figure 11D | | | | |
|---|---|---|---|---|
| RefSeq Gene Symbol(s) | Exon overlap | RefSeq Accession Number | mRNA Description | SEQ ID |
| MSR1 | exonic | NM_138715 | Homo sapiens macrophage scavenger receptor 1 (MSR1), transcript variant SR-AI, mRNA. | 984 |
| MSR1 | exonic | NM_138716 | Homo sapiens macrophage scavenger receptor 1 (MSR1), transcript variant SR-AIII, mRNA. | 985 |
| MSR1 | exonic | NM_002445 | Homo sapiens macrophage scavenger receptor 1 (MSR1), transcript variant SR-AII, mRNA. | 986 |
| FAM49B | intronic | NR_046360 | Homo sapiens family with sequence similarity 49, member B (FAM49B), transcript variant 4, non-coding RNA. | 987 |
| FAM49B | intronic | NR_046361 | Homo sapiens family with sequence similarity 49, member B (FAM49B), transcript variant 5, non-coding RNA. | 988 |
| FAM49B | intronic | NM_001256763 | Homo sapiens family with sequence similarity 49, member B (FAM49B), transcript variant 1, mRNA. | 989 |
| FAM49B | intronic | NM_016623 | Homo sapiens family with sequence similarity 49, member B (FAM49B), transcript variant 2, mRNA. | 990 |
| FAM49B | intronic | NR_046359 | Homo sapiens family with sequence similarity 49, member B (FAM49B), transcript variant 3, non-coding RNA. | 991 |
| AK8 | intronic | NM_152572 | Homo sapiens adenylate kinase 8 (AK8), mRNA. | 992 |
| CTNNA3 | intronic | NM_001127384 | Homo sapiens catenin (cadherin-associated protein), alpha 3 (CTNNA3), transcript variant 2, mRNA. | 993 |
| CTNNA3 | intronic | NM_013266 | Homo sapiens catenin (cadherin-associated protein), alpha 3 (CTNNA3), transcript variant 1, mRNA. | 994 |
| FAM160B1 | exonic | NM_001135051 | Homo sapiens family with sequence similarity 160, member B1 (FAM160B1), transcript variant 2, mRNA. | 995 |
| TRUB1 | exonic | NM_139169 | Homo sapiens TruB pseudouridine (psi) synthase family member 1 (TRUB1), mRNA. | 996 |
| ATRNL1 | exonic | NM_001276282 | Homo sapiens attractin-like 1 (ATRNL1), transcript variant 2, mRNA. | 997 |
| ATRNL1 | exonic | NR_074088 | Homo sapiens attractin-like 1 (ATRNL1), transcript variant 3, non-coding RNA. | 998 |
| ATRNL1 | exonic | NM_207303 | Homo sapiens attractin-like 1 (ATRNL1), transcript variant 1, mRNA. | 999 |
| FAM160B1 | intronic | NM_020940 | Homo sapiens family with sequence similarity 160, member B1 (FAM160B1), transcript variant 1, mRNA. | 1000 |
| ST3GAL4 | intronic | NM_001254757 | Homo sapiens ST3 beta-galactoside alpha-2,3-sialyltransferase 4 (ST3GAL4), transcript variant 2, mRNA. | 1001 |
| ST3GAL4 | intronic | NM_006278 | Homo sapiens ST3 beta-galactoside alpha-2,3-sialyltransferase 4 (ST3GAL4), transcript variant 1, mRNA. | 1002 |
| ST3GAL4 | intronic | NM_001254758 | Homo sapiens ST3 beta-galactoside alpha-2,3-sialyltransferase 4 (ST3GAL4), transcript variant 3, mRNA. | 1003 |
| ST3GAL4 | intronic | NM_001254759 | Homo sapiens ST3 beta-galactoside alpha-2,3-sialyltransferase 4 (ST3GAL4), transcript variant 4, mRNA. | 1004 |
| APLP2 | exonic | NM_001142276 | Homo sapiens amyloid beta (A4) precursor-like protein 2 (APLP2), transcript variant 2, mRNA. | 1005 |
| APLP2 | exonic | NM_00114 | Homo sapiens amyloid beta (A4) precursor-like protein 2 | 10 |

Figure 11D (Continued)

| Figure 11D | | | | |
|---|---|---|---|---|
| RefSeq Gene Symbol(s) | Exon overlap | RefSeq Accession Number | mRNA Description | SEQ ID |
| | c | 2277 | (APLP2), transcript variant 3, mRNA. | 06 |
| APLP2 | exonic | NM_001142278 | Homo sapiens amyloid beta (A4) precursor-like protein 2 (APLP2), transcript variant 4, mRNA. | 1007 |
| APLP2 | exonic | NM_001642 | Homo sapiens amyloid beta (A4) precursor-like protein 2 (APLP2), transcript variant 1, mRNA. | 1008 |
| APLP2 | exonic | NR_024515 | Homo sapiens amyloid beta (A4) precursor-like protein 2 (APLP2), transcript variant 5, non-coding RNA. | 1009 |
| APLP2 | exonic | NR_024516 | Homo sapiens amyloid beta (A4) precursor-like protein 2 (APLP2), transcript variant 6, non-coding RNA. | 1010 |
| APLP2 | exonic | NM_001243299 | Homo sapiens amyloid beta (A4) precursor-like protein 2 (APLP2), transcript variant 7, mRNA. | 1011 |
| ST14 | exonic | NM_021978 | Homo sapiens suppression of tumorigenicity 14 (colon carcinoma) (ST14), mRNA. | 1012 |
| NR1H4 | intronic | NM_001206977 | Homo sapiens nuclear receptor subfamily 1, group H, member 4 (NR1H4), transcript variant 6, mRNA. | 1013 |
| NR1H4 | intronic | NM_001206978 | Homo sapiens nuclear receptor subfamily 1, group H, member 4 (NR1H4), transcript variant 5, mRNA. | 1014 |
| NR1H4 | intronic | NM_001206979 | Homo sapiens nuclear receptor subfamily 1, group H, member 4 (NR1H4), transcript variant 1, mRNA. | 1015 |
| NR1H4 | intronic | NM_005123 | Homo sapiens nuclear receptor subfamily 1, group H, member 4 (NR1H4), transcript variant 2, mRNA. | 1016 |
| NR1H4 | intronic | NM_001206992 | Homo sapiens nuclear receptor subfamily 1, group H, member 4 (NR1H4), transcript variant 4, mRNA. | 1017 |
| NR1H4 | intronic | NM_001206993 | Homo sapiens nuclear receptor subfamily 1, group H, member 4 (NR1H4), transcript variant 3, mRNA. | 1018 |
| DLEU2 | exonic | NR_002612 | Homo sapiens deleted in lymphocytic leukemia 2 (non-protein coding) (DLEU2), non-coding RNA. | 1019 |
| TRIM13 | exonic | NM_001007278 | Homo sapiens tripartite motif containing 13 (TRIM13), transcript variant 4, mRNA. | 1020 |
| TRIM13 | exonic | NM_005798 | Homo sapiens tripartite motif containing 13 (TRIM13), transcript variant 1, mRNA. | 1021 |
| TRIM13 | exonic | NM_052811 | Homo sapiens tripartite motif containing 13 (TRIM13), transcript variant 2, mRNA. | 1022 |
| TRIM13 | exonic | NM_213590 | Homo sapiens tripartite motif containing 13 (TRIM13), transcript variant 3, mRNA. | 1023 |
| KCNRG | exonic | NM_173605 | Homo sapiens potassium channel regulator (KCNRG), transcript variant 1, mRNA. | 1024 |
| KCNRG | exonic | NM_199464 | Homo sapiens potassium channel regulator (KCNRG), transcript variant 2, mRNA. | 1025 |
| MIR16-1 | exonic | NR_029486 | Homo sapiens microRNA 16-1 (MIR16-1), microRNA. | 1026 |
| MIR15A | exonic | NR_029485 | Homo sapiens microRNA 15a (MIR15A), microRNA. | 1027 |
| DLEU1 | exonic | NR_002605 | Homo sapiens deleted in lymphocytic leukemia 1 (non-protein coding) (DLEU1), non-coding RNA. | 1028 |

Figure 11D (Continued)

| Figure 11D | | | | |
|---|---|---|---|---|
| RefSeq Gene Symbol(s) | Exon overlap | RefSeq Accession Number | mRNA Description | SEQ ID |
| ST13P4 | exonic | NR_002183 | Homo sapiens suppression of tumorigenicity 13 (colon carcinoma) (Hsp70 interacting protein) pseudogene 4 (ST13P4), non-coding RNA. | 1029 |
| WDR72 | intronic | NM_182758 | Homo sapiens WD repeat domain 72 (WDR72), transcript variant 1, mRNA. | 1030 |
| WDR72 | intronic | NR_102334 | Homo sapiens WD repeat domain 72 (WDR72), transcript variant 3, non-coding RNA. | 1031 |
| WDR72 | intronic | NR_102336 | Homo sapiens WD repeat domain 72 (WDR72), transcript variant 5, non-coding RNA. | 1032 |
| WDR72 | intronic | NM_001277176 | Homo sapiens WD repeat domain 72 (WDR72), transcript variant 2, mRNA. | 1033 |
| WDR72 | intronic | NR_102335 | Homo sapiens WD repeat domain 72 (WDR72), transcript variant 4, non-coding RNA. | 1034 |
| CGNL1 | exonic | NM_001252335 | Homo sapiens cingulin-like 1 (CGNL1), transcript variant 1, mRNA. | 1035 |
| CGNL1 | exonic | NM_032866 | Homo sapiens cingulin-like 1 (CGNL1), transcript variant 2, mRNA. | 1036 |
| TOP3B | exonic | NM_003935 | Homo sapiens topoisomerase (DNA) III beta (TOP3B), transcript variant 1, mRNA. | 1037 |
| SYN3 | intronic | NM_001135774 | Homo sapiens synapsin III (SYN3), transcript variant IIIg, mRNA. | 1038 |
| SYN3 | intronic | NM_003490 | Homo sapiens synapsin III (SYN3), transcript variant IIIa, mRNA. | 1039 |
| SYN3 | intronic | NM_133633 | Homo sapiens synapsin III (SYN3), transcript variant IIIc, mRNA. | 1040 |
| ENOX2 | exonic | NM_006375 | Homo sapiens ecto-NOX disulfide-thiol exchanger 2 (ENOX2), transcript variant 1, mRNA. | 1041 |
| ENOX2 | exonic | NM_182314 | Homo sapiens ecto-NOX disulfide-thiol exchanger 2 (ENOX2), transcript variant 2, mRNA. | 1042 |

| Gene | Known drug target | Prescription therapies | OTC therapies | PubMed PMID No |
|---|---|---|---|---|
| ACE2 | yes | | | |
| ACY3 | | ACY3 (alternate name aminoacylase 3) inhibitors are neuroprotective in a rat model | | 22819785 |
| ADRA1A | yes | Agonists (e.g., cirazoline and midodrine) | Butcher's broom (Ruscus aculeatus) | 11152059,11482743,19487244,21338248,21791575 |
| ALDH2 | yes | | | |
| ANGPT1 | yes | | | |
| ANKRD11 | | TP53 modulators | Curcumin; luteolin and epigallocatechin-3-gallate (antioxidant in white and green tea); thiamine | 17900536,18840648,18952146,19601800,20586718,20826787,23035972,23075044,23149933,23447676,23462281,23714208,23813102 |
| ARSB | yes | ARSB activators; Enzyme replacement (e.g., galsulfase, tradename Naglazyme) | Alcohol, which some studies indicate is neuroprotective, in some patients may be deleterious as it is an ARSB inhibitor | 22971959,23520469,24311516,24590499,24788751 |
| BCKDHB | | Phenylbutyrate clinical trials for Maple Syrup Urine Disease and Parkinson's disease | Low/no protein diets; protein supplements such as MSUD Express (manufactured by Vitaflo) that are free from branched chain amino acids leucine, isoleucine and valine | 16151896,16539653,20301495,21098507,21902286 |
| BCL2L1 | yes | BCL2L1 activators and cell-based therapies; rasagiline response | Curcumin, L-carnitine, Salvianolic acid B | 17084538,17884684,19810877,20106970,21218454,21307646,22127243,22537773,22884477,23813102 |

| Gene | Known drug target | Prescription therapies | OTC therapies | PubMed PMID No |
|---|---|---|---|---|
| CA5B | | CA5B activators or modulators of its activity (e.g., SIRT3) | Momordica charantia (bitter melon); nicotinamide riboside | 17174092,21390294,21639917,21699374,22595756,22682224,23392354,23589845,23888142,24046746,24071780,24686337,24797412 |
| CACNA1B | yes | | | |
| CACNA1C | yes | | | |
| CACNA2D1 | yes | | | |
| CALCRL_intergenic | yes | Glucocorticoid/glucocorticoid receptor modulation; L-DOPA response; neuronal nicotinic receptor modulators; neuropeptides | | 8735876,11804624,12871824,18241048,22434110,23340218,24040816,24064060,24096124;24210137 |
| CBR3 | | isatin action | | 11722560,17447419 |
| CENPE | yes | | | |
| CERK | | PPAR agonists | | 17167170,24513118 |
| CFH | yes | | | |
| COMMD1 | | Modulators of copper levels | | 22473957,24288134,24672633,24691167 |
| COMMD10 | | Modulators of copper levels | | 22473957,24288134,24672633,24691167 |
| COX4I2 | | COX4I2 inhibitors | | 20734249 |
| CSAD | | | Taurine | 22903433,24639894 |
| CYP2R1 | | | Vitamin D | 9251086,17230473,21403017,22855339,23813102,24019477,24068787,24160295 |
| EPHA3 | yes | | | |
| F7 | yes | | | |
| FXN | | FXN knockdown | | 21779322 |
| GADL1 | | Lithium response | Taurine | 22480690,23038267,24369049 |
| GALNS | yes | Enzyme replacement with elosulfase alfa (tradename Vimizim) | | 23274460,23844448 |

Figure 13 (Continued)

| Figure 13 |||||
|---|---|---|---|---|
| Gene | Known drug target | Prescription therapies | OTC therapies | PubMed PMID No |
| GFRA3 | yes | Modulators of the GDNF pathway; clozapine response | acetyl-L-carnitine; harpagoside (active ingredient in harpagophytum) | 17218019,18709675,20116071,21193524;21590285,22192054,23813102,23884957 |
| GLRA3 |  | Glycine receptor agonists (e.g., taurine) |  | 6276509,8220914,12834252,18667154,19915682,20438799,22773138,22903433,23973295,24281261 |
| GNS_intergenic |  | Gene therapy and other approaches in development |  |  |
| GPR39 | yes | GPR39 modulators |  | 22192464,22441041,22545109,22879599,23089648,23719795,24333148 |
| GRIA3 |  | AMPA receptor modulators |  | 12730350,21966506,24557498 |
| GRIN2A | yes |  |  |  |
| GRM1 | yes | GRM (mGluR) modulators |  | 20632969,22791805,23010935,23415092 |
| GRM5 | yes | GRM (mGluR) modulators |  | 20632969,23010935,23415092 |
| GSTP1 | yes |  |  |  |
| HLCS |  |  | Biotin | 3736876,3762868,9183268,15456772,16359899,18845537,23622402 |
| HTR7 |  | HTR7 agonists |  | 19458153,20399562,21424680,21538661,23164613,24042216 |
| IKBKB | yes |  |  |  |
| KCNMA1 | yes |  |  |  |
| KCNN2 |  | KCNN2 modulators |  | 15180477,20074365,22554781,22794265,23002008,23430260,24405447 |
| KCNN3 |  | KCNN3 modulators |  | 15180477,20074365,22554781,22794265,23002008,23430260,24405447 |
| KLRC1 | yes |  |  |  |
| LRP1 | yes |  |  |  |

Figure 13 (Continued)

| Figure 13 |||||
|---|---|---|---|---|
| Gene | Known drug target | Prescription therapies | OTC therapies | PubMed PMID No |
| LYG1 |  | Compounds that impact protein folding (e.g., acridine analogues, single-domain antibody approaches); chitosin and derivatives (e.g., chitooligosaccharides); inhibitors specific for g-type lysozymes to faciliate drug development | Carnosine, curcumin | 9118001,18755243,19272331,19416848,19844776,20714426,20734102,22758638,23075044,23094108,23813102,24349167 |
| LYG2 |  | Compounds that impact protein folding (e.g., acridine analogues, single-domain antibody approaches); chitosin and derivatives (e.g., chitooligosaccharides); inhibitors specific for g-type lysozymes to faciliate drug development | Carnosine, curcumin | 9118001,18755243,19272331,19416848,19844776,20714426,20734102,22758638,23075044,23094108,23813102,24349167 |
| MAS1 | yes |  |  |  |
| NDUFAF2 |  | Activators of Complex I activity (e.g., AICAR); protein replacement (e.g., replacement of defective Complex I assembly factors); mTor modulators (e.g., rapamycin); | Aspirin; supplements (sometimes compounded together to create a 'mitochondrial cocktail') containing antioxidants, vitamins, and other compounds such as B vitamins | 16366737,19891905,21757032,21958946,22046392,22115768,22174907,23341947,23813102,2342672,23447126,23447126,23574157,23670274,24041694,24231806,24269733,24700433,24792485,24810045,25503498 |

Figure 13 (Continued)

| \multicolumn{5}{|c|}{Figure 13} |
| Gene | Known drug target | Prescription therapies | OTC therapies | PubMed PMID No |
|---|---|---|---|---|
| | | metformin may be a useful in some PD patients but it is also known to inhibit Complex I; coenzyme Q10 analogs (e.g., idebenone and EPI-743) | (B1, B2, B3, B5, B6, B9), vitamin C, vitamin E, vitamin K, acetyl L-carnitine, alpha-Lipoic acid, arginine, biotin, coenzyme Q10 (e.g., in the form of ubiquinol), creatine, glycerophosphochoLine, glycine, nicotine adenine dinucleotide (NADH), omega-3 fatty acids (e.g., DHA), phosphatidylserine; high fat (ketogenic) diet | |
| NDUFC2 - KCTD14 | | Activators of Complex I activity (e.g., AICAR); protein replacement (e.g., replacement of defective Complex I assembly factors); mTor modulators (e.g., rapamycin); metformin may be a useful in some PD patients but it is also known to inhibit Complex I; coenzyme Q10 analogs (e.g., idebenone and EPI-743) | Aspirin; supplements (sometimes compounded together to create a 'mitochondrial cocktail') containing antioxidants, vitamins, and other compounds such as B vitamins (B1, B2, B3, B5, B6, B9), vitamin C, vitamin E, vitamin K, acetyl L-carnitine, alpha-Lipoic acid, arginine, biotin, coenzyme Q10 (e.g., in the form of ubiquinol), creatine, glycerophosphoch | 16366737,19891905,21757032,2195 8946,22046392,22115768,22174907 ,23341947,23813102,2342672,2344 7126,23447126,23574157,23670274 ,24041694,24231806,24269733,247 00433,24792485,24810045,2550349 8 |

Figure 13 (Continued)

| Figure 13 |||||
|---|---|---|---|---|
| Gene | Known drug target | Prescription therapies | OTC therapies | PubMed PMID No |
| | | | oline, glycine, nicotine adenine dinucleotide (NADH), omega-3 fatty acids (e.g., DHA), phosphatidylserine; high fat (ketogenic) diet | |
| NDUFS4 | | Activators of Complex I activity (e.g., AICAR); protein replacement (e.g., replacement of defective Complex I assembly factors); mTor modulators (e.g., rapamycin); metformin may be a useful in some PD patients but it is also known to inhibit Complex I; coenzyme Q10 analogs (e.g., idebenone and EPI-743) | Aspirin; supplements (sometimes compounded together to create a 'mitochondrial cocktail') containing antioxidants, vitamins, and other compounds such as B vitamins (B1, B2, B3, B5, B6, B9), vitamin C, vitamin E, vitamin K, acetyl L-carnitine, alpha-Lipoic acid, arginine, biotin, coenzyme Q10 (e.g., in the form of ubiquinol), creatine, glycerophosphoch oline, glycine, nicotine adenine dinucleotide (NADH), omega-3 fatty acids (e.g., DHA), phosphatidylserine; high fat (ketogenic) diet | 16366737,19891905,21757032,2195 8946,22046392,22115768,22174907 ,23341947,23813102,2342672,2344 7126,23447126,23574157,23670274 ,24041694,24231806,24269733,247 00433,24792485,24810045,2550349 8 |

Figure 13 (Continued)

| Figure 13 |||||
|---|---|---|---|---|
| Gene | Known drug target | Prescription therapies | OTC therapies | PubMed PMID No |
| NFKB1 | yes | | | |
| NLRP3 | | | Korean red ginseng extract; zinc | 20127816,23254930 |
| NQO1 | | NQO1 modulators (e.g., bromocriptine, ladostigil, lithium, and vinyl sulfone compounds such as KMS04014); NQO1 targeting strategies | Coenzyme Q10, sulforaphane | 18234165,18455424,18751929,19236154,20166144,24666648,24467268,25297649,25702135,26074776 |
| NRG1 | yes | | | |
| NUBPL | | Activators of Complex I activity (e.g., AICAR); protein replacement (e.g., replacement of defective Complex I assembly factors); mTor modulators (e.g., rapamycin); metformin may be a useful in some PD patients but it is also known to inhibit Complex I; coenzyme Q10 analogs (e.g., idebenone and EPI-743) | Aspirin; supplements (sometimes compounded together to create a 'mitochondrial cocktail') containing antioxidants, vitamins, and other compounds such as B vitamins (B1, B2, B3, B5, B6, B9), vitamin C, vitamin E, vitamin K, acetyl L-carnitine, alpha-Lipoic acid, arginine, biotin, coenzyme Q10 (e.g., in the form of ubiquinol), creatine, glycerophosphocholine, glycine, nicotine adenine dinucleotide (NADH), omega-3 fatty acids (e.g., DHA), | 16366737,19891905,21757032,21958946,22046392,22115768,22174907,23341947,23813102,2342672,23447126,23447126,23574157,23670274,24041694,24231806,24269733,24700433,24792485,24810045,25503498 |

| Gene | Known drug target | Prescription therapies | OTC therapies | PubMed PMID No |
|---|---|---|---|---|
| | | | phosphatidylserine; high fat (ketogenic) diet | |
| PARK2 | yes | | | |
| PDE3B | | PDE3B modulators | | 19747167,21693152,21963837,22001403,23471014 |
| PIK3C3 | yes | | | |
| PRAME | yes | | | |
| PRCP | yes | | | |
| PRKAA1 | | AMPK modulators (e.g., metformin, an AMPK activator) | Herbs (e.g., radix polygalae); polyphenols (e.g., resveratrol); supplements (e.g., AMP, guanidinopropionic acid); aspirin; calorie restriction | 21406233,21778691,22498320,23055502,23159314,23200460,23341947,23447126,23515333,23800577,23813102,23835445,24047115,24059307,24269733,24606805,24067927,24232095,24248062,24269733,24582596,24824502 |
| PRKAG2 | | AMPK modulators (e.g., metformin, an AMPK activator) | Herbs (e.g., radix polygalae); polyphenols (e.g., resveratrol); supplements (e.g., AMP, guanidinopropionic acid); aspirin; calorie restriction | 21406233,21778691,22498320,23055502,23159314,23200460,23341947,23447126,23515333,23800577,23813102,23835445,24047115,24059307,24269733,24606805,24067927,24232095,24248062,24269733,24582596,24824502 |
| PRKCB | yes | | | |
| PRTN3 | yes | | | |
| PSAP | | Gene therapy and other approaches demonstrated, such as the peptide derivative prosaptide | | 11292674,21257328,21472771,22652185,23321539,23690594,23697974,24070323,24371137 |

Figure 13 (Continued)

| Figure 13 | | | | |
|---|---|---|---|---|
| Gene | Known drug target | Prescription therapies | OTC therapies | PubMed PMID No |
| PTPRC | yes | | | |
| ROCK1 | yes | | | |
| RORA | yes | | | |
| RTN4 | yes | Modulators of RTN4 or its receptor, RTN4R, may benefit dopaminergic homeostasis | | 19077178,19112410,24157929,24201447 |
| RYR2 | yes | | | |
| S100A12 | | S100A12 inhibitors | Green tea extract | 10837826,18193636,23901023 |
| S100A7 | | S100A7 inhibitors | Vitamin D | 10837826,18193636,22402441,23478321,23813102 |
| S100A8 | | S100A8 inhibitors; IL17; olanzapine increases S100A8 expression and can induce parkinsonism | | 10837826,17047680,18193636 |
| S100A9 | yes | S100A9 inhibitors | aspirin | 10837826,18193636,24064546 |
| SLC13A5 | | SLC13A5 modulators; lithium action | | 9521279,12177002,12826022,16366737,16516867,21787310,23177988,23266187,23393310,23506872,23561848,24582596 |
| SMEK2 | | Modulators of the sonic hedgehog pathway; stem cell therapies | | 7619528,7584992,10607393,12391318,16408088,16574067,18330924,19088085,20439738,20640532,20844013,21423269,21495963,21799491,22056989,22277298,22559936,22567022,22644265,22841315,23201023,23587183,24209749,24240054,24703627 |
| SMPD4 | | SMPD4 inhibitors; neuroprotective compounds acting via a gp120 mechanism; catecholamine | fish oil, glutathione, phosphatidylserine, vitamin E | 8822791,10470675,10470676,10493721,10713073,11060751,11459075,11597471,11777929,14624946,14720208,15509740,15749390,16366737,16517606,20197086,20353779,20729148,21796379,24737460 |

| Gene | Known drug target | Prescription therapies | OTC therapies | PubMed PMID No |
|---|---|---|---|---|
| | | modulators | | |
| SRD5A2 | yes | SRD5A2 inhibitors | | 18354385,18465891,20386102,21361868,21734282,22534502 |
| STEAP1 | yes | | | |
| SUMF1 | | Gene therapy and other approaches in development | | 21224894,21326216,22826245 |
| SUPT3H | | HAT activators; HDAC inhibitors | | 18838386,21307242,23543406,23711791 |
| TAAR1 | yes | | | |
| TACR3 | yes | | | |
| TRPM7 | yes | | | |
| TXNIP | | siRNA knockdown is neuroprotective | | 22366181,24409188 |
| USP14 | yes | | | |
| XDH | yes | | Inosine supplementation to increase urate levels (NCT00833690), which is neuroprotective, may be an effective therapy in PD patients with XDH variants | 14348191,23894418,24366103 |

Figure 13 (Continued)

| Figure 14 | | | |
|---|---|---|---|
| Gene Symbol | Causal Variant | Protective Variant | PubMed ID numbers: Gene biology, including neuro- and PD-relevant findings |
| ABCC1 | 1 | | 15501592,15889270,16297187,19429473,22545122, 23789959,24012632,25218792,25446622 |
| ABCC6 | 1 | | 15501592,15889270,16297187,19429473,22545122, 23789959,24012632,25218792,25446622 |
| ACAD10 | 1 | | 16722804,19639238,20390405,21237683,21309949, 22508986,23504072,23830815,24314068,24491970, 24557940 |
| ACTR1B | 1 | | 9492049 |
| ADAM6 | 1 | | 19129510,21339297,22926424 |
| ADRA1A | 1 | | 18955589,19068224,19771592,21338248,22588352 |
| AGBL1 | 1 | | 19644510,24094747 |
| AGMO_intergenic | | 1 | 20643956 |
| AK8 | | 1 | 21746835,25484190,25597950 |
| ALDH7A1 | 1 | | 16491085,20207735,21338592,22201923,24374917, 24613284,25004007,25073604,25274592,25758715, 26224730,26260980 |
| ANKRD11 | 1 | | 7548976,17900536,18840648,18952146,18840648,1 9601800,20586718,20826787,20969953,21654729,2 1930938,22833673,23035972,23149933,23447676,2 3462281,23714208,23791745,23885231,24027110,2 4040810,24060684,24124630,24324808,24423178 |
| ANKS1B | 1 | | 15004329,15347684,16176358,18978800,18981141, 21232086,21900033,23232665,23519153,23799029, 26085624 |
| APLP2 | 1 | | 12372026,16707114,18535156,19194882,20732423, 21178287,23345401,22353605,23430252,24998676, 25098278 |
| ARHGAP15 | 1 | | 18541383,21454543,22098189,22697132,23109420, 23760270,24926785,25009260,25071441,25533347 |
| ARHGAP26_intergenic | 1 | | 20226058,20602808,25189622,25498830,26298328 |
| ARHGEF38 | 1 | | 21048939,24075941,25009260,25588580 |
| ARSB | 1 | | 22428001,22971959,23520469,24311516,24334127, 24407717,24590499,24788751 |
| ATG7 | | 1 | 18182054,20174468,20697744,22649237,23509287, 23661100,23894380,24586198,24646838,26159917, 26207393 |
| ATRNL1 | 1 | | 14531729,20670697,22336087,23583561,23786641, 23996627 |
| AUTS2 | 1 | | 15944382,17465029,17714183,18451726,20577972, 23290496,23576548,23681749,24008202,25519132 |

Figure 14

| Figure 14 | | | |
|---|---|---|---|
| Gene Symbol | Causal Variant | Protective Variant | PubMed ID numbers: Gene biology, including neuro- and PD-relevant findings |
| BASP1 | | 1 | 11071705,20109554,21769916,22595364,23376695, 23376695,23579388,23821606,24350992,25010655, 26101831 |
| BAZ2B | 1 | | 10662543,2430432,25719566,25799074 |
| BCKDHB | 1 | | 11509994,15509654,15626823,16151896,16539653, 16875466,17459145,19345133,20301495,21098507, 21372141,21902286,22723850,24235816,26239723 |
| BLVRA | 1 | | 11509994,15509654,15626823,16151896,16539653, 16875466,17459145,19345133,20301495,21098507, 21372141,21902286,22723850,24235816,26239723 |
| CADPS2 | 1 | | 14715936,15857609,20448178,22001167,23213205, 23472874 |
| CALCRL_intergenic | 1 | | 11317366,12871824,16052036,18241048,22434110, 24210137 |
| CARD8 | 1 | | 18841008,23702978,24250222,25788762 |
| CBR3 | 1 | | 11722560,11771743,16406002,16944949,17270157, 17447419,17963726,22001310,22425771,22486522, 23227193,24002177,24262633,24333330,24374061 |
| CCSER1 | | 1 | 23665203 |
| CDH12 | 1 | | 20723620,22765916,23292232,24254198 |
| CDH19 | 1 | | 15580626,19850111,24254198,25158904,25612302 |
| CELSR3 | 1 | | 15778712,18487195,18494256,23478408,24012835, 25108913,25113559 |
| CERK | 1 | | 11956206,17888878,18612076,22230689,22465662, 23142158,23579454,23863933,24513118,24853423, 25938271,25309325 |
| CGNL1 | | 1 | 17503739,18808450,21454477,22671598,24254220, 25533682,25847918,25891934 |
| CITED4_intergenic | | 1 | 9326279,20513629,17922512,20639870,20713603,21254152,22730407,24275605,24441527,24870241,25030911,25092570,25326513,26096744,26211726 |
| CLSTN1 | 1 | | 8951871,11161476,12498782,12972431,15850677,16407541,16957079,17197368,17332754,19345186,19368810,19864173,19864413,20197093,20374418,20628651,20925061,21307242,21385839,21469201,21699982,21901155,22130675,22133327,22434822,22764880,22766071,22905201,22925831,23538867,23658629,24026176,24073418,24081378,24290359,24376773,24469401,24576173,24595449,24613359,24966372,25009257,25152012,25232110,25322951,25389371,25406318,25463516,25481627,25574134,25604855 |

Figure 14 (Continued)

| Figure 14 | | | |
|---|---|---|---|
| Gene Symbol | Causal Variant | Protective Variant | PubMed ID numbers: Gene biology, including neuro- and PD-relevant findings |
| CNTN6_intergenic | 1 | | 8586965,12884264,15082708,16502212,17222959,18046458,18625701,19672956,20133774,20176085,21622556,21846565,21935948,22973882,25074942 |
| COMMD1 | 1 | | 22473957,24672633,24691167,24697840,24901380,25007851,25355947 |
| COMMD10 | 1 | | 15799966,17497243,18974300,22130675,24176624,24288134,24340079,24435851,24440710,24691167,24901380,25007851,25315681,25355947,25495902,25496901,25497688,25583185,25631711,25648629 |
| COPS8_intergenic | 1 | | 14647295,15916908,18424433,19859546,22388932,23459167,23618758,24450635 |
| CREM | 1 | | 1584756,18424767,19144833,19270718,20302395,20367754,22044735 |
| CTNNA3 | | 1 | 15075440,15302915,23750206,24890784,25050139 |
| CTPS1_intergenic | | 1 | 9326279,20513629,17922512,20639870,20713603,21254152,22730407,24275605,24441527,24870241,25030911,25092570,25326513,26096744,26211726 |
| CYP2R1 | 1 | | 9251086,17230473,21403017,22855339,24019477,24068787,24160295 |
| DAP3 | 1 | | 24026176,24882515,24882516,24937456 |
| DCC | 1 | | 9858358,15730872,16840550,19162339,22748019,22926168,24808016,24867253,26264903 |
| DGKB_intergenic | | 1 | 18985386,23618683,24708409,25446448 |
| DOCK4_intergenic | | 1 | 18615735,23536706,23720743 |
| DPP6 | 1 | | 17635667,20573902,21826085,22675523,24225951,24726706,25520315,26239200,26275019 |
| DSCAM | 1 | | 24267895,24478371,24831526,25451118,25754961 |
| EHD4 | 1 | | 20463227,21535338,21187387,21535338 |
| EML1 | 1 | | 9867489,16890222,17196341,19014691,20975667,23735805,24859200,24964156 |
| EML6 | 1 | | 9867489,16890222,17196341,19014691,20975667,23735805,24859200,24964156 |
| ENOX2 | 1 | | 19734126,19734127,23939472 |
| ENPP2 | 1 | | 15303102,15378605,21735130,22821873,23747354,25788872 |
| EXOC4 | 1 | | 8982167,9630218,14525976,18498660,18541705,19006485,19587293,23169490 |
| EYS | 1 | | 9425527,11818560,17011488,18297055,18976725,20933338,21519034,21687773,21826682,24265693,24891994,25412384 |

Figure 14 (Continued)

| Figure 14 | | | |
|---|---|---|---|
| Gene Symbol | Causal Variant | Protective Variant | PubMed ID numbers: Gene biology, including neuro- and PD-relevant findings |
| FADD_intergenic | | 1 | 11805265,12666099,19176810,21785459,25286119, 26282360 |
| FAM49B | 1 | | 20126412,21403007,22871113 |
| FGF20_intergenic | 1 | | 19332307,20427658,20471450,20489616,21738488, 22342445,22971544,23754977,24942208, |
| FGGY | 1 | | 17671248,19464757,19875103,19193627,19922138, 20001489,22215998,24250222,24348429 |
| FOXG1_intergenic | 1 | | 17067292 |
| FZD5 | 1 | | 18509025,22647713,23324743,23461676,24205342 |
| GABRA3_intergenic | 1 | | 7902982,9577836,12373537,16284244,16699817,20 538013,21030585,21219474,22507762,23897874 |
| GABRQ_intergenic | 1 | | 7902982,9577836,12373537,16284244,16699817,20 538013,21030585,21219474,22507762,23897874 |
| GADL1 | 1 | | 9497435,20352617,22480690,22936308,23038267,2 3834617,24369049 |
| GFRA3 | 1 | | 9883723,11106404,17368428,18709675,20395301,2 1193524,21200028,21590285,22192054,23220632,2 3603259,23884957,24473149 |
| GLRA3 | 1 | | 6276509,8220914,12834252,18667154,19915682,20 438799,22773138,22903433,23973295,24281261 |
| GMDS | 1 | | 22027835,23824909 |
| GNS_intergenic | 1 | | 12624138,16990043,18392742,19650410,20232353, 22102531 |
| GON4L | 1 | | 24026176,24882515,24882516,24937456 |
| GPR88_intergenic | 1 | | 11056049,23064379,23103990,23936473,24793972, 24952328,25134728,25155879,25690789,25754495, 26188,28426188600 |
| GSN | 1 | | 1850958,1660109,11259122,21798243,24946097 |
| GSTA2 | | 1 | 20061341,20888808, 24503016,24599642 |
| HTR7 | 1 | | 16870886,17543469,18855532,19243449,19458153, 21184583,23164613,21424680,21538661,22507762, 23217531,23995648,24042216,24259245 |
| IMMP2L_intergenic | | 1 | 21332923,21824519,24251118 |
| IQGAP2 | 1 | | 8702968,16452628,18541383,21376255,21428964,2 1460214,22493426,23018238,23169921,23783559 |
| IRX2 | | 1 | 11493563,14585979,14732407,15133517,19268445, 23954875 |
| IRX4 | | 1 | 11493563,14585979,14732407,15133517,19268445, 23954875 |
| ITSN2_intergenic | | 1 | 21241680,22449706,23447614,23811784,24945110 |

| Gene Symbol | Causal Variant | Protective Variant | PubMed ID numbers: Gene biology, including neuro- and PD-relevant findings |
|---|---|---|---|
| JADE1 | | | 12953267,16713569,16959795,18684714,18806787, 19320554,19751207,20097775,20302395,20577972, 21307242,21467032,24899725,25100726,25320964, 25500533 |
| JAKMIP2 | 1 | | 17572408,22250954,23580333 |
| KCNA7 | 1 | | 9488722,19056359,26298328 |
| KCNIP4 | 1 | | 15363885,19279261,22311982,22615428,22815518, 23055512,23066017,23576435,23692269,24225951 |
| KCNIP4_intergenic | | 1 | 15363885,19279261,22311982,22615428,22815518, 23055512,23066017,23576435,23692269,24225951 |
| KCNMA1 | 1 | | 7993625,16845385,18414909,20131966,23508624,23542916 |
| KCNN2 | 1 | | 15180477,20074365,22554781,22794265,23002008, 23430260,24405447 |
| KCNN2_intergenic | 1 | | 15180477,20074365,22554781,22794265,23002008, 23430260,24405447 |
| KCNQ5 | 1 | | 12890507,15963599,16093396,17314282,20534576, 21666672,21750731,23911573,23996276,25649132 |
| KCNS3_intergenic | 1 | | 22937123,24487976,25514637,25652918 |
| KIAA0125_intergenic | | | 19707560 |
| LCN15_intergenic | | 1 | 22043816,23799078 |
| LOR_intergenic | | 1 | 22942380,23292542,25281877,26097310 |
| LRRN1_intergenic | 1 | | 20664637,20678249,21315708,24731980 |
| LTBP1 | 1 | | 9460794,18174901,18196529,18420832,19731553,20155936,20211260,20713051,22306345,23016688,23244239,23454196,25369932 |
| LYG1 | 1 | | 8765292,12574869,16162499,16854430,19088715,19416848,19696882,20036826,20049595,20382744,20413917,21093056,21541339,22758638,23075044,23094108,23353684,23687968,23764522,24349167 |
| LYG2 | 1 | | 8765292,12574869,16162499,16854430,19088715,19416848,19696882,20036826,20049595,20382744,20413917,21093056,21541339,22758638,23075044,23094108,23353684,23687968,23764522,24349167 |
| MSR1_intergenic | 1 | | 11238031,12379907,17548170,19000712,23108486, 23295906,23799536,23800361,23823020,24035364, 24059307,24114771,24170693,24355073,24718034, 24718459,24927544,24941076,24990881,25284487, 25904803,25926623,26049087,26217337 |
| MSR1 | | 1 | 11238031,12379907,17548170,19000712,23108486, 23295906,23799536,23800361,23823020,24035364, 24059307,24114771,24170693,24355073,24718034, |

Figure 14 (Continued)

| Figure 14 | | | |
|---|---|---|---|
| Gene Symbol | Causal Variant | Protective Variant | PubMed ID numbers: Gene biology, including neuro- and PD-relevant findings |
| | | | 24718459,24927544,24941076,24990881,25284487, 25904803,25926623,26049087,26217337 |
| MYOC | 1 | | 11755850,16392033,16644363,17562996,18700928, 19225343,21284751,23764838,23897819,24839011, 25524706,26121352 |
| NAV3 | 1 | | 12062803,12079279,16166283,18509363,20202123 |
| NCOA1_intergenic | | 1 | 21241680,22449706,23447614,23811784,24945110 |
| NDUFA4L2 | 1 | | 21924235,22100406,22972949 |
| NDUFAF2 | 1 | | 19525295,20552642,20571988,21550379,21617257, 21924235,22972949,23428416,23562423,23702311, 24269733,24324434 |
| NDUFC2-KCTD14 | 1 | | 16828987,21924235,22972949 |
| NDUFS4 | 1 | | 10944442,11165261,11181577,11943471,14765537, 16082506,21924235,22090423,22326555,22766071, 22912761,22972949,23574157,24231806,23234723, 23426728,24321326 |
| NDUFV1 | 1 | | 19498008,21924235,22819785,22972949 |
| NPFFR2 | 1 | | 20381562,21111027,24800761,22847214,23911743, 24520383 |
| NR1H4 | | 1 | 12075985,16239214,19417220,19996111,21691099, 22565294,24891994,25388534,25870546 |
| NRXN1 | 1 | | 22155091,25693924,26216298,26279266 |
| NTF3 | 1 | | 25925835,26076409 |
| NTF4 | 1 | | 7908342,9368855,10785444,11429269,11734360,15 010333,17425559,23671637,25241069 |
| NTRK2_intergenic | | 1 | 19927149,24374887,25052836,25560396,26282118 |
| NUBPL | 1 | | 20818383,22036961,22072591,22826544,23553477, 23828044 |
| PARK2 | 1 | 1 | Known PD gene |
| PDE3B | 1 | | 20471454,22001403,23471014 |
| PDE4D | 1 | | 18060387,21833500,23129425,23587879,24453367 |
| PLCL1 | 1 | | 23358250,24363063,25477900 |
| PLD1 | 1 | | 9538008,16042758,23863162,24632948 |
| PLSCR5_intergenic | 1 | | 10930526,12605885,19428821,21789211 |
| PLXNA4_intergenic | | 1 | 24244438,24599038,25043464,25338972 |
| PPFIA1_intergenic | | 1 | 9624153,115750591,17956329,19013515,21157931, 21618221 |
| PPM1L | | 1 | 18165232,22796112,24327947,24327956 |

| Gene Symbol | Causal Variant | Protective Variant | PubMed ID numbers: Gene biology, including neuro- and PD-relevant findings |
|---|---|---|---|
| PREPL | | 1 | 16143824,21222627,23321636,23485813 |
| PRR9_intergenic | | 1 | 22942380,23292542,25281877,26097310 |
| PSAP | 1 | | 11292674,18055126,18513679,19368810,21953577, 22652185,23383386,23622393,23697974,24070323, 24478108,25600808 |
| PTGIS | 1 | | 23042236,23691265,24365321,25230250 |
| PTPRT | 1 | | 19816407,23212845,23242284,23914057,23962429 |
| RASSF3_intergenic | | | 23357313,24250220,24464935 |
| RASSF3 | 1 | | 23357313,24250220,24464935 |
| RBM47 | | 1 | 23649762,24038582 |
| RGL1 | 1 | | 10760592,12012002,15492800,17462594,25751262 |
| RGS13 | 1 | | 12419501,12603835,14505795,15090051,15093612, 16930410,18347610,20561938 |
| RGS7 | 1 | | 20043004,23857581 |
| RPIA_intergenic | | 1 | 7396409,7758956,10589548,14988808,20140223,20 499043,20504623,24300239,24323934,24937102,24 970317 |
| SCARB1 | 1 | | 11959156,12736081,16380385,21076037,22575598 |
| SCARB2 | 1 | | 17215280,21796727,22223122,23408458,23419877, 23825416,24389070,24485911 |
| SDK1 | 1 | | 10318960,15703275,16298078,17203291,17362997, 17449015,18216854,18378407,19539006,19998477, 20219992,21767974,22486217,24449909,24874851, 25049175,25479916,25999161 |
| SGCZ | 1 | | 14628853,14872019,19133653,22438980,22626542, 22738885 |
| SH3GL3 | 1 | | 9169142,9809064,15363893,16115810,16710756,17 161366,18602463,20064468,21316588,22099461,22 998859,22998870,23184946,23187129,24778241,24 841483,25071441,25302295,25501810,25520322 |
| SH3RF3 | 1 | | 20696164,26214276 |
| SLC16A1 | 1 | | 16519673,18698340,19118535,21297988,21340000, 21376239,21384429,22451434,22801498,22925948, 22941028,23506875,23789956,23963315,24454947, 25390740,25447940,25762662 |
| SLC28A3_intergenic | | 1 | 23130601,23819782 |
| SLC2A9 | 1 | | 18327257,18842065,20613716,20945982,23248282, 23422251,25422986,26167684 |
| SLC3A1 | | 1 | 7560263,9987991,10207169,11430870,25073474 |
| SLC45A1_intergenic | 1 | | 12417639,15763422,22321011,23937259,25164149, |

| Figure 14 | | | |
|---|---|---|---|
| Gene Symbol | Causal Variant | Protective Variant | PubMed ID numbers: Gene biology, including neuro- and PD-relevant findings |
| | | | 25254549 |
| SMEK2 | 1 | | 7619528,7584992,10607393,12391318,15913612,16408088,16574067,18330924,19088085,20439738,20640532,20844013,20876121,21423269,21495963,21799491,21979788,22056989,22277298,22559936,22567022,22644265,22841315,23201023,23587183,23618354,23671329,23680462,24209749,24240054,24703627,24711418 |
| SMPD4 | 1 | | 11459075,20096352,23840630,24316227,24448491,24486621 |
| SNTG1 | 1 | | 21358174,24323403 |
| SORCS1_intergenic | 1 | | 15009648,23055476,23673467,24128306,24152121,24262184 |
| SPAG16 | | 1 | 12167721,24387768,25086173,26130477 |
| ST3GAL4 | | 1 | 22735313,25066807,25998389 |
| SUMF1 | 1 | | 15146462,21224894,21326216,21382133,22826245,23321616,24524415 |
| SUPT3H | 1 | | 9726987,15496412,15932940,16494529,17967894,18206423,18250150,18838386,19542216,21307242,23133622,23543406,23711791,23934153,24160175,24686445,24788822 |
| SYN3 | 1 | | 15721173,18761383,20660258,21827867,22182688,22723079,23768104,24501346,24586301,24882721,25239370,25309331,25467131,25834052,25930988,25967550,26269422 |
| SYNDIG1_intergenic | | 1 | 20152115,21878521,22363774,22813734,23426437,23785483 |
| SYNJ2BP | 1 | | 10357812,11498538,22871113,24025447,24086625,25915564 |
| TMEM141_intergenic | | 1 | 24252905 |
| TNIK | 1 | | 20159449,21048137,23035106,23863162,25753355 |
| TOP3B | | 1 | 18367668,23912948,26174813 |
| TRAP1 | 1 | | 17579517,17638420,17700685,21366594,21878357,22319455,22610403,23328674,23525905,23564345,23747254,23842546,24382805,24522549,24737941,25265088,25265962,26022780 |
| TRHDE_intergenic | 1 | | 1563463,19735445,1975148,21085660,24199031 |
| TRIM13 | 1 | | 11447312,11786419,19968958,20098416,20510502,20890124,21186355,21741444,21979307,22178386,23300799,23707074,24021263 |
| TRPM3_intergenic | | 1 | 21955047,22475023,26123194,26238178,25733887 |
| UMAD1 | 1 | | 20448139,22989140,24211851,25008355,25484190 |

Figure 14 (Continued)

| Figure 14 | | | |
|---|---|---|---|
| Gene Symbol | Causal Variant | Protective Variant | PubMed ID numbers: Gene biology, including neuro- and PD-relevant findings |
| UNC13C | 1 | | 9895278,11150314,11797009,15218059,16412482,17582334,17997229,20554867,22966208,23658173 |
| VPS13B | 1 | | 12351643,12730828,15498460,16135085,17076657,17156376,17964175,18537618,19245369,20461111,20951187,21377529,21605373,21763483,21865173,22398979,23352163,23939344,24210793,24311531,24334764,24347771,25502226,25492866,25502226 |
| WDR72 | | 1 | 22126837,22522085,25008349 |
| YWHAQ_intergenic | | | 21799745,21920445,23886663,24002177,24351927,24922733,25862939,26314634 |
| ZSCAN5A_intergenic | 1 | | 19549071,21832049,21865395 |

Figure 14 (Continued)

METHODS AND COMPOSITIONS FOR INHIBITING AND TREATING NEUROLOGICAL CONDITIONS

The present application claims the benefit of the filing date of U.S. application Ser. No. 62/070,798, filed on Sep. 5, 2014, the disclosure of which is incorporated by reference herein.

Three copies of the sequence listing (Copy 1, Copy 2 and Copy 3) and a computer readable form (CRF copy) of the sequence listing, all in ASCII and all on CD-Rs, each containing a text file named "3885003WO1.txt", which is 656,769,024 bytes (measured in MS-WINDOWS) and created on Sep. 3, 2015 are incorporated herein by reference.

BACKGROUND

Genetic risk can be conferred by subtle differences in individual genomes within a population. Genes can differ between individuals due to genomic variability, the most frequent of which are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Recently, many copy number variations (CNVs) of DNA segments, including deletions, insertions, duplications and complex multi-site variants, ranging in length from kilobases to megabases in size, have been discovered (Redon et al., *Nature* 444:444 (2006) and Estivill, X. & Armengol, L. *PLoS Genetics* 3(10): e190 (2007)). To date, known CNVs account for over 15% of the assembled human genome (Estivill and Armengol, *PLoS Genetics* 3(10): e190 (2007)). However, a majority of these variants are extremely rare and cover a small percentage of a human genome of any particular individual.

Parkinson's Disease (also known as Parkinson disease, Parkinson's, idiopathic parkinsonism, primary parkinsonism, PD, or paralysis agitans) is a degenerative disorder of the central nervous system. Parkinson's disease (PD) can be characterized by a progressive degeneration of dopaminergic neurons in the midbrain. While PD is a complex disorder of unknown etiology, it is postulated that symptom manifestation occurs after the fraction of functional dopaminergic cells falls below a threshold of twenty percent.

Symptoms of PD can include tremor, muscular rigidity, bradykinesia, akinesia, and postural instability. A hallmark of idiopathic or sporadic Parkinson's disease can be the progressive loss of dopaminergic neurons and a depletion of dopamine, more specifically in the basal ganglia, and is thought to result from a combination of genetic predisposition (Vaughn et al., *Ann. Hum. Genet.*, 65:111 (2001), and environmental factors (Shapira, *Adv. Neurol.*, 86:155 (2001)). Thus, research efforts have focused on discovering means to prevent, protect and restore the dopaminergic cell network (Latchman et al., *Rev. Neurosci.*, 12:69 (2001)). As genetic polymorphisms conferring risk neurological diseases, including PD, are uncovered, genetic testing can play a role for clinical therapeutics.

There is a need to identify new treatments for neurological diseases, such as PD, and the identification of genetic risk factors that can assist in the stratification of patients for development of potential therapeutics.

SUMMARY OF THE INVENTION

As described herein, CNV analysis revealed the presence of copy number variation (CNV) in individuals with Parkinson's disease (PD), essential tremor (ET) and PD as essential tremor (ET). For instance, CNV subregions impacting 3 or more Parkinson's disease cases that were not found or occurred at a lower frequency in non-Parkinson's disease cases were identified. Also, CNV subregions impacting 1 or 2 Parkinson's disease cases that were not found in non-Parkinson's disease cases, and which subregions were associated with Parkinson's disease relevant biology (biology including apoptosis, autophagy, cell signaling (e.g., NOS, Ras or Wnt), dopaminergic function, lysosomal pathways, mitochondrial dysfunction, oxidative stress, neuroinflammation, neuroprotective factors, neurotransmitter receptors, ion channels, or ubiquitin/proteasome pathways), as well as CNV subregions occurring in intergenic regions near genes with Parkinson's disease relevant biology, were identified. As also described herein, a subset of individuals with Parkinson's disease and specific genetic variations, e.g., genetic variations in genes or regions associated with lysosomal storage or metabolism or mitochondrial dysfunction, may benefit from treatment with agents that alter lysosomal metabolism or alter mitochondrial dysfunction, e.g., complex I dysfunction. Thus, LYG1, LYG2, SUMF1, GNS/RASSF3, ARSB, GALNS, PSAP, and NUBPL genetic variations, e.g., LYG1, LYG2, SUMF1, GNS/RASSF3, ARSB, GALNS, PSAP, and NUBPL CNVs or others described herein, may be used to stratify PD patients and match certain patients with specific genetic variation(s) to certain treatments selected to modulate disease in patients with those variations. In one embodiment, a subset of individuals with Parkinson's disease and specific genetic variations in genes or regions near genes such as ACE2, ACY3, ALDH2, ANKRD11, ARSB, BCKDHB, BCL2L1, CA5B, CACNA1C, CALCRL_intergenic, CBR3, COMMD1, COMMD10, COX4I2, CSAD, CYP2R1, FXN, GALNS, GNS_intergenic, GFRA3, GLRA3, GPR39, GRIA3, GRM1, GSTP1, HLCS, HTR7, KCNN2, LYG1, LYG2, NDUFAF2, NDUFC2-KCTD14, NDUFS4, NLRP3, NQO1, NUBPL, PDE3B, PIK3C3, PRCP, PRKAA1, PRKAG2, PSAP, S100A12, S100A7, S100A7A, S100A7L2, S100A8, S100A9, SLC13A5, SMEK2, SMPD4, SRD5A2, STEAP1, STEAP2, SUMF1, SUPT3H, or TXNIP, may benefit from treatment with certain agents as described herein. In one embodiment, a subset of individuals with Parkinson's disease and specific genetic variations in genes or regions near genes such as CACNA1B, CACNA2D1, CENPE, CERK, CFH, EPHA3, F7, GADL1, GRIN2A, GRM5, IKBKB, KCNMA1, KCNN3, KLRC1, LRP1, MAS1, NFKB1, NRG1, PRAME, PRTN3, PTPRC, ROCK1, RORA, TAAR1, TACR3, or USP14, may benefit from treatment with certain agents as described herein. For example, a subset of individuals with Parkinson's disease and specific genetic variations in genes or regions near genes such as CACNA1B, CACNA2D1, CENPE, CERK, CFH, EPHA3, F7, GADL1, GRIN2A, GRM5, IKBKB, KCNMA1, KCNN3, KLRC1, LRP1, MAS1, NFKB1, NRG1, PRAME, PRTN3, PTPRC, ROCK1, RORA, TAAR1, TACR3, or USP14, may benefit from treatment with Butcher's broom (Ruscus aculeatus), curcumin, luteolin, epigallocatechin-3-gallate (antioxidant in white and green tea); thiamine, alcohol, low/no protein diets, protein supplements such as MSUD Express (manufactured by Vitaflo) that are free from branched chain amino acids leucine, isoleucine and valine, L-carnitine, salvianolic acid B, Momordica charantia (bitter melon), nicotinamide riboside, taurine, vitamin D, acetyl-L-carnitine, harpagoside, biotin, carnosine, aspirin, supplements containing antioxidants, vitamins, and other compounds such as B vitamins (B1, B2, B3, B5, B6, and/or B9), vitamin C, vitamin E, vitamin K, acetyl L-carnitine, alpha-lipoic acid, arginine, biotin, coenzyme Q10 (e.g., in the form of ubiquinol), creatine, glycerophosphocholine, glycine, nicotine adenine dinucleotide (NADH), omega-3 fatty acids (e.g., DHA), phosphatidylserine; high fat (ketogenic) diet, or inosine supplementation, or two or more combinations of those agents. In one embodiment, the patients to be treated are those with genetic variations in genes or regions near genes such as CERK, GADL1, GRM5, or KCNN3. In one embodiment, the patients to be treated are not those with genetic variations in CACNA1B, CACNA2D1, CENPE, CERK, CFH, EPHA3, F7, GADL1, GRIN2A, GRM5, IKBKB, KCNMA1, KCNN3, KLRC1, LRP1, MAS1, NFKB1, NRG1, PRAME, PRTN3, PTPRC, ROCK1, RORA, TAAR1, TACR3, or USP14. In one embodiment, the patients to be treated are not those with genetic variations in CERK, GADL1, GRM5, or KCNN3.

The invention provides a method of screening subjects for those with altered susceptibility to developing Parkinson's disease or ET, or those at risk of developing Parkinson's disease or ET. Another embodiment provides a method of screening subjects for those with altered susceptibility to developing one or more movement disorders that include but are not limited to PD, ET or Restless Legs Syndrome (RLS), or those at risk of developing one or more movement disorders that include but are not limited to PD, ET or RLS. The method comprises assaying at least one genetic sample of one or more subjects, nucleic acid sequence information from the one or more subjects, or providing that information, for at least one genetic variation in genes or regions associated with Parkinson's disease, e.g., gene variations associated with one or more regions, subregions or genes in FIG. 8A, 9A, 10A or 11A, or in FIG. 8D, 9D, 10D or 11D. The presence in the genetic sample of the at least one genetic variation is used to determine whether the one or more subjects have an altered susceptibility to Parkinson's disease or ET, or are at risk of Parkinson's disease or ET. In some embodiments, determining whether the one or more subjects are at risk of Parkinson's disease or have an altered susceptibility to Parkinson's disease includes a medical history analysis and other clinical factors, e.g., in addition to the nucleic acid sequence information. In some embodiments, at least one genetic sample is collected from blood, e.g., peripheral blood mononuclear cells (PBMC) or peripheral blood lymphocytes (PBL), saliva, urine, serum, tears, skin, tissue, or hair from at least one subject. In some embodiments, assaying the at least one genetic sample of one or more subjects includes purifying the at least one genetic sample. In some embodiments, assaying the at least one genetic sample of the one or more subjects includes amplifying at least one nucleotide or a specific region of one or more chromosomes in the at least one genetic sample. In some embodiments, assaying the at least one genetic sample of the one or more subjects includes assaying an unamplified sample for at least one nucleotide or a specific region of one or more chromosomes in the at least one genetic sample. In some embodiments, assaying the at least one genetic sample for at least one genetic variation includes a microarray analysis of the at least one sample. In some embodiments, the microarray analysis comprises a comparative genomic hybridization (CGH) array analysis.

Thus, to identify patients with genetic variations that may be amenable to particular therapies, at least one genetic sample of one or more subjects may be assayed to obtain nucleic acid sequence information or that information may be provided. Nucleic acid sequence information from one or more subjects having at least one genetic variation, e.g., variations impacting or encompassing NUBPL or other genes associated with or encoding gene products in mitochondrial complex I, II, III or IV, or lysosomal storage or metabolism, is used to determine whether the one or more subjects may benefit from a particular treatment. In one embodiment, the specific genetic variations are in regions, subregions or genes disclosed in FIG. 8A, 9A, 10A, or 11A. In one embodiment, the specific genetic variations are in regions, subregions or genes disclosed in FIG. 8B, 9B, 10B, or 11B. In one embodiment, the specific genetic variations are in regions, subregions or genes disclosed in FIG. 8C, 9C, 10C, or 11C. In one embodiment, the specific genetic variations are in regions, subregions or genes disclosed in FIG. 8D, 9D, 10D, or 11D. In some embodiments, the nucleic acid sequencing information is obtained for the whole genome or whole exome from the one or more subjects. In some embodiments, the nucleic acid sequencing information has already been obtained for the whole genome or whole exome from the one or more subjects and the nucleic acid information is obtained from in silico analysis. In other embodiments, the nucleic acid sequencing information is obtained for a selected portion of the whole genome or whole exome. In some embodiments, assaying at least one genetic sample comprises obtaining the nucleic acid sequence information. In some embodiments, obtaining the nucleic acid information is determined by one or more methods selected from the group comprising PCR, sequencing, Northern blots, or any combination thereof. In some embodiments, sequencing comprises one or more high-throughput sequencing methods, Sanger sequencing, or a combination thereof. In some embodiments, at least one genetic sample is collected from blood, e.g., peripheral blood mononuclear cells (PBMC) or peripheral blood lymphocytes (PBL), saliva, urine, serum, tears, skin, tissue, or hair from at least one subject. In some embodiments, assaying the at least one genetic sample of one or more subjects includes purifying the at least one genetic sample. In some embodiments, assaying the at least one genetic sample of the one or more subjects includes amplifying at least one nucleotide or a specific region of one or more chromosomes in the at least one genetic sample. In some embodiments, assaying the at least one genetic sample of the one or more subjects includes assaying an unamplified sample for at least one nucleotide or a specific region of one or more chromosomes in the at least one genetic sample. In some embodiments, assaying the at least one genetic sample for at least one genetic variation includes a microarray analysis of the at least one sample. In some embodiments, the microarray analysis comprises a comparative genomic hybridization (CGH) array analysis. In one embodiment, the method includes detecting a genetic variation, e.g., using a multiplex ligation-dependent probe amplification (MLPA), molecular beacon, aCGH, Invader assay, ligase chain reaction (LCR), or fluorescence in situ hybridization.

In one aspect, a method for screening for a therapeutic agent useful for preventing, inhibiting or treating at least one symptom of a neurological disease (ND) such as PD or ET is provided. The method includes identifying an agent that modulates the expression of one or more genes or regions associated with mitochondrial complex I, II, III or IV, or lysosomal storage or metabolism, modulates the expression of one or more genes encoding expression products that are part of mitochondrial complex I, II, III or IV, or lysosomal storage or metabolism, or modulates the function or activity of expression products of the one or more genes or regions. In some embodiments, the expression products include one or more RNA transcripts for gene products associated with modulation of mitochondrial complex I, II, III or IV, or lysosomal storage or metabolism. In some embodiments, the expression products include one or more proteins that modulate the function or activity of mitochondrial complex I, II, III or IV, or lysosomal storage or metabolism. In some embodiments, the agent(s) increase the expression of one or more RNA transcripts or proteins. In some embodiments, the agent(s) decrease the expression of one or more RNA transcripts or proteins. In some embodiments, an agent identified as modulating the function or activity of a mitochondrial complex is employed in a therapy based on the presence or absence of one or more genetic variations in at least one gene or regions associated with or encoding gene products of mitochondrial complex I, II, III or IV, or, or lysosomal storage or metabolism.

In some embodiments, the at least one genetic variation comprises one or more point mutations, polymorphisms, translocations, insertions, deletions, amplifications, inversions, microsatellites, interstitial deletions, copy number variations (CNVs), loss of heterozygosity, or any combination thereof. In some embodiments, the at least one genetic variation comprises one or more point mutations, single nucleotide polymorphisms (SNPs), single nucleotide variants (SNVs), polymorphisms, translocations, insertions, deletions, amplifications, inversions, microsatellites, interstitial deletions, copy number variations (CNVs), loss of heterozygosity, or any combination thereof. In some embodiments, the at least one genetic variation includes one or more CNVs in one or more genes associated with or encoding gene products in mitochondrial complex I, II, III or IV, or lysosomal storage or metabolism. In some embodiments, the genetic variation comprises one or more CNVs that disrupt one or more genes associated with mitochondrial complex I, II, III or IV. In some embodiments, the at least one genetic variation comprises one or more CNVs that modulate the expression or function of one or more RNA transcripts of genes with gene products, or that modulate the function or activity of gene products, associated with mitochondrial complex I, II, III or IV, or lysosomal storage or metabolism.

In one aspect, a method of treating a subject for PD or ET is provided. The method includes administering one or more agents effective to modulate the function or activity of one or more genes or regions associated with mitochondrial complex I, II, III or IV, or lysosomal storage or metabolism, or expression products therefrom, thereby treating PD or ET. In some embodiments, the expression products include one or more RNA transcripts of a gene product found in mitochondrial complex I, II, III or IV, or lysosomal storage or metabolism. In one embodiment, the subject has a specific genetic variation in regions, subregions or genes disclosed in FIG. 8A, 9A, 10A, or 11A. In one embodiment, the subject has a specific genetic variation in regions, subregions or genes disclosed in FIG. 8B, 9B, 10B, or 11B. In one embodiment, the subject has a specific genetic variation in regions, subregions or genes disclosed in FIG. 8C, 9C, 10C, or 11C. In one embodiment, the subject has a specific genetic variation in regions, subregions or genes disclosed in FIG. 8D, 9D, 10D, or 11D. In some embodiments, the expression products include one or more proteins expressed from a gene or regions associated with mitochondrial complex I, II, III or IV, or lysosomal storage or metabolism. In some embodiments, the agent may be an anti-oxidant, whey, a B vitamin, a carotene, a chloroacetic acid or a salt thereof, a dicarboxylic acid or a salt thereof, a vitamin K, a nucleoside, or a mineral, or a combination thereof, which may be optionally administered before, concurrently with, or subsequently to administration of an antibody, a dopamine agonist, a monoamine oxidase B inhibitor, a genetic sequence, a combination of genetic sequences, or any combination thereof.

In one aspect, the invention provides a kit, array or panel for screening for PD or ET in a subject. In one aspect, a kit, array or panel detects two or more, e.g., 5 to 40, 2 to 20, 5 to 10 or 5 to 15, of the genes, regions or subregions disclosed herein. In one aspect, the kit includes at least one component for assaying a genetic sample from the subject for the presence of at least one genetic variation in one or more genes associated with mitocondrial complex I, II, III or IV, e.g., mitochondrial complex I function or activity, or lysosomal storage or metabolism.

In one aspect, the patient to be treated has, or the kit, array or panel is useful for screening for, genetic variation(s) in complex I genes including, but not limited to, those encoding subunits for NADH dehydrogenase (ubiquinone). Those genetic variations may be in one or more of nuclear or mitochondrial endoded Complex I subunits and/or assembly factors: NDUFA1, NDUFA2, NDUFA3, NDUFA4, NDUFA4L, NDUFA4L2, NDUFA5, NDUFA6, NDUFA7, NDUFA8, NDUFA9, NDUFA10, NDUFA11, NDUFA12, NDUFA13, NDUFAB1, NDUFB1, NDUFB2, NDUFB3, NDUFB4, NDUFB5, NDUFB6, NDUFB7, NDUFB8, NDUFB9, NDUFB10, NDUFB11, NDUFC1, NDUFC2, NDUFS1, NDUFS2, NDUFS3, NDUFS4, NDUFS5, NDUFS6, NDUFS7, NDUFS8, NDUFV1, NDUFV2, NDUFV3, MT-ND1, MT-ND2, MT-ND3, MT-ND4, MT-ND4L, MT-ND5, MT-ND6, ACAD9, ECSIT, FOXRED1, NDUFAF1, NDUFAF2, NDUFAF3, NDUFAF4, NDUFAF5 (aka C20orf7), NDUFAF6 (aka C8orf38), NDUFAF7 (aka C2orf56), NUBPL, TIMMDC1 (aka C3orf1), and TMEM126B. One or more agents disclosed herein may also be employed to treat subjects with genetic variations in one or subunits or assembly factors of NADH Dehydrogenase (Ubiquinone).

In one aspect, the patient to be treated has, or the kit, array or panel is useful for screening for, genetic variation(s) in genes associated with occurrence of 3-Methylglutaconic aciduria, including, but not limited to, one or more genes encoding: ATP12, ATP5E, ATPAF2, AUH, BCKDHB, CLPB, DNAJC19, OPA3, POLG, RYR1, SERAC1, SUCLA2, TAZ and TMEM70.

In one aspect, a method for screening for a therapeutic agent useful for preventing, inhibiting or treating at least one symptom of a neurological disease (ND) such as PD or ET is provided. The method includes identifying an agent that modulates the expression of one or more genes or regions associated with lysosomal storage or metabolism, modulates the expression of one or more genes encoding expression products that are part of lysosomal storage or metabolism, or modulates the function or activity of expression products of the one or more genes or regions. In some embodiments, the expression products include one or more RNA transcripts for gene products associated with modulation of lysosomal storage or metabolism. In some embodiments, the expression products include one or more proteins that modulate the function or activity of lysosomal storage or metabolism. In some embodiments, the agent(s) increase the expression of one or more RNA transcripts or proteins. In some embodiments, the agent(s) decrease the expression of one or more RNA transcripts or proteins. In some embodiments, an agent identified as modulating the function or activity of a mitochondrial complex is employed in a therapy based on the presence or absence of one or more genetic variations in at least one gene or regions associated with or encoding gene products of lysosomal storage or metabolism.

In some embodiments, the at least one genetic variation comprises one or more point mutations, polymorphisms, translocations, insertions, deletions, amplifications, inversions, microsatellites, interstitial deletions, copy number variations (CNVs), loss of heterozygosity, or any combination thereof. In some embodiments, the at least one genetic variation comprises one or more point mutations, single nucleotide polymorphisms (SNPs), single nucleotide variants (SNVs), polymorphisms, translocations, insertions, deletions, amplifications, inversions, microsatellites, interstitial deletions, copy number variations (CNVs), loss of heterozygosity, or any combination thereof. In some embodiments, the at least one genetic variation includes one or more CNVs in one or more genes associated with or encoding gene products in lysosomal storage or metabolism. In some embodiments, the genetic variation comprises one or more CNVs that disrupt one or more genes associated with lysosomal storage or metabolism. In some embodiments, the at least one genetic variation comprises one or more CNVs that modulate the expression or function of one or more RNA transcripts of genes with gene products, or that modulate the function or activity of gene products, associated with lysosomal storage or metabolism.

In one aspect, a method of treating a subject for PD or ET is provided. The method includes administering one or more agents effective to modulate the function or activity of one or more genes or regions associated with lysosomal storage or metabolism, or expression products therefrom, thereby treating PD or ET. In some embodiments, the expression products include one or more RNA transcripts of a gene product found in lysosomal storage or metabolism. In some embodiments, the expression products include one or more proteins expressed from a gene or regions associated with lysosomal storage or metabolism. In some embodiments, the agent may be an anti-oxidant, whey, a B vitamin, a carotene, a chloroacetic acid or a salt thereof, a dicarboxylic acid or a salt thereof, a vitamin K, a nucleoside, or a mineral, or a combination thereof, which may be optionally administered before, concurrently with, or subsequently to administration of an antibody, a dopamine agonist, a monoamine oxidase B inhibitor, a genetic sequence, a combination of genetic sequences, or any combination thereof.

In one aspect, the patient to be treated has, or a kit, array or panel is useful for screening for, genetic variation(s) in lysosomal storage or metabolic genes including but not limited to those for LYG1, LYG2, SUMF1, GNS/RASSF3, ARSB, GALNS, or PSAP, and including other sulfatases, sulfatase modifying proteins or sulfatase substrates. In one aspect, the patient to be treated has, or a kit, array or panel is useful for screening for, genetic variation(s) in one or more of ARSB, CERK, GALNS, GNS, PSAP, SCARB1, SCARB2, SMPD4, or SUMF1, including any combination thereof, and optionally one or more of GBA, GLA, GUSB, HGSNAT, IDS, IDUA, NAGLU, or SGSH including any combination thereof. For example, substrates for SUMF1 include GALNS, ARSA, STS and ARSE, paralogs including SUMF2. Other sulfatase genes besides ARSB, GNS, and GALNS include ARSG, ARSI, IDS, SULF1, and SULF2. Other lysozyme genes, besides LYG1 and LYG2, include LYZ, LALBA, LYZL1, LYZL2, LYZL4, LYZL6, SPACA3, SPACA5, or SPACA5B, or other gene regions encoding enzymes that hydrolyze 1,4-beta linkages, e.g., between N-acetyl-D-glucosamine and N-acetylmuranic acid. In one aspect, the patient to be treated has, or a kit, array or panel is useful for screening for, genetic variation(s) in one or more potassium channel genes: KCNA7, KCND2, KCNE1, KCN1P4, KCNJ15, KCNMA1, KCNN2, KCNN3, KCNQ5, KCNRG, or KCNS3 including any combination thereof.

In one aspect, the invention provides a kit, array or panel for screening for PD in a subject. In one aspect, the kit includes at least one component for assaying a genetic sample from the subject for the presence of at least one genetic variation in one or more genes associated with mitocondrial complex I, II, III or IV, e.g., mitochondrial complex I function or activity, or lysomal storage or metabolism.

Agents useful to treat disorders associated with a genetic variation in any of the above genes or regions may include one or more of the following agents: an anti-oxidant, whey, a B vitamin, a carotene, a chloroacetic acid or a salt thereof, a dicarboxylic acid or a salt thereof, a vitamin K, a nucleoside, or a mineral, or a combination thereof. For example, a subject may be administered an effective amount of riboflavin (B2), e.g., 100 to about 400 mg/day, thiamine (B1), e.g., about 50 to about 100 mg/day, other B vitamins (e.g., nicotinamide (B3), e.g., about 50 to about 100 mg/day, B6, B12 and folic acid (B9), e.g., 1 to about 10 mg/day, biotin, e.g., 2.5 to 10 mg/day, CoQ10, for instance, about 5 to about 15 mg/kg/day, e.g., high dose CoQ10, carnitine, acetyle-L-carnitive (about 250 to about 1000 mg/day) or levo-carnitine (about 30 mg/kg/day to about 100 mg/kg/day), creatine monohydrate, lipoic acid, e.g., about 60 to about 200 mg/day up to three times per day, dichloroacetate, dimethylglycine, a whey based supplement, antioxidants like Vitamin C (ascorbic acid) or other citrates, e.g., about 100 to about 500 mg/day 1 to 3 times per day, vitamin K3, and Vitamin E (tocopherol), e.g., about 100 to about 400 IU/day 1 to 3 times per day, minerals, including but not limited to selenium, calcium, or magnesium, beta carotene, phosphorus, succinate, creatine, or uridine. In one embodiment, a subject is administered a combination of coenzyme Q10, creatine monohydrate, and lipoic acid.

Another embodiment of the invention provides a method of screening for variants that are protective against disease. That is, the aim is to identify variants that are absent or present at substantially lower frequency in affected individuals, compared to normal individuals that have a given variant at higher frequency. Such variants are likely 'protective', in that the presence of the variant in an individual appears to lessen the likelihood of a disease, rather than increase it. Such variants are often relatively common in normal populations. While causal significance for variants can be inferred even in cases where only 1-2 affected individuals in a cohort carry the variant (if the variant results in loss of function of a gene/region for which substantial biological evidence exists that is relevant to the disease under investigation), the reverse is not true for protective variants. The presence of a variant in 1-2 normal individuals but 0 affected individuals cannot be assumed to be protective, because the absence in the affected cohort may be the result of chance. However, for the protective variants described herein, the frequency difference between normal and affected individuals is significant enough to suggest a protective effect. A further difference exists between causal and protective variants. Causal variants within in a gene are often not identical (i.e., there can be many different mutations within the gene that can result in disease), since any that result in loss of function are likely to result in the same overall effect (loss of gene function, resulting in a phenotype). While there may be some instances wherein protective variants within a given gene are heterogeneous (i.e., multiple protective variants in different sites within or near the gene), the nature of the discovery methodology only makes it possible to identify protective variants on the basis of appreciable frequencies (e.g., 0.5-5%) in normal individuals. In the case of CNVs, those that are present at higher frequency tend to be identical in different individuals. This also has the added benefit of allowing for rapid analysis of protective variants, using an assay that screens for a gain or loss on the basis of an identical set of CNV breakpoints, in large sample numbers (cases and controls). It can be appreciated by those skilled in the art that subjects harboring a protective variant (e.g., one that results lower neuroinflammation or oxidative stress) may have a decreased susceptibility to developing PD or ET. Another embodiment provides a method of screening subjects for those with altered susceptibility to developing one or more movement disorders that include but are not limited to PD, ET or Restless Legs Syndrome (RLS), or those at risk of developing one or more movement disorders that include but are not limited to PD, ET or RLS. The method comprises assaying at least one genetic sample of one or more subjects, nucleic acid sequence information from the one or more subjects, or providing that information, for at least one genetic variation in genes or regions associated with lower risk of PD, e.g., gene variations associated with one or more regions, subregions or genes in FIG. 8A, 9A, 10A or 11A. The presence in the genetic sample of the at least one genetic variation is used to determine whether the one or more subjects have an altered susceptibility to PD or ET, or are at lower risk of PD or ET.

Genes harboring protective variants may be different from the one or more genes that are known to cause or contribute to a given disorders, but those skilled in the art appreciate that variants within the same gene can be causal for or protective from the same disorder, or for different disorders. For example, A precedent for both causal and protective variants in a neurodegenerative disease gene is the finding of a protective variant in the Alzheimer's gene APP (Jonsson et al. Nature. 2012 Aug. 2; 488(7409):96-9). Protective variants also provide an opportunity to develop therapies that may treat a greater percentage of individuals diagnosed with a given disorder, such as the SLC30A8 loss-of-function mutations that were found to be protective from developing Type 2 diabetes (Flannick et al. Nat Genet. 2014 April; 46(4):357-63).

BRIEF DESCRIPTION OF THE DRAWINGS

FIG. 8 shows exemplary regions with genetic variations that are associated with PD. For each variation, the following may be provided: chromosome, original CNV start, original CNV stop, original CNV size, CNV type, PD case ID, RefSeq gene symbol, and SEQ ID No. corresponding to that region. FIGS. 8A-D list all CNVs of interest, with the exception that, for each entry, the original CNV start and stop positions are noted, along with original CNV size, type (loss or gain), case ID and gene annotation (for the CNV-subregion NOT original CNV). FIG. 8A provides CNVs corresponding regions associated with SEQ ID NOs:1-197. FIGS. 8B-C provide CNVs corresponding to regions in SEQ ID NOs:1059-1340 and 1621-2002, respectively. FIG. 8D provides CNVs corresponding to regions in SEQ ID NOs: 806-916. The final column in FIG. 8A contains SEQ ID numbers for exemplary genes/CNV subregions, which also correspond to higher priority genes/CNV subregions. Thus, SEQ ID NO:1 has the highest priority, SEQ ID NO:2 has the next highest priority.

FIG. 9 shows exemplary subregions with genetic variations that are associated with PD. For each variation, the following may be provided: chromosome, CNV subregion start, CNV subregion stop, CNV subregion size, CNV type, PD case ID(s), RefSeq gene symbol, exon overlap, NVE cases, PD cases, FET, OR, and category. FIGS. 9A-D are similar to FIGS. 9A-D but there are a number of exceptions. Firstly, the CNV coordinates listed refer to the actual CNV-subregions found to be unique or significantly different between the disease and normal cohorts, as opposed to FIG. 9, which lists the original CNVs. Secondly, an extra column details whether genic CNV-subregions of interest overlap an exon or not. Third and fourth, 2 extra columns detail the number of normal cases and the number of disease cases that harbor the relevant CNV-subregion. Finally, 3 columns report Fisher's 2-tailed Exact Test (FET), odds ratio (OR) and the Category under which the CNV-subregion falls wrt significance. FIG. 9A provides CNV subregions corresponding to regions associated with SEQ ID NOs:1-197. FIG. 9B provides CNV subregions corresponding to SEQ ID NOs: 1059-1340. FIG. 9C provides CNV subregions corresponding to SEQ ID NOs:1621-2002, and FIG. 9D provides CNV subregions corresponding to SEQ ID NOs:806-916.

FIG. 10 is a summary of the characteristics of the regions associated with PD. FIG. 10A provides CNV subregions corresponding to regions associated with SEQ ID NOs:1-197. FIG. 10B provides CNV subregions corresponding to SEQ ID NOs:1059-1340. FIG. 10C provides CNV subregions corresponding to SEQ ID NOs:1621-2002, and FIG. 10D provides CNV subregions corresponding to SEQ ID NOs:806-916.

FIG. 11 is a summary of transcripts in the regions associated with PD and SEQ ID numbers therefor. FIG. 11A is a summary of transcripts associated with SEQ ID NOs:1-197, e.g., those having SEQ ID Nos. 198-805. FIG. 11B is a summary of transcripts associated with SEQ ID NOs: 1059-1349, e.g., SEQ ID Nos. 1341-1620. FIG. 11C is a summary of transcripts associated with SEQ ID NOs:1621-2002, e.g., SEQ ID NOs 2003-2640. FIG. 11D is a summary of transcripts associated with SEQ ID NOs:806-916, e.g., SEQ ID Nos:918-1042.

FIG. 13. Gene-specific therapeutic strategies.

FIG. 14. Genes and neuropathological or PD relevant biology.

DETAILED DESCRIPTION

Figure 1:
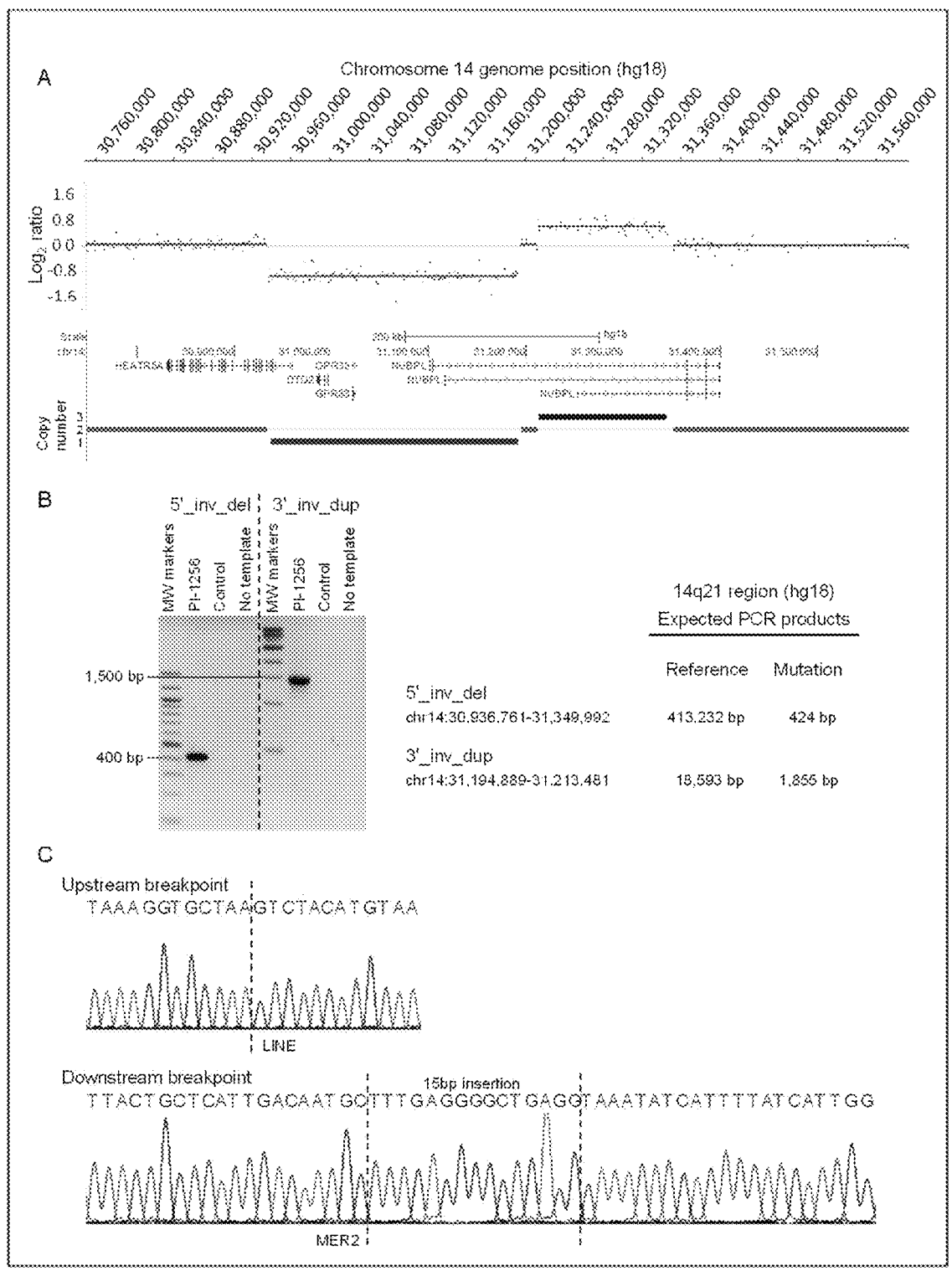
FIG. 1. A chromosomal rearrangement disrupts NUBPL in a sporadic case of Parkinson's disease (PD). (A) Genome-wide CNV analysis revealed a complex chromosomal rearrangement in a female patient diagnosed with sporadic PD that consists of a 254 Kb loss and 134 Kb gain. It was found in 1 of 467 PD cases and in 0 of 1,005 controls. (B) Gene annotation for the rearrangement mapped in the UCSC genome browser (hg18) showing HEATR5A is disrupted and there is a complete loss of DTD2 and GPR33. (C) The NUBPL chromosomal rearrangement is found in PD and CI deficiency patients. PCR confirmation that the rearrangement detected in the sporadic PD case is identical to the one previously found in a CI deficiency patient (Calvo et al., *Nat. Genet.*, 42:861 (2010)). (D) Sequence chromatograms of upstream and downstream PCR products that were generated using the PCR primers described in Tucker et al. (*Hum Mutat.*, 33:411 (2012)). Identical sequences were found at both breakpoints (upstream and downstream) in the PD patient (shown) as were found in the CI deficiency patient, including the LINE and MER2 repeat elements and a 15 bp insertion at the downstream breakpoint (sequence is the reverse complement of the Tucker et al. sequence). (E) Predicted alterations in splice events for NUBPL variants. NUBPL variants (OR ≥2.0 or that are pathogenic CI deficiency mutations) were analyzed for predicted splice site event alterations using HSF. Total events corresponds to the total number of event types/positions impacted by a predicted splice event alteration. For example, for novel variant c.694-18A>T four types of events (splice site, enhancer site, silencer site, const./alt. site) at six positions (40 and 46-50) equals 8 total events. Alterations in splice events were predicted for each NUBPL variant by using a 100 bp window of sequence with the variant in position 51 to enable a comparison of variants relative to a fixed position. Exon (white-filled boxes) and intron (hatched boxes) regions are mapped according to the wild type sequence. The c.815-27T>C variant was previously reported as a pathogenic variant. Color-coding identifies if a splice event was created, destroyed, or both by the variant relative to the wild-type nucleotide. Numbers inside the colored boxes indicate the total number of predictions for each type of event listed to the left.

Genetic risk can be conferred by subtle differences in individual genomes within a population. Genes can differ between individuals due to genomic variability, and the most frequent differences are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Many copy number variations (CNVs) of DNA segments, including deletions, insertions, duplications and complex multi-site variants, ranging in length from kilobases to megabases in size, have been discovered (Redon et al., Nature 444:444 (2006) and Estivill & Armengol PLoS Genetics, 3:1787 (2007)). Known CNVs account for over 15% of the assembled human genome (Estivill & Armengol, supra). However, a majority of these variants are extremely rare and cover a small percentage of a human genome of any particular individual.

Described herein are methods of identifying variations in nucleic acids and genes associated with neurological disorders, in particular, PD and their use stratifying patients for therapy. Also described herein are methods and compositions for treating, inhibiting and/or preventing PD using a therapeutic modality. The present disclosure further encompasses methods of assessing an individual for probability of response to a therapeutic agent for PD, methods for predicting the effectiveness of a therapeutic agent for PD, and computer-implemented functions. Kits, arrays or panels for screening a sample from a subject to detect or determine a risk of or susceptibility to PD, or if the subject would benefit from a particular therapy, are also encompassed by the disclosure.

Neurological Disorders

As described herein, NDs, within the scope of the current disclosure can comprise:
Acquired Epileptiform Aphasia, Acute Disseminated Encephalomyelitis, Adrenoleukodystrophy, Agenesis of the corpus callosum, Agnosia, Aicardi syndrome, Alexander disease, Alpers' disease, Alternating hemiplegia, Alzheimer's disease, Amyotrophic lateral sclerosis (see Motor Neuron Disease), Anencephaly, Angelman syndrome, Angiomatosis, Anoxia, Aphasia, Apraxia, Arachnoid cysts, Arachnoiditis, Arnold-Chiari malformation, Arteriovenous malformation, Asperger's syndrome, Ataxia Telangiectasia, Attention Deficit Hyperactivity Disorder, Autism, Auditory processing disorder, Autonomic Dysfunction, Back Pain, Batten disease, Behcet's disease, Bell's palsy, Benign Essential Blepharospasm, Benign Focal Amyotrophy, Benign Intracranial Hypertension, Bilateral frontoparietal polymicrogyria, Binswanger's disease, Blepharospasm, Bloch-Sulzberger syndrome, Brachial plexus injury, Brain abscess, Brain damage, Brain injury, Brain tumor, Brown-Sequard syndrome, Canavan disease, Carpal tunnel syndrome (CTS), Causalgia, Central pain syndrome, Central pontine myelinolysis, Centronuclear myopathy, Cephalic disorder, Cerebral aneurysm, Cerebral arteriosclerosis, Cerebral atrophy, Cerebral gigantism, Cerebral palsy, Charcot-Marie-Tooth disease, Chiari malformation, Chorea, Chronic inflammatory demyelinating polyneuropathy (CIDP), Chronic pain, Chronic regional pain syndrome, Coffin Lowry syndrome, Coma, including Persistent Vegetative State, Congenital facial diplegia, Corticobasal degeneration, Cranial arteritis, Craniosynostosis, Creutzfeldt-Jakob disease, Cumulative trauma disorders, Cushing's syndrome, Cytomegalic inclusion body disease (CIBD), Cytomegalovirus Infection, Dandy-Walker syndrome, Dawson disease, De Morsier's syndrome, Dejerine-Klumpke palsy, Dejerine-Sottas disease, Delayed sleep phase syndrome, Dementia, Dermatomyositis, Neurological Dyspraxia, Diabetic neuropathy, Diffuse sclerosis, Dysautonomia, Dyscalculia, Dysgraphia, Dyslexia, Dystonia, Early infantile epileptic encephalopathy, Empty sella syndrome, Encephalitis, Encephalocele, Encephalotrigeminal angiomatosis, Encopresis, Epilepsy, Erb's palsy, Erythromelalgia, Essential tremor (ET), Fabry's disease, Fahr's syndrome, Fainting, Familial spastic paralysis, Febrile seizures, Fisher syndrome, Friedreich's ataxia, FART Syndrome, Gaucher's disease, Gerstmann's syndrome, Giant cell arteritis, Giant cell inclusion disease, Globoid cell Leukodystrophy, Gray matter heterotopia, Guillain-Barre syndrome, HTLV-1 associated myelopathy, Hallervorden-Spatz disease, Head injury, Headache, Hemifacial Spasm, Hereditary Spastic Paraplegia, Heredopathia atactica polyneuritiformis, Herpes zoster oticus, Herpes zoster, Hirayama syndrome, Holoprosencephaly, Huntington's disease, Hydranencephaly, Hydrocephalus, Hypercortisolism, Hypoxia, Immune-Mediated encephalomyelitis, Inclusion body myositis, Incontinentia pigmenti, Infantile phytanic acid storage disease, Infantile Refsum disease, Infantile spasms, Inflammatory myopathy, Intracranial cyst, Intracranial hypertension, Joubert syndrome, Kearns-Sayre syndrome, Kennedy disease, Kinsbourne syndrome, Klippel Feil syndrome, Krabbe disease, Kugelberg-Welander disease, Kuru, Lafora disease, Lambert-Eaton myasthenic syndrome, Landau-Kleffner syndrome, Lateral medullary (Wallenberg) syndrome, Learning disabilities, Leigh's disease, Lennox-Gastaut syndrome, Lesch-Nyhan syndrome, Leukodystrophy, Lewy body dementia, Lissencephaly, Locked-In syndrome, Lou Gehrig's disease, Lumbar disc disease, Lyme disease—Neurological Sequelae, Machado-Joseph disease (Spinocerebellar ataxia type 3), Macrencephaly, Maple Syrup Urine Disease, Megalencephaly, Melkersson-Rosenthal syndrome, Menieres disease, Meningitis, Menkes disease, Metachromatic leukodystrophy, Microcephaly, Migraine, Miller Fisher syndrome, Mini-Strokes, Mitochondrial Myopathies, Mobius syndrome, Monomelic amyotrophy, Motor Neuron Disease, Motor skills disorder, Moyamoya disease, Mucopolysaccharidoses (including the subset referred to as Hurler Syndrome, Hurler-Scheie syndrome, Scheie syndrome, Hunter syndrome, Sanfilippo syndromes A-D, Morquio syndromes A and B, Maroteaus-Lamy syndrome, Sly syndrome, and Natowicz syndrome), Multi-Infarct Dementia, Multifocal motor neuropathy, Multiple sclerosis, Multiple system atrophy with postural hypotension, Muscular dystrophy, Myalgic encephalomyelitis, Myasthenia gravis, Myelinoclastic diffuse sclerosis, Myoclonic Encephalopathy of infants, Myoclonus, Myopathy, Myotubular myopathy, Myotonia congenita, Narcolepsy, Neurofibromatosis, Neuroleptic malignant syndrome, Neurological manifestations of AIDS, Neurological sequelae of lupus, Neuromyotonia, Neuronal ceroid lipofuscinosis, Neuronal migration disorders, Niemann-Pick disease, Non 24-hour sleep-wake syndrome, Nonverbal learning disorder, O'Sullivan-McLeod syndrome, Occipital Neuralgia, Occult Spinal Dysraphism Sequence, Ohtahara syndrome, Olivopontocerebellar atrophy, Opsoclonus myoclonus syndrome, Optic neuritis, Orthostatic Hypotension, Overuse syndrome, Palinopsia, Paresthesia, Parkinson's disease, Paramyotonia Congenita, Paraneoplastic diseases, Paroxysmal attacks, Parry-Romberg syndrome (also known as Rombergs Syndrome), Pelizaeus-Merzbacher disease, Periodic Paralyses, Peripheral neuropathy, Persistent Vegetative State, Pervasive NDs, Photic sneeze reflex, Phytanic Acid Storage disease, Pick's disease, Pinched Nerve, Pituitary Tumors, PMG, Polio, Polymicrogyria, Polymyositis, Porencephaly, Post-Polio syndrome, Postherpetic Neuralgia (PHN), Postinfectious Encephalomyelitis, Postural Hypotension, Prader-Willi syndrome, Primary Lateral Sclerosis, Prion diseases, Progressive Hemifacial Atrophy also known as Rombergs_Syndrome, Progressive multifocal leukoencephalopathy, Progressive Sclerosing Poliodystrophy, Progressive Supranuclear Palsy, Pseudotumor cerebri, Ramsay-Hunt syndrome (Type I and Type II), Rasmussen's encephalitis, Reflex sympathetic dystrophy syndrome, Refsum disease, Repetitive motion disorders, Repetitive stress injury, Restless legs syndrome, Retrovirus-associated myelopathy, Rett syndrome, Reye's syndrome, Rombergs_Syndrome, Rabies, Saint Vitus dance, Sandhoff disease, Schytsophrenia, Schilder's disease, Schizencephaly, Sensory Integration Dysfunction, Septo-optic dysplasia, Shaken baby syndrome, Shingles, Shy-Drager syndrome, Sjogren's syndrome, Sleep apnea, Sleeping sickness, Snatiation, Sotos syndrome, Spasticity, Spina bifida, Spinal cord injury, Spinal cord tumors, Spinal muscular atrophy, Spinal stenosis, Steele-Richardson-Olszewski syndrome, see Progressive Supranuclear Palsy, Spinocerebellar ataxia, Stiff-person syndrome, Stroke, Sturge-Weber syndrome, Subacute sclerosing panencephalitis, Subcortical arteriosclerotic encephalopathy, Superficial siderosis, Sydenham's chorea, Syncope, Synesthesia, Syringomyelia, Tardive dyskinesia, Tay-Sachs disease, Temporal arteritis, Tethered spinal cord syndrome, Thomsen disease, Thoracic outlet syndrome, Tic Douloureux, Todd's paralysis, Tourette syndrome, Transient ischemic attack, Transmissible spongiform encephalopathies, Transverse myelitis, Traumatic brain injury, Tremor, Trigeminal neuralgia, Tropical spastic paraparesis, Trypanosomiasis, Tuberous sclerosis, Vasculitis including temporal arteritis, Von Hippel-Lindau disease (VHL), Viliuisk Encephalomyelitis (VE), Wallenberg's syndrome, Werdnig-Hoffman disease, West syndrome, Whiplash, Williams syndrome, Wilson's disease, X-Linked Spinal and Bulbar Muscular Atrophy, and Zellweger syndrome. In some embodiments, neurological conditions can comprise movement disorders. In one embodiment, movement disorders comprise Parkinson's Disease (PD).

The term Parkinsonism is used for a motor syndrome whose main symptoms are tremor at rest, stiffness, slowing of movement and postural instability. Parkinsonian syndromes can be divided into four subtypes according to their origin: primary or idiopathic, secondary or acquired, hereditary parkinsonism, and parkinson plus syndromes or multiple system degeneration. Parkinson's disease is the most common form of Parkinsonism and is usually defined as "primary" Parkinsonism, meaning Parkinsonism with no external identifiable cause. As much as this can go against the definition of Parkinson's disease as an idiopathic illness, genetic Parkinsonism disorders with a similar clinical course to PD are generally included under the Parkinson's disease label. The terms "familial Parkinson's disease" and "sporadic Parkinson's disease" can be used to differentiate genetic from truly idiopathic forms of the disease.

PD is usually classified as a movement disorder, although it also gives rise to several non-motor types of symptoms such as sensory deficits, cognitive difficulties or sleep problems. Parkinson plus diseases are primary parkinsonisms which present additional features. They include multiple system atrophy, progressive supranuclear palsy, corticobasal degeneration and dementia with Lewy bodies.

In terms of pathophysiology, PD is considered a synucleinopathy due to an abnormal accumulation of alpha-synuclein protein in the brain in the form of Lewy bodies, as opposed to other diseases such as Alzheimer's disease where the brain accumulates tau protein in the form of neurofibrillary tangles. Nevertheless, there is clinical and pathological overlap between tauopathies and synucleinopathies. The most typical symptom of Alzheimer's disease, dementia, occurs in advanced stages of PD, while it is common to find neurofibrillary tangles in brains affected by PD.

Dementia with Lewy bodies (DLB) is another synucleinopathy that has similarities with PD, and especially with the subset of PD cases with dementia. However the relationship between PD and DLB is complex and still has to be clarified. They may represent parts of a continuum or they may be separate diseases.

Parkinson's disease affects movement, producing motor symptoms. Non-motor symptoms, which include autonomic dysfunction, neuropsychiatric problems (mood, cognition, behavior or thought alterations), and sensory and sleep difficulties, are also common.

Four motor symptoms are considered cardinal in PD: tremor, rigidity, slowness of movement, and postural instability. Tremor is the most apparent and well-known symptom. It is the most common; though around 30% of individuals with PD do not have tremor at disease onset, most develop it as the disease progresses. It is usually a rest tremor: maximal when the limb is at rest and disappearing with voluntary movement and sleep. It affects to a greater extent the most distal part of the limb and at onset typically appears in only a single arm or leg, becoming bilateral later. A feature of tremor is "pill-rolling", a term used to describe the tendency of the index finger of the hand to get into contact with the thumb and perform together a circular movement. The term derives from the similarity between the movement in PD patients and the earlier pharmaceutical technique of manually making pills.

Bradykinesia (slowness of movement) is another characteristic feature of PD, and is associated with difficulties along the whole course of the movement process, from planning to initiation and finally execution of a movement. Performance of sequential and simultaneous movement is hindered. Bradykinesia is the most disabling symptom in the early stages of the disease. Initial manifestations are problems when performing daily tasks which use fine motor control such as writing, sewing or getting dressed. Clinical evaluation is based in similar tasks such as alternating movements between both hands or both feet. Bradykinesia is not equal for all movements or times. It is modified by the activity or emotional state of the subject, to the point that some patients are barely able to walk yet can still ride a bicycle. Generally patients have less difficulty when some sort of external cue is provided.

Rigidity is stiffness and resistance to limb movement caused by increased muscle tone, an excessive and continuous contraction of muscles. In Parkinsonism the rigidity can be uniform (lead-pipe rigidity) or ratchety (cogwheel rigidity). The combination of tremor and increased tone is considered to be at the origin of cogwheel rigidity. Rigidity may be associated with joint pain; such pain being a frequent initial manifestation of the disease. In early stages of Parkinson's disease, rigidity is often asymmetrical and it tends to affect the neck and shoulder muscles prior to the muscles of the face and extremities. With the progression of the disease, rigidity typically affects the whole body and reduces the ability to move.

Postural instability is typical in the late stages of the disease, leading to impaired balance and frequent falls, and secondarily to bone fractures. Instability is often absent in the initial stages, especially in younger people. Up to 40% of the patients may experience falls and around 10% may have falls weekly, with number of falls being related to the severity of PD.

Other recognized motor signs and symptoms include gait and posture disturbances such as festination (rapid shuffling steps and a forward-flexed posture when walking), speech and swallowing disturbances including voice disorders, mask-like face expression or small handwriting, although the range of possible motor problems that can appear is large.

Parkinson's disease can cause neuropsychiatric disturbances which can range from mild to severe. This includes disorders of speech, cognition, mood, behavior, and thought. Cognitive disturbances can occur in the initial stages of the disease and sometimes prior to diagnosis, and increase in prevalence with duration of the disease. The most common cognitive deficit in affected individuals is executive dysfunction, which can include problems with planning, cognitive flexibility, abstract thinking, rule acquisition, initiating appropriate actions and inhibiting inappropriate actions, and selecting relevant sensory information. Fluctuations in attention and slowed cognitive speed are among other cognitive difficulties. Memory is affected, specifically in recalling learned information. Nevertheless, improvement appears when recall is aided by cues. Visuospatial difficulties are also part of the disease, seen for example when the individual is asked to perform tests of facial recognition and perception of the orientation of drawn lines.

A person with PD has two to six times the risk of suffering dementia compared to the general population. The prevalence of dementia increases with duration of the disease. Dementia is associated with a reduced quality of life in people with PD and their caregivers, increased mortality, and a higher probability of needing nursing home care. Behavior and mood alterations are more common in PD without cognitive impairment than in the general population, and are usually present in PD with dementia. The most frequent mood difficulties are depression, apathy and anxiety. Impulse control behaviors such as medication overuse and craving, binge eating, hypersexuality, or pathological gambling can appear in PD and have been related to the medications used to manage the disease. Psychotic symptoms—hallucinations or delusions—occur in 4% of patients, and it is assumed that the main precipitant of psychotic phenomena in Parkinson's disease is dopaminergic excess secondary to treatment; it therefore becomes more common with increasing age and levodopa intake.

In addition to cognitive and motor symptoms, PD can impair other body functions. Sleep problems are a feature of the disease and can be worsened by medications. Symptoms can manifest in daytime drowsiness, disturbances in REM sleep, or insomnia. Alterations in the autonomic nervous system can lead to orthostatic hypotension (low blood pressure upon standing), oily skin and excessive sweating, urinary incontinence and altered sexual function. Constipation and gastric dysmotility can be severe enough to cause discomfort and even endanger health. PD is related to several eye and vision abnormalities such as decreased blink rate, dry eyes, deficient ocular pursuit (eye tracking) and saccadic movements (fast automatic movements of both eyes in the same direction), difficulties in directing gaze upward, and blurred or double vision. Changes in perception may include an impaired sense of smell, sensation of pain and paresthesia (skin tingling and numbness). All of these symptoms can occur years before diagnosis of the disease.

The primary symptoms of Parkinson's disease result from greatly reduced activity of dopamine-secreting cells caused by cell death in the pars compacta region of the substantia nigra. There are five major pathways in the brain connecting other brain areas with the basal ganglia. These are known as the motor, oculo-motor, associative, limbic and orbitofrontal circuits, with names indicating the main projection area of each circuit. All of them are affected in PD, and their disruption explains many of the symptoms of the disease since these circuits are involved in a wide variety of functions including movement, attention and learning.

Most people with Parkinson's disease have idiopathic (also termed sporadic) Parkinson's disease (having no specific known cause). A small proportion of cases, however, can be attributed to known genetic factors. Mutations in specific genes have been conclusively shown to cause PD. These genes code for alpha-synuclein (SNCA, also known as PARK1 and PARK4), parkinson protein 2 (PARK2, but also known as parkin, PRKN, as well as E3 ubiquitin ligase), leucine-rich repeat kinase 2 (LRRK2, also known as dardarin), PTEN-induced putative kinase 1 (PINK1, also known as PARK6), parkinson protein 7 (PARK7, also known as DJ-1) and ATPase type 13A2 (ATP13A2), in which some mutations are referred to as Kufor-Rakeb syndrome. In most cases, people with these mutations can develop PD. With the exception of LRRK2, however, they account for only a small minority of cases of PD. The most extensively studied PD-related genes are SNCA and LRRK2. Mutations in genes including SNCA, LRRK2 and glucocerebrosidase (GBA) have been found to be risk factors for sporadic PD. Mutations in GBA are known to cause Gaucher's disease.

PD invariably progresses with time. The Hoehn and Yahr scale, which defines five stages of progression, is commonly used to estimate the progress of the disease. Motor symptoms, if not treated, advance aggressively in the early stages of the disease and more slowly later. Untreated, subjects are expected to lose independent ambulation after an average of eight years and be bedridden after ten years. However, it is uncommon to find untreated subjects nowadays. Medication has improved the prognosis of motor symptoms, while at the same time it is a new source of disability because of the undesired effects of levodopa after years of use. In subjects taking levodopa, the progression time of symptoms to a stage of high dependency from caregivers may be over 15 years. However, it is hard to predict what course the disease can take for a given subject. Age is the best predictor of disease progression. The rate of motor decline is greater in those with less impairment at the time of diagnosis, while cognitive impairment is more frequent in those who are over 70 years of age at symptom onset.

Since current therapies improve motor symptoms, disability at present is mainly related to non-motor features of the disease. Nevertheless, the relationship between disease progression and disability is not linear. Disability is initially related to motor symptoms. As the disease advances, disability is more related to motor symptoms that do not respond adequately to medication, such as swallowing/speech difficulties, and gait/balance problems; and also to motor complications, which appear in up to 50% of subjects after 5 years of levodopa usage. Finally, after ten years most subjects with the disease have autonomic disturbances, sleep problems, mood alterations and cognitive decline. All of these symptoms, especially cognitive decline, greatly increase disability.

Genetic Variations Associated with Parkinson's Disease

Genomic sequences within populations exhibit variability between individuals at many locations in the genome. For example, the human genome exhibits sequence variations, which occur on average every 500 base pairs. Such genetic variations in nucleic acid sequences are commonly referred to as polymorphisms or polymorphic sites. In some embodiments, these genetic variations can be found to be associated with PD using the methods disclosed herein. In some embodiments, these genetic variations comprise point mutations, e.g., single nucleotide polymorphisms (SNPs) or single nucleotide variants (SNVs), polymorphisms, translocations, insertions, deletions, amplifications, inversions, interstitial deletions, copy number variations (CNVs), loss of heterozygosity, or any combination thereof. In some embodiments, polymorphisms (e.g., polymorphic markers, genetic variations, or genetic variants) can comprise any nucleotide position at which two or more sequences are possible in a subject population. In some embodiments, each version of a nucleotide sequence with respect to the polymorphism can represent a specific allele of the polymorphism. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms can comprise any number of specific alleles. In some embodiments of the disclosure, a polymorphism can be characterized by the presence of two or more alleles in a population. In some embodiments, the polymorphism can be characterized by the presence of three or more alleles. In some embodiments, the polymorphism can be characterized by four or more alleles, five or more alleles, six or more alleles, seven or more alleles, nine or more alleles, or ten or more alleles. In some embodiments an allele can be associated with one or more diseases or disorders. In some embodiments, genetic variations and alleles can be used to associate an inherited phenotype, for example, susceptibility PD, with a responsible genotype. In some embodiments, an allele, e.g., a risk allele, can be a variant allele that is statistically associated with PD, a risk of developing PD, or an increase susceptibility to PD.

In some embodiments, genetic variations can be of any measurable frequency in the population, for example, a frequency higher than 10%, a frequency between 5-10%, a frequency between 1-5%, or frequency below 1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a haplotype can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, protein expression, protein function, or any combination thereof. In some embodiments, a genetic variation can be a loss-of-function mutation, gain-of-function mutation, dominant negative mutation, or reversion. In some embodiments, a genetic variation can be part of a gene's coding region or regulatory regions. Regulatory regions can control gene expression and thus protein expression. In some embodiments, a regulatory region can be a segment of DNA wherein regulatory proteins, for example, transcription factors, can bind. In some embodiments a regulatory region can be positioned near the gene being regulated, for example, positions upstream of the gene being regulated. In some embodiments, a regulatory region (e.g., enhancer element) can be several thousands of base pairs upstream or downstream of a gene.

In some embodiments, variants can include changes that affect a polypeptide or protein, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with PD can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the protein product having an altered structure due to rare codon usage that impacts protein folding during translation, which in some cases may alter its function and/or drug binding properties if it is a drug target. In some embodiments, the changes that can alter DNA increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

In some embodiments, one or more variant polypeptides or proteins can be associated with PD. In some embodiments, variant polypeptides and changes in expression, localization, and interaction partners thereof, can be used to associate an inherited phenotype, PD, with a responsible genotype. In some embodiments, an PD associated variant polypeptide can be statistically associated with a diagnosis, prognosis, or theranosis of PD.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to PD. SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is be the official Reference SNP (rs) ID identification tag as assigned to each unique SNP by the National Center for Biotechnological Information (NCBI).

Another genetic variation of the disclosure can be copy number variations/variants (CNVs). CNVs can be alterations of the DNA of a genome that results in an abnormal number of copies of one or more sections of DNA. CNVs can be inherited or caused by de novo mutation and can be responsible for a substantial amount of human phenotypic variability, behavioral traits, and disease susceptibility. In one embodiment, CNVs of the current disclosure can be associated with risk of or susceptibility to PD. In some embodiments, CNVs can impact a single gene or include a contiguous set of genes. In some embodiments, CNVs can be caused by structural rearrangements of the genome, for example, translocations, insertions, deletions, amplifications, inversions, and interstitial deletions. In some embodiments, these structural rearrangements occur on one or more chromosomes. Low copy repeats (LCRs), which are region-specific repeat sequences, can be susceptible to these structural rearrangements, resulting in CNVs. Factors such as size, orientation, percentage similarity and the distance between the copies can influence the susceptibility of LCRs to mediate genomic rearrangement.

CNVs can account for genetic variation affecting a substantial proportion of the human genome, for example, known CNVs can cover over 15% of the human genome sequence (Estivill and Armengol, supra). CNVs can affect gene expression, phenotypic variation and adaptation by disrupting a gene or altering gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants (projects.tcag.ca/variation/), which currently contains data for over 100,000 CNVs.

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

Subjects

A subject, as used herein, can be an individual of any age from whom a sample containing nucleotides is obtained for analysis, e.g., by one or more methods described herein, so as to obtain genetic data, for example, a subject adult, child, newborn, or fetus. In some embodiments, a subject can be any target of therapeutic administration. In some embodiments, a subject can be a test subject or a reference subject. In some embodiments, a subject can be associated with PD, asymptomatic or symptomatic, have increased or decreased susceptibility to PD, be associated or unassociated with a treatment or treatment regimen, or any combination thereof. As used in the present disclosure a cohort can represent an ethnic group, a patient group, a particular age group, a group not associated with PD, a group associated with PD, a group of asymptomatic subject subjects, a group of symptomatic subject subjects, or a group or subgroup of subject subjects associated with a particular response to a treatment regimen or clinical trial. In some embodiments, a patient can be a subject afflicted with PD. In some embodiments, a patient can be a subject not afflicted with PD. In some embodiments, a subject subject can be a test subject subject, a subject patient or a subject candidate for a therapeutic, wherein genomic DNA from the subject subject, subject patient, or subject candidate is obtained for analysis by one or more methods of the present disclosure herein, so as to obtain genetic variation information of the subject, patient or candidate.

In some embodiments, the sample can be obtained prenatally from a subject fetus or embryo or from the mother, for example, from fetal or embryonic cells in the maternal circulation. In some embodiments, the sample can be obtained with the assistance of a health care provider, for example, to draw blood. In some embodiments, the sample can be obtained without the assistance of a health care provider, for example, where the sample is obtained non-invasively, such as a saliva sample, or a sample comprising buccal cells that is obtained using a buccal swab or brush, or a mouthwash sample.

The present disclosure also provides methods for assessing genetic variations in subjects who are members of a target population. Such a target population is in some embodiments a population or group of subjects at risk of developing PD, based on, for example, other genetic factors, biomarkers, biophysical parameters, family history of PD, previous screening or medical history, or any combination thereof.

In some embodiments, subjects can be from specific age subgroups, such as those over the age of 1, over the age of 2, over the age of 3, over the age of 4, over the age of 5, over the age of 6, over the age of 7, over the age of 8, over the age of 9, over the age of 10, over the age of 15, over the age of 20, over the age of 25, over the age of 30, over the age of 35, over the age of 40, over the age of 45, over the age of 50, over the age of 55, over the age of 60, over the age of 65, over the age of 70, over the age of 75, over the age of 80, or over the age of 85. Other embodiments of the disclosure pertain to other age groups, such as subjects aged less than 85, such as less than age 80, less than age 75, less than age 70, less than age 65, less than age 60, less than age 55, less than age 50, less than age 45, less than age 40, less than age 35, less than age 30, less than age 25, less than age 20, less than age 15, less than age 10, less than age 9, less than age 8, less than age 6, less than age 5, less than age 4, less than age 3, less than age 2, or less than age 1. Other embodiments relate to subjects with age at onset of the disease in any of particular age or age ranges defined by the numerical values described in the above or other numerical values bridging these numbers. It is also contemplated that a range of ages can be relevant in certain embodiments, such as age at onset at more than age 15 but less than age 20. Other age ranges are however also contemplated, including all age ranges bracketed by the age values listed in the above.

The genetic variations of the present disclosure found to be associated with PD can show similar association in other subject populations. Particular embodiments comprising subject populations are thus also contemplated and within the scope of the disclosure. Such embodiments relate to subject subjects that are from one or more human populations including, but not limited to, Caucasian, European, American, Ashkenazi Jewish, Sephardi Jewish, Eurasian, Asian, Central/South Asian, East Asian, Middle Eastern, African, Hispanic, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The racial contribution in subject subjects can also be determined by genetic analysis, for example, genetic analysis of ancestry can be carried out using unlinked microsatellite markers such as those set out in Smith et al. (Am. J. Hum. Genet., 74:1001 (2004)).

It is also well known to the person skilled in the art that certain genetic variations have different population frequencies in different populations, or are polymorphic in one population but not in another. A person skilled in the art can however apply the methods available and as thought herein to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations. Samples Samples that are suitable for use in the methods described herein can be from a subject and can contain genetic or proteinaceous material, for example, genomic DNA (gDNA). Genetic material can be extracted from one or more biological samples including but not limited to, blood, saliva, urine, mucosal scrapings of the lining of the mouth, expectorant, serum, tears, skin, tissue, or hair.

In some embodiments, the sample can comprise cells or tissue, for example, cell lines. Exemplary cell types from which genetic material can be obtained using the methods described herein and include but are not limited to, a blood cell; such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops there from. A cell from which gDNA is obtained can be at a particular developmental level including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally any type of stem cell can be used including, without limitation, an embryonic stem cell, adult stem cell, an induced pluripotent stem cell created from an adult cell type such as fibroblasts derived from skin or pluripotent stem cell.

In some embodiments, a sample can be processed for DNA isolation, for example, DNA in a cell or tissue sample can be separated from other components of the sample. Cells can be harvested from a biological sample using standard techniques known in the art, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the sample can be concentrated and/or purified to isolate DNA. All samples obtained from a subject subject, including those subjected to any sort of further processing, are considered to be obtained from the subject. In some embodiments, standard techniques and kits known in the art can be used to extract genomic DNA from a biological sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a sample comprising DNA from a subject, and/or assessing the identity, copy number, presence or absence of one or more genetic variations and their chromosomal locations in the sample. The individual or organization that performs the determination need not actually carry out the physical analysis of a sample from a subject. In some embodiments, the methods can include using information obtained by analysis of the sample by a third party. In some embodiments, the methods can include steps that occur at more than one site. For example, a sample can be obtained from a subject at a first site, such as at a health care provider or at the subject's home in the case of a self-testing kit. The sample can be analyzed at the same or a second site, for example, at a laboratory or other testing facility.

Molecular Pathways in PD

The affected systems in PD include synaptic transmission, endosomal trafficking, lysosomal-autophagy, and energy metabolism or mitophagy. For example, in synaptic transmission, alpha-synuclein protein is found abundantly at the presynaptic terminals of neurons and is involved in synaptic release. At the synapse, LRRK2 levels regulate glutamate transmission, dopamine-dependent plasticity and striatal signal transduction. LRRK2 protein is also reported to interact with the dynamin superfamily of GTPases, which mediate both membrane scission in clathrin-induced endocytosis and mitochondrial fission and fusion. DNAJC6 encodes auxilin, a homolog of cyclin-G associated kinase (GAK), which is preferentially expressed in neurons and involved in clathrin uncoating and synaptic vesicle recycling. Similarly, recessively inherited mutations in SYNJ1, encoding synaptojamin, that complexes with Hsc70 and auxilin, have been implicated in disease.

Endosomal trafficking is a highly complex and dynamic cellular process whereby vesicles or cargos that are internalized at the plasma membrane are subsequently recycled, directly or via the trans-Golgi network, and targeted for degradation by lysosomal autophagy. Neurons have a critical need to recycle membrane receptors. This can be accomplished through the clathrin-independent retromer system, a tubulovesicular tripartite complex of VPS26, VPS29 and VPS35. Multiple VPS35 subunits coalesce about FAM21, a subunit of the WASH (Wiskott-Aldrich syndrome protein and scar homolog) complex, to mediate dynamic actin remodeling. RME-8 also binds sorting nexins and FAM21 to influence WASH and cargo trafficking. VPS35 may also physically interact with LRRK2 and Rab7L1 to influence these processes.

Lysosomes have an essential function in maintaining protein and organelle integrity within cells and impaired lysosomal function may play an important role in the pathogenesis of Parkinson's disease. The formation of intracellular aggregated alpha-synuclein or tau inclusions, albeit not a primary pathology, is also found in several ceroid lipofuscinosis disorders. These include glycolipid storage diseases such as Gaucher disease and Niemann-Pick type C that are most prevalent in Ashkenazi Jewish communities. Loss of GBA activity increases intracellular glucosylceramide accumulation, resulting in decreased lysosomal degradation and subsequent accumulation of alpha-synuclein.

Two juvenile or early-onset forms of atypical parkinsonism result directly from mutations in lysosomal proteins. X-linked parkinsonism is a consequence of splicing or protein isoform deficits in ATP6AP2 (encoding ATPase, H+transporting, lysosomal accessory protein 2), mutations in ATP13A2 (ATPase type 13A2 gene) also result in impaired lysosomal proteolysis.

The importance of mitochondria in parkinsonism is highlighted by the identification of mutations in several genes within a common pathway for mitophagy. Mutations in the PARK2 (parkin) gene result in a recessive form of early-onset parkinsonism. Parkin protein was first described as a proteosomal E3 ubiquitin ligase responsible for K48 substrate polyubiquination (targeting to the proteosome) and K63 monoubiquination (for signaling). PINK1 (Pteninduced kinase 1) and FBXO7 (F-box domain-containing protein), which are also genes implicated in recessive early-onset parkinsonism. Upstream regulators of mitophagy include TOMM7, for stabilizing PINK1 on the outer mitochondrial membrane; HSPA1L and BAG4, which may help to regulate parkin translocation to mitochondria; and SIAH3, which is localized to mitochondria and inhibits PINK1 after mitochondrial damage.

Hexokinase activity, occurring downstream of Akt but upstream of PINK1, STOML2, mitofusinl/2, GRP75, HSP60, LRPPRC, and TUFM have been nominated as downstream targets of the PINK1/parkin pathway. DJ-1 mutations, may also regulate PINK1-dependent parkin translocation to depolarized mitochondria.

Lysosomal storage diseases (LSDs) are hereditary disorders. Most are inherited in an autosomal recessive manner. LSDs are often caused by mutations in genes encoding catabolic enzymes that are involved in degradation of macromolecules. Neuronal ceroid lipofuscinoses (NCLs)—a groups of neurodegenerative disorders that are similar to classic LSDs as they are characterized by accumulation of cellular material (namely, lipofuscin) in bodily tissues. The CNS seems to be particularly vulnerable to LSDs. LSDs are commonly caused by dysfunction in lysosomal components such as hydrolases, transporters and hydrolase activators, and lead to intralysosomal accumulation of undegraded metabolites.

Initially, classification of LSDs was made according to the nature of the accumulating storage material—as in sphingolipidoses, mucopolysaccharidoses and oligosaccharidoses. A less restrictive classification of disorders involving lysosomal storage, however, allows inclusion of diseases that display defects in cellular storage, synthetic enzymes, lysosome membrane or other membrane proteins, and trafficking. LSDs expands to include disorders that are characterized by defects in synthetic processes (such as defective GM3-synthase in GM3-gangliosidosis) or by trafficking defects (Niemann-Pick disease, type C1 [NPC1] and NPC2), as well as including lysosomal membrane protein diseases due to faulty lysosome-associated membrane protein 1 (LAMP-1), LAMP-2, or lysosome membrane protein II (LIMP2).

TABLE 1

Classic lysosomal storage disorders

| Disease type | Neurological involvement? | Defective enzyme or protein |
|---|---|---|
| *Sphingolipidoses* | | |
| Fabry disease | Y | α-Galactosidase A |
| Farber lipogranulomatosis | N | Ceramidase |
| Gaucher disease type I | N | β-Glucosidase |
| Gaucher disease types II and III | Y | Saposin-C activator |
| Niemann-Pick disease types A and 13 | Y | Sphingomyelinase |
| GM1-gangliosidosis: infantile, juvenile and adult variants | Y | β-Galactosidase |
| GM2-gangliosidosis (Sandhoff): infantile and juvenile | Y | β-Hexosaminidase A and B |
| GM2-gangliosidosis (Tay-Sachs): infantile, juvenile and adult variants | Y | β-Hexosaminidase A |
| GM2-gangliosidosis (GM2-activator deficiency) | | GM2-activator protein |
| GM3-gangliosidosis | Y | GM3 synthase |
| Metachromatic leukodystrophy (late infantile, juvenile and adult) | Y | Arylsulphatase A |
| Sphingolipid-activator deficiency | Y | Sphingolipid activator |
| *Mucopolysaccharidoses* | | |
| MPS I (Scheie, Hurler-Scheie and Hurler disease) | Y | α-Iduronidase |
| MPS II (Hunter) | Y | Iduronidase-2-sulphatase |
| MPS IIIA (Sanfilippo A) | Y | Heparan N-sulphatase (sulphamidase) |
| MPS IIIB (Sanfilippo B) | Y | N-acetyl-α-glucosaminidase |
| MPS IIIC (Sanfilippo C) | Y | Acetyl-CoA; α-glucosamide N-acetyltransferase |
| MPS IIID (Sanfilippo D) | Y | N-acetylglucosamine-6-sulphatase |
| MPS IVA (Morquio syndrome A) | Y | N-acetylgalactosamine-6-sulphate sulphatase |
| MPS IVB (Morquio syndrome B) | N | β-Galactosidase |
| MPS VI (Maroteaux-Lamy) | Y | N-acetylgalactosamine-4-sulphatase (arylsulphatase B) |
| MPS VII (Sly disease) | Y | β-Glucuronidase |
| MPS IX | Y | Hyaluronidase |
| *Glycogen storage disease* | | |
| Pompe (glycogen storage disease type II) | Y | α-Glucosidase |

TABLE 1-continued

Classic lysosomal storage disorders

| Disease type | Neurological involvement? | Defective enzyme or protein |
|---|---|---|
| *Oligosaccharidoses* | | |
| α-Mannosidosis | Y | α-Mannosidase |
| β-Mannosidosis | Y | β-Mannosidase |
| Fucosidosis | Y | α-Fucosidase |
| Aspartylglucosaminuria | Y | Aspartylglucosaminidase |
| Schindler disease | Y | α-N-acetylgalactosaminidase |
| Sialidosis | Y | α-Neuraminidase |
| Galactosialidosis | Y | Lysosomal protective protein |
| Mucolipidosis II (I-cell disease); mucolipidosis III | Y | Urine diphosphate-N-acetylglucosamine; lysosomal enzyme N-acetylglucosaminyl-1-phosphotransferase |
| *Integral membrane protein disorders* | | |
| Cystinosis | N | Cystinosin |
| Danon disease | Y | Lysosome-associated membrane protein 2 |
| Action myoclonus-renal failure syndrome | N | Lysosome membrane protein 2 |
| Salla disease | Y | Sialin |
| Niemann-Pick disease type Cl | Y | NPC-1, NPC-2 |
| Mucolipidosis IV | Y | Mucolipin |
| *Additional disease types* | | |
| Multiple sulphatase deficiency | Y | Sulphatase-modifying factor 2 |
| Niemann-Pick disease type C2 | Y | NPC-2 |
| Wolman disease (infantile); cholesteryl ester storage disease | N | Lysosomal acid lipase |
| Galactosialidosis | Y | Cathepsin A |

It is noteworthy that variants in certain Gaucher disease associated genes were found in PD patients. PD patients or those at risk of developing PD may also have variants in genes associated with NCLs (Table 2) or human lysosome-related organelle disorders (Table 3).

TABLE 2

Human neuronal ceroid lipofuscinoses variants

| Disease | Clinical phenotype | Gene | Gene product |
|---|---|---|---|
| CLN1 | Classic infantile, late infantile, juvenile, adult* | CLN1 (PPT1) | PPT-1 |
| CLN2 | Classic late infantile, juvenile* | CLN2 (TPP1) | TPP-1 |
| CLN3 | Juvenile* | CLN3 | CLN3 protein (battenin) |
| CLN4 | Adult autosomal dominant* | CLN4 (DNAJC5) | DnaJ homologue subfamily C member 5193 |
| CLN5 | Late infantile variant, juvenile, adult* | CLN5 | Protein CLN5 |
| CLN6 | Late infantile variant, adult*(Kuf, type A)* | CLN6 | Protein CLN6 |
| CLN7 | Late infantile variant*, juvenile*, adult* | CLN7 (MFSD8) | Major facilitator superfamily domain-containing protein 8 |
| CLN8 | Late infantile variant EPMR* | CLN8 | Protein CLN8 |
| CLN10 | Congenital classic*, late infantile*, adult* | CLN10 (CTSD) | Cathepsin D |
| CLN11 | Adult* | CLN11 (GRN) | Progranulin194 |
| CLN12 | Juvenile, Kufor-Rakeb syndrome* | CLN12 (ATP13A2) | — |

TABLE 2-continued

Human neuronal ceroid lipofuscinoses variants

| Disease | Clinical phenotype | Gene | Gene product |
|---------|-------------------|------|--------------|
| CLN13 | Adult Kuf type* | CLN13 (CTSF) | Cathepsin F |
| CLN14 | Infantile, progressive myoclonus epilepsy 3* | CLN14 (KCTD7) | Potassium channel tetramerization domain-containing protein 7195 |

*These diseases have neurological involvement Abbreviation: EPMR, epilepsy with mental retardation In general, the NCLs are pathologically characterized by storage of autofluorescent material (including protein subunit C of mitochondrial ATP synthase or saposins) within neuronal lysosomes. 14 distinct genetic NCL variants are now recognized.
Table 3

TABLE 3

| Mutant gene | Mutant protein | Protein complex | Clinical picture |
|-------------|----------------|-----------------|------------------|
| HPS1 | HPS1 | BLOC-3 AP-3 adaptor | Hypopigmentation of skin and/or eyes; bleeding diathesis; progressive pulmonary fibrosis; accumulation of degraded material in lysosomes |
| HPS2 | HPS2 | BLOC-2 | |
| HPS3 | HPS3 | BLOC-3 | |
| HPS4 | HPS4 | BLOC-2 | |
| HPS5 | HPS5 | BLOC-2 | |
| HPS6 | HPS6 | BLOC-1 | |
| HPS7 | HPS7 | BLOC-1 | |
| HPS8 | HPS8 | BLOC | |
| MYO5A | Myosin VA | Myosin VA-RAB27-melanophillin tripartite complex | Hypopigmentation of skin and hair; severe neurological problems early in life; lack of melanocyte transfer from melanocytes to keratinocytes |
| RAB27A | Rab-27 | Myosin VA-RAB27-melanophillin tripartite complex | Hypopigmentation of skin and/or hair; immune defect owing to decreased exotycosis of lytic granules in cytotoxic T lymphocytes; lack of melanocyte transfer from melanocytes to keratinocytes |
| MLPH | Melanophillin | Myosin VA-RAB27-melanophillin tripartite complex | Hypopigmentation of skin and/or hair; perinuclear accumulation of melanosomes owing to ineffective capturing of melanosomes by the actin network |
| LYST | Lysosome trafficking regulator | LYST or lysosome traffic regulator | Hypopigmentation of skin and/or hair; bleeding diathesis; giant azurophilic granules In children: life-threatening skin and/or lung infections owing to decreased cellular immunity In adults: ataxia, cerebellar signs, neuropathy, autonomic problems, seizures, cognitive impairment |

Numerous mechanisms have emerged as contributors to disease propagation, including activation of cell-death signaling, alteration of lipid content, prolonged inflammation, ER-cytosol calcium balance, and dysregulation of autophagy.

GAGs are similar to lipopolysaccharide in that they activate Toll-like receptor 4 (TLR4). Activation of this receptor leads not only to upregulation of proapoptotic ceramide in the chondrocytes, thereby causing cell death, but also to proliferation of synovial cells owing to an increase in levels of sphingosine-1-phosphate. excess storage of heparin sulphate can lead to modulation of signaling mediated by fibroblast growth factor 2 and transforming growth factor 13, which contributes to neuronal cell death, neurodegeneration and bone pathology.

Alterations of plasma membrane lipid content and lipid raft stoichiometry can also affect receptor responses and subsequent signaling events. For instance, defects of CLN3 protein affect sphingolipid stoichiometry in lipid rafts.

Lysosphingolipids—are sphingolipids that contain a sphingoid-base free amino group. Psychosine, a lysosphingolipid that is derived from GalCer. Excessive accumulation of psychosine is associated with Krabbe disease psychosine inhibits cytokinesis via interaction with the orphan G protein-coupled receptor 8 (TDAG8). Psychosine also inhibits protein kinase C, a signalling molecule that attenuates the response of Schwann cells and oligodendrocytes to growth factors, so excessive cellular accumulation of psychosine sensitizes these cells to apoptosis. Furthermore, through activation of phospholipase $A_2$, psychosine drives an increase in arachidonic acid and lysophosphatidylcholine, which leads to caspase-3 activation, apoptosis and subsequent demyelination in both the CNS and PNS. Glucosylsphingosine accumulates in the brain and contributes to the neurodegenerative process.

The reticuloendothelial system is the major storage site in many LSDs, particularly Gaucher disease and NPA, NPB and NPC. Injury to neurons leads to activation of microglia and release of inflammatory mediators from these cells. In LSDs an increasing and lifelong storage load in neurons provides a constant stimulus for glial activation and inflammation that ultimately leads to neuronal.

In Gaucher disease, calcium release from the ER into the cytosol is increased owing to activation of the ryanodine receptor, driven by excess intracellular accumulation of glucosylceramide (GluCer). In GM1-gangliosidosis and GM2-gangliosidosis, reduction of calcium uptake by the ER can occur owing to inhibition of the sarcoplasmic-ER calcium ATPase (SERCA) transporter. Glycosphingolipids and phospholipids can modulate ER and cytosolic calcium levels.

When taken to the extreme, autophagy can promote apoptosis either by acting alone or as an executor of programmed cell death.

Altered lipid trafficking and autophagic vacuole flux are two other mechanisms that cross paths with autophagy. Activation of autophagy is visualized as an increase in conversion of microtubule-associated protein 1A/1B-light chain 3 (LC3) from the cytosolic form (LC3-I) to the autophagosome-associated form (LC3-II), as well as an increase in the level of an autophagy related protein, beclin1.
Methods of Screening As used herein, screening a subject may include diagnosing or determining, theranosing, or determining the risk of or susceptibility to developing (prognosing) PD. In particular embodiments, the disclosure is a method of determining the presence of, a risk of developing or a susceptibility to, PD, by detecting at least one genetic variation in a sample from a subject as described herein. In some embodiments, detection of particular alleles, markers, variations, or haplotypes is indicative of the presence of or susceptibility to PD.

Within any given population, there can be an absolute susceptibility of developing a disease or trait, defined as the chance of a person developing the specific disease or trait over a specified time-period. Susceptibility (e.g., being at-risk) is typically measured by looking at very large numbers of people, rather than at a particular individual. As described herein, certain copy number variations (genetic variations) are found to be useful for susceptibility assessment of PD. Susceptibility assessment can involve detecting particular genetic variations in the genome of individuals undergoing assessment. Particular genetic variations are found more frequently in individuals with PD, than in individuals without PD. Therefore, these genetic variations have predictive value for detecting EN, risk of developing PD, or a susceptibility to PD, in an individual. Without intending to be limited by theory, it is believed that the genetic variations described herein to be associated with susceptibility of PD represent functional variants predisposing to the disease. In some embodiments, a genetic variation can confer a susceptibility of the condition, for example, carriers of the genetic variation are at a different risk of the condition than non-carriers. In one embodiment, the presence of a genetic variation is indicative of increased susceptibility to or the presence of PD.

Screening can be performed using any method. In some embodiments, screening can be performed using Polymerase Chain Reaction (PCR). In one embodiment, screening can be performed using Array Comparative Genomic Hybridization (aCGH). In some embodiments, the genetic variation information as it relates to the current disclosure can be used in conjunction with any symptomatic screening tests.

In some embodiments, information from any of the above screening methods (e.g., specific symptoms or genetic variation data) can be used to define a subject as a test subject or reference subject. In some embodiments, information from any of the above screening methods can be used to associate a subject with a test or reference population, for example, a subject in a population.

In one embodiment, an association with PD can be determined by the statistical likelihood of the presence of a genetic variation in a subject with PD, for example, an unrelated individual or a first or second-degree relation of the subject. In some embodiments, an association with PD can be determined by determining the statistical likelihood of the absence of a genetic variation in an unaffected reference subject, for example, an unrelated individual or a first or second-degree relation of the subject. The methods described herein can include obtaining and analyzing a sample from one or more suitable reference subjects.

As used herein, susceptibility can be proneness of a subject towards the development of PD, or towards resisting development of PD, than one or more control subjects. In some embodiments, susceptibility can encompass increased susceptibility. For example, particular nucleic acid variations of the disclosure as described herein can be characteristic of increased susceptibility to development of PD. In some embodiments, susceptibility can encompass decreased susceptibility, for example, particular nucleic variations of the disclosure as described herein can be characteristic of decreased susceptibility to development of PD. As used herein, a subject at risk of developing PD has a greater chance of developing PD relative to the general population or to one or more subjects without a specific genetic variation.

As described herein, a genetic variation predictive of susceptibility to or presence of PD can be one where the particular genetic variation is more frequently present in a subject with the condition (affected), compared to the frequency of its presence in a reference group (control), such that the presence of the genetic variation is indicative of susceptibility to or presence of PD. In some embodiments, the reference group can be a population sample, for example, a random sample from the general population or a mixture of two or more samples from a population. In some embodiments, disease-free controls can be characterized by the absence of one or more specific PD-associated symptoms, for example, individuals who have not experienced symptoms associated with PD. In some embodiments, the disease-free control group is characterized by the absence of one or more PD-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art can appreciate that for genetic variations with two or more alleles present in the population being studied, and wherein one allele can be found in increased frequency in a group of individuals with PD in the population, compared with controls, the other allele(s) of the marker can be found in decreased frequency in the group of individuals with the trait or disease, compared with controls. In such a case, one allele of the marker, for example, the allele found in increased frequency in individuals with PD, can be the at-risk allele, while the other allele(s) can be neutral or even protective.

A genetic variant associated with PD can be used to predict the susceptibility of PD for a given genotype. For any genetic variation, there can be one or more possible genotypes, for example, homozygote for the at-risk variant (e.g., in autosomal recessive disorders), heterozygote, and non-carrier of the at-risk variant. In some embodiments, susceptibility associated with variants at multiple loci can be used to estimate overall susceptibility. For multiple genetic variants, there can be k ($k=3^n*2^P$) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of PD, or other genetic risk variants for PD. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening for PD or a susceptibility to PD. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods known in the art, such as the use of available algorithms and software can be used to identify, or call, significant genetic variations, including but not limited to, algorithms of DNA Analytics or DNAcopy, iPattern and/or QuantiSNP. In some embodiments, a threshold log ratio value can be used to determine losses and gains. For example, using DNA Analytics, a log 2ratio cutoff of 0.25 and −0.25 to classify CNV gains and losses respectively may be used. As a further example, using DNAcopy, a log 2ratio cutoff of 0.35 and −0.35 to classify CNV gains and losses respectively may be used. In some embodiments, the information and calls from two or more of the methods described herein can be compared to each other to identify significant genetic variations more or less stringently. For example, CNV calls generated by both DNA Analytics and DNAcopy algorithms may be defined as stringent CNVs. In some embodiments, significant or stringent genetic variations can be tagged as identified or called if it can be found to have a minimal reciprocal overlap to a genetic variation detected by one or more platforms and/or methods described herein. For example, a minimum of 50% reciprocal overlap can be used to tag the CNVs as identified or called.

In some embodiments, multivariate analyses or joint risk analyses, including the use of multiplicative model for overall risk assessment, and can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes can be required to be able to demonstrate statistical interactions between loci. Assessment of risk based on such analysis can subsequently be used in the methods, uses and kits, arrays or panels of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.2, at least 1.3, at least 1.4, at least 1.5, at least 1.6, at least 1.7, 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least, 5.0, at least 6.0, or at least 10.0 is significant. Other values for significant susceptibility are also contemplated, for example, at least 2.5, 3.5, 4.5, 5.5, or any suitable other numerical values, wherein the values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of PD can be an individual in whom at least one genetic variation, conferring decreased susceptibility for or the lack of presence of PD is identified. In some embodiments, the genetic variations conferring decreased susceptibility are also protective. In one aspect, the genetic variations can confer a significant decreased susceptibility of or lack of presence of PD.

In some embodiments, significant decreased susceptibility can be measured as a relative susceptibility of less than 0.9, including but not limited to less than 0.9, less than 0.8, less than 0.7, less than 0,6, less than 0.5, less than 0.4, less than 0.3, less than 0.2 and less than 0.1. In some embodiments, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher's exact test. Other statistical tests of significance known to the skilled person are also contemplated and are also within scope of the disclosure.

In some embodiments, the significance of increased or decreased susceptibility can be determined according to the ratio of measurements from a test subject to a reference subject. In one embodiment, losses or gains of one or more CNVs can be determined according to a threshold log 2 ratio determined by these measurements. In some embodiments, a log 2 ratio value greater than 0.35 is indicative of a gain of one or more CNVs. In some embodiments, a log 2 ratio value less than −0.35 is indicative of a loss of one or more CNVs.

In some embodiments, the combined or overall susceptibility associated with a plurality of variants associated with PD can also be assessed, for example, the genetic variations described herein to be associated with susceptibility to PD can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for PD. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous carriers of an at-risk allele of a marker compared with non-carriers of the at-risk allele. Using the population average can, in certain embodiments, be more convenient, since it provides a measure which can be easy to interpret for the user, for example, a measure that gives the risk for the individual, based on his/her genotype, compared with the average in the population.

In certain embodiments of the disclosure, a genetic variation is correlated to PD by referencing genetic variation data to a look-up table that comprises correlations between the genetic variation and PD. The genetic variation in certain embodiments comprises at least one indication of the genetic variation. In some embodiments, the table comprises a correlation for one genetic variation. In other embodiments, the table comprises a correlation for a plurality of genetic variations. In both scenarios, by referencing to a look-up table that gives an indication of a correlation between a genetic variation and PD, a risk for PD, or a susceptibility to PD, can be identified in the individual from whom the sample is derived.

The screening applications of PD-associated genetic variations, as described herein, can, for example, be performed by an individual, a health professional, or a third party, for example, a service provider who interprets genotype information from the subject.

A medical professional can initiate or modify treatment after receiving information regarding a subject's screening for PD, for example. In some embodiments, a medical professional can recommend a change in therapy. In some embodiments, a medical professional can enroll a subject in a clinical trial for, by way of example, detecting correlations between a haplotype as described herein and any measurable or quantifiable parameter relating to the outcome of the treatment as described above.

Also provided herein are databases that include a list of genetic variations as described herein, and wherein the list can be largely or entirely limited to genetic variations identified as useful for screening PD as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening Using Variations in Polypeptides and/or RNA

In some embodiments of the disclosure, screening of PD can be made by examining or comparing changes in expression, localization, binding partners, and composition of a polypeptide encoded by a nucleic acid associated with PD, for example, in those instances where the genetic variations of the present disclosure results in a change in the composition or expression of the polypeptide and/or RNA, for example, mRNAs, miRNAs, and other noncoding RNAs (ncRNAs). Thus, screening of PD can be made by examining expression and/or composition of one of these polypeptides and/or RNA, or another polypeptide and/or RNA encoded by a nucleic acid associated with PD, in those instances where the genetic variation of the present disclosure results in a change in the expression, localization, binding partners, and/or composition of the polypeptide and/or RNA. In some embodiments, screening can comprise diagnosing a subject. In some embodiments, screening can comprise determining a prognosis of a subject, for example, determining the susceptibility of developing PD. In some embodiments, screening can comprise theranosing a subject.

The genetic variations described herein that show association to PD can play a role through their effect on one or more of these nearby genes. For example, while not intending to be limited by theory, it is generally expected that a deletion of a chromosomal segment comprising a particular gene, or a fragment of a gene, can either result in an altered composition or expression, or both, of the encoded protein and/or mRNA. Likewise, duplications, or high number copy number variations, are in general expected to result in increased expression of encoded polypeptide and/or RNA if the duplication encompasses the whole gene. It is also known to those skilled in the art that segments of DNA can be duplicated, triplicated, quadruplicated, or amplified many times and result in increasingly higher levels of expression of the gene if it is encompassed by these multiplicated segments of DNA. Those skilled in the art also know that one or both breakpoints of a duplication or other level of amplification can disrupt a gene and thus result in loss of function, such as the expressed protein encoded by the transcript is truncated. Further, those skilled in the art anticipate that an amplified segment of DNA can occur in tandem (e.g., multiple gene copies adjacent to each other on the chromosome) or can insert into a site far away from the original chromosomal location or even on another chromosome. Thus, in some cases a gene not contained within the amplified segment of DNA is impacted by the chromosomal rearrangement. Such complex rearrangements can be mapped, for example, by fluorescence in situ hybridization (FISH) methods. Other possible mechanisms affecting genes within or near a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplified genomic DNA, or indirectly, using RNA or DNA obtained from the subject's tissue(s) that are present in an aberrant form or expression level as a result of the genetic variations of the disclosure showing association to PD.

In some embodiments, the genetic variations of the disclosure showing association to PD can affect the expression of a gene within the genetic variation region. Certain genetic variation regions can have flanking duplicated segments, and genes within such segments can have altered expression and/or composition as a result of such genomic alterations. It is also well known that regulatory elements affecting gene expression can be located far away, even as far as tens or hundreds of kilobases away, from the promoter region of a gene. Thus, regulatory elements for genes that are located outside the genetic variation region can be located within the genetic variation, and thus affect the expression of genes located outside the genetic variation. It is thus contemplated that the detection of the genetic variations described herein, can be used for assessing expression for one or more of associated genes.

In some embodiments, genetic variations of the disclosure showing association to PD can affect protein expression at the translational level. It can be appreciated by those skilled in the art that this can occur by increased or decreased expression of one or more microRNAs (miRNAs) that regulates expression of a protein known to be important, or implicated, in the cause, onset, or progression of PD. Increased or decreased expression of the one or more miRNAs can result from gain or loss of the whole miRNA gene, disruption of a portion of the gene (e.g., by an indel or CNV), or even a single base change (SNP or SNV) that produces an altered, non-functional or aberrant functioning miRNA sequence. It can also be appreciated by those skilled in the art that the expression of protein, for example, one known to cause EN by increased or decreased expression, can result due to a genetic variation that results in alteration of an existing miRNA binding site within the protein's mRNA transcript, or even creates a new miRNA binding site that leads to aberrant protein expression.

A variety of methods can be used for detecting protein composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test sample from a subject can be assessed for the presence of an alteration in the expression and/or an alteration in composition of the polypeptide encoded by a nucleic acid associated with PD. An "alteration" in the polypeptide expression or composition, as used herein, refers to an alteration in expression or composition in a test sample, as compared to the expression or composition of the polypeptide in a control sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening for PD can be made by detecting a particular splicing variant encoded by a nucleic acid associated with PD, or a particular pattern of splicing variants.

Antibodies can be polyclonal or monoclonal and can be labeled or unlabeled. An intact antibody or a fragment thereof can be used. The term "labeled", with regard to the probe or antibody, is intended to encompass direct labeling of the probe or antibody by coupling a detectable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Detecting Genetic Variations Associated with Parkinson's Disease

Described herein, are methods that can be used to detect genetic variations. Detecting specific genetic variations, for example, polymorphic markers and/or haplotypes, copy number, absence or presence of an allele, or genotype associated with PD as described herein, can be accomplished by methods known in the art for analyzing nucleic acids and/or detecting sequences at polymorphic or genetically variable sites, for example, amplification techniques, hybridization techniques, sequencing, arrays, or any combination thereof. Thus, by use of these methods disclosed herein or other methods available to the person skilled in the art, one or more alleles at polymorphic markers, including microsatellites, SNPs, CNVs, or other types of genetic variations, can be identified in a sample obtained from a subject.

Nucleic Acids

The nucleic acids and polypeptides described herein can be used in methods and kits, arrays or panels of the present disclosure. In some embodiments, aptamers that specifically bind the nucleic acids and polypeptides described herein can be used in methods and kits, arrays or panels of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example, a translated gene, or non-coding, for example, a regulatory region, or any fragments, derivatives, mimetics or complements thereof. In some embodiments, nucleic acids can comprise oligonucleotides, nucleotides, polynucleotides, nucleic acid sequences, genomic sequences, antisense nucleic acids, DNA regions, probes, primers, genes, regulatory regions, introns, exons, open-reading frames, binding sites, target nucleic acids and allele-specific nucleic acids.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein Such nucleic acid sequences can be detected and/or isolated by allele- or sequence-specific hybridization (e.g., under high stringency conditions). Stringency conditions and methods for nucleic acid hybridizations are well known to the skilled person (see, e.g., *Current Protocols in Molecular Bioloav*, Ausubel, F. et al., John Wiley & Sons, (1998), and Kraus, M. and Aaronson, S., *Methods Enzymol* 200:546 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e., % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, and Altschul, *Proc. Natl. Acad. Sci. USA,* 90:5873 (1993). Such an algorithm is incorporated into the NBLAST and XBLAST programs (version 2.0), as described in Altschul et al., *Nucleic Acids Res.,* 25:3389 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In some embodiments, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. It can be appreciated by those skilled in the art that probes for detection of amplified or unamplified nucleic acid molecules can also include an Invader oligonucleotide and probe pair. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the compliments thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In one embodiment, a nucleic acid probe can be an oligonucleotide capable of hybridizing with a complementary region of a gene associated with PD containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained fallowing in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), copy number variations (CNVs), for example, insertions, deletions, inversions, and translocations. In some embodiments, nucleic acids can comprise analogs, for example, phosphorothioates, phosphoramidates, methyl phosphonate, chiral methyl phosphonates, 2-O-methyl ribonucleotides, or modified nucleic acids, for example, modified backbone residues or linkages, or nucleic acids combined with carbohydrates, lipids, protein or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm.nih.gov). In some embodiments, a reference sequence can be determined by a practitioner of the present disclosure using methods well known in the art, for example, by sequencing a reference nucleic acid.

In some embodiments, a probe can hybridize to an allele, SNP, or CNV as described herein. In some embodiments, the probe can bind to another marker sequence associated with PD as described herein.

One of skill in the art would know how to design a probe so that sequence specific hybridization can occur only if a particular allele is present in a genomic sequence from a test sample. The disclosure can also be reduced to practice using any convenient genotyping method, including commercially available technologies and methods for genotyping particular genetic variations.

Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detectable label. A detectable label can comprise any label capable of detection by a physical, chemical, or a biological process for example, a radioactive label, such as 32P or 3H, a fluorescent label, such as FITC, a chromophore label, an affinity-ligand label, an enzyme label, such as alkaline phosphatase, horseradish peroxidase, or 12 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, an electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling.

Non-limiting examples of label moieties useful for detection include, without limitation, suitable enzymes such as horseradish peroxidase, alkaline phosphatase, beta-galactosidase, or acetylcholinesterase; members of a binding pair that are capable of forming complexes such as streptavidin/biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include 14C, 1231, 1241, 1251, Tc99m, 32P, 33P, 35S or 3H.

Other labels can also be used in the methods of the present disclosure, for example, backbone labels. Backbone labels comprise nucleic acid stains that bind nucleic acids in a sequence independent manner. Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red).

In some embodiments, fluorophores of different colors can be chosen, for example, 7-amino-4-methylcoumarin-3-acetic acid (AMCA), 5-(and-6)-carboxy-X-rhodamine, lissamine rhodamine B, 5-(and-6)-carboxyfluorescein, fluorescein-5-isothiocyanate (FITC), 7-diethylaminocoumarin-3-carboxylic acid, tetramethylrhodamine-5-(and-6)-isothiocyanate, 5-(and-6)-carboxytetramethylrhodamine, 7-hydroxycoumarin-3-carboxylic acid, 6-[fluorescein 5-(and-6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE blue acetylazide, such that each probe in or not in a set can be distinctly visualized. In some embodiments, fluorescently labeled probes can be viewed with a fluorescence microscope and an appropriate filter for each fluorophore, or by using dual or triple band-pass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}P$ and/or $^{3}H$. As a non-limiting example, a probe indirectly labeled with biotin can be detected by avidin conjugated to a detectable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, nucleic acid based sequence amplification (NASBA), and multiplex ligation-dependent probe amplification (MLPA). Guidelines for selecting primers for PCR amplification are well known, in the art. In some embodiments, a computer program can be used to design primers, for example, Oligo (National Biosciences, Inc., Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader; Third Wave/Hologic). PCR can be a procedure in which target nucleic acid is amplified in a manner similar to that described in U.S. Pat. No. 4,683,195 and subsequent modifications of the procedure described therein. In some embodiments, real-time quantitative PCR can be used to determine genetic variations, wherein quantitative PCR can permit both detection and quantification of a DNA sequence in a sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a sample containing genomic DNA obtained from the subject can be collected and PCR can used to amplify a fragment of nucleic acid that comprises one or more genetic variations that can be indicative of a susceptibility to PD. In some embodiments, detection of genetic variations can be accomplished by expression analysis, for example, by using quantitative PCR. In some embodiments, this technique can assess the presence of an alteration in the expression or composition of one or more polypeptides or splicing variants encoded by a nucleic acid associated with PD.

In one embodiment, the DNA template of a sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA. In one embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid containing sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the sample, the sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker allele of a particular haplotype, for example, a probe can contain alleles complementary to 2, 3, 4, 5 or all of the markers that make up a particular haplotype. In some embodiments detection of one or more particular markers of the haplotype in the sample is indicative that the source of the sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed, as described by Kutyavin et al. (*Nucleic Acid Res.* 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In one embodiment sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, SOLiD sequencing, on semiconductor sequencing, DNA nanoball sequencing, Helioscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In some embodiments, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarily at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments; restriction fragment length polymorphism (RFLP) analysis can be conducted, wherein the digestion pattern of the relevant DNA fragment indicates the presence or absence of the particular genetic variation in the sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of the genetic variation, for example, one or more SNPs, microsatellites, or CNVs, as described herein, to determine or identify an allele or genotype. For example, the array can include one or more nucleic acid probes that can be used to detect a genetic variation associated with a gene and/or product of a gene listed in FIGS. 8-11. In some embodiments, the array can further comprise at least one area that includes a nucleic acid probe that can be used to specifically detect another marker associated with PD, as described herein.

Microarray hybridization can be performed by hybridizing a nucleic acid of interest, for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier et al., *Adv. Biochem. Eng. Biotechnol.*, 109:433 (2008); Hoheisel, *Nat. Rev. Genet.*, 7: 200 (2006); Fan et al., *Methods Enzymol.*, 410:57 (2006); Raqoussis & Elvidge, Expert Rev. Mol. Design, 6: 145-52 (2006); Mockler et al., *Genomics*, 85:1 (2005), and references cited therein, the entire teachings of each of which are incorporated by reference herein). Many additional descriptions of the preparation and use of oligonucleotide arrays for detection of polymorphisms can be found, for example, in U.S. Pat. Nos. 6,858,394; 6,429,027; 5,445,934; 5,700,637; 5,744,305; 5,945,334; 6,054,270; 6,300,063; 6,733,977; 7,364,858, EP 619 321, and EP 373 203, the entire teachings of which are incorporated by reference herein. Methods for array production, hybridization, and analysis are also described in Snijders et al., *Nat. Genetics*, 29:263 (2001); Klein et al., *Proc. Natl. Acad. Sci. USA*, 96:4494 (1999); Albertson et al., *Breast Cancer Research and Treatment*, 78:289 (2003); and Snijders et al., "BAC microarray based comparative genomic hybridization," in: Zhao et al. (eds) *Bacterial Artificial Chromosomes: Methods and Protocols, Methods in Molecular Biology*, Humana Press, 2002.

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily be designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a sample, and detecting binding of a nucleic acid from the sample to the array. In some embodiments, the method can comprise amplifying nucleic acid from the sample, for example, a region associated with PD or a region that includes another region associated with PD. In some embodiments, the methods described herein can include using an array that can identify differential expression patterns or copy numbers of one or more genes in samples from control and affected individuals. For example, arrays of probes to a marker described herein can be used to identify genetic variations between DNA from an affected subject, and control DNA obtained from an individual that does not have PD. Since the nucleotides on the array can contain sequence tags, their positions on the array can be accurately known relative to the genomic sequence.

In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein.

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as NimbleGen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, qPCR, or fluorescence in situ hybridization. In one embodiment, Array Comparative Genomic Hybridization (aCGH) methods can be used. As described herein, karyotype analysis can be a method to determine the content and structure of chromosomes in a sample. In some embodiments, karyotyping can be used, in lieu of aCGH, to detect translocations, which can be copy number neutral (balanced translocations), and therefore, not detectable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (*J. Nature Methods*, 5:447 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present disclosure include, but are not limited to quantitative PCR, real-time quantitative PCR (qPCR), quantitative fluorescent PCR (QF-PCR), multiplex fluorescent PCR (MF-PCR), real time PCR (RT-PCR), single cell PCR, PCR-RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid based sequence amplification (NABSA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In some embodiments, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In some embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al., Nature, 15:437(7057):376-80 (2005), and as well as in US Publication Application Nos. 20020012930; 20030068629; 20030100102; 20030148344; 20040248161; 20050079510, 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. Nos. 6,300,063, 5,837,832, 6,969,589, 6,040,138, 6,858,412, U.S. application Ser. No. 08/529,115, U.S. application Ser. No. 10/272, 384, U.S. application Ser. No. 10/045,575, U.S. application Ser. No. 10/264,571 and U.S. application Ser. No. 10/264,574. It should be noted that there are also distinct differences such as target and probe complexity, stability of DNA over RNA, the presence of repetitive DNA and the need to identify single copy number alterations in genome profiling.

In one embodiment, the genetic variations detected comprise CNVs and may be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al, Nat. Genet., 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome amplification methods prior to CGH analysis of the sample.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a higher stringency than for other microarray technologies. Note that technical details are extremely important and different implementations of methods using the same array CGH approach can yield different levels of performance. Various CGH methods are known in the art and are equally applicable to one or more methods of the present disclosure. For example, CGH methods are disclosed in U.S. Pat. Nos. 7,957,913, 7,910,353, 7,238,484, 7,702,468, 7,034,144; 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many samples. The advent of array CGH technology makes it possible to monitor DNA copy number changes on a genomic scale and many projects have been launched for studying the genome in specific diseases.

In one embodiment, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al., Science, 258:818 (1992)) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from test and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the test genome. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP) PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cot1-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as about 3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-4 million unique features/probes per microarray, which can include microarrays available from Roche NimbleGen and Agilent Technologies. In addition to array CGH methods for copy number detection, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybridizing a single test genome against a pooled sample of two or more genomes, which can result in minimizing the detection of higher frequency variants in the experiment. In some embodiments, a test genome can be hybridized alone (e.g., one-color detection) to a microarray, for example, using array CGH or SNP genotyping methods, and the comparison step to one or more reference genomes can be performed in silico to reveal the set of CNVs in the test genome relative to the one or more reference genomes. In one embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one embodiment is comprised of individuals or subjects that are apparently healthy (normal). Methods employed for such analyses are described in U.S. Pat. Nos. 7,702,468 and 7,957,913. In some embodiments of CNV comparison methods, candidate genes that are causative or associated (i.e., potentially serving as a biomarker) with a phenotype, condition, or disease will be identified by CNVs that occur in the affected cohort but not in the unaffected cohort, or present at much lower frequency in the unaffected cohort as compared to the affected cohort. In another embodiment of CNV comparison methods, one or more CNVs may be present at much higher frequency in the unaffected cohort as compared to the affected cohort and thus may be indicative of protection for development of the disease or condition present in the affected cohort. In some embodiments of CNV comparison methods, candidate genes that are causative or associated (i.e., potentially serving as a biomarker) with a phenotype, condition, or disease will be identified by CNVs that occur at a statistically significant higher frequency in the affected cohort as compared their frequency in the unaffected cohort. Thus, CNVs detected in the affected cohort as compared to the unaffected cohort can serve as beacons of genes that are causative or associated with a particular phenotype, condition, or disease. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest.

Due to the large amount of genetic variation between any two genomes, or two sets (cohorts) of genomes, being compared, one embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (e.g., potentially serving as a biomarker) with a phenotype, condition, or disease. It can be appreciated by those skilled in the art that the targeted sequencing experiments can be performed in both the affected and unaffected cohorts in order to identify the genetic variants (e.g., SNVs and indels) that occur only, or at a statistically significant higher frequency, in the affected individual or cohort as compared to the unaffected cohort. In another embodiment, the targeted sequencing experiments can be performed on the affected cohort and the variations found can be compared to public or private databases containing sequence variants present in unaffected subjects, or in some embodiments, the general population.

When investigating PD, it can be appreciated by those skilled in the art that the number of PD candidate genes (or regulatory sequences) identified via CNV (or other variant types) detection methods may increase or decrease when additional PD cohorts are analyzed. Similarly, the number of PD candidate genes (or regulatory sequences), for example, identified via CNV (or other variant types) detection methods may increase or decrease when additional unaffected cohorts are used to interpret the affected cohort CNVs (or other variant types). For very rare CNVs (e.g., <0.1% frequency in the general population), only a single case may be observed in a given PD cohort (e.g., 100 cases) but further statistical significance or evidence for the gene (or regulatory sequence/locus in the genome) can be established by: 1) CNV analysis of additional PD cohorts, 2) CNV analysis of additional Normal cohorts, 3) targeted gene sequencing of both PD and Normal cohorts, and/or 4) functional characterization of the PD candidate gene (e.g., in silico analysis of the predicted impact of the candidate mutation on the gene product, RNAi knockdown experiments, biochemical assays on PD patient tissue, gene expression analysis of disease-relevant tissues or of induced pluripotent stem cells (iPSCs) created from the PD patient(s) harboring the candidate PD-causing genetic variant).

It can be appreciated by those skilled in the art that a candidate gene may validate as causative of the phenotype, condition, or disease (e.g., PD), which may, for example, be confirmed via mechanism of action experiments, or it may serve as a biomarker of the phenotype, condition, or disease. Thus, in the example of PD, in some embodiments, the PD-specific gene (or regulatory sequence/locus) may be a biomarker of age-of-onset for PD and disease severity, and thus have diagnostic utility for monitoring patients known to be at risk for PD or as a general screening test in the population for early diagnosis of the disease. In some embodiments, the PD-specific gene/biomarker may be an indicator of drug response (e.g., a particular subtype of PD may respond best to a therapeutic targeting a particular phenotype, causative gene, or other gene in the same pathway as the causative gene) and thus have utility during drug development in clinical trials. For example, clinical trials for a therapeutic that targets a PD genetic subtype comprising only 10% of all patients exhibiting symptoms of PD, can be designed to comprise only those 10% of patients with a specific genotype(s) in order to reduce the time and cost of such clinical trials (e.g., smaller number of patients in the clinical trial). It can be appreciated by those skilled in the art that such patient stratification methods (i.e., specific genotypes correlated with the disease or drug response) can be employed not only for targeted therapeutics, but in general for any drug that is approved or in development (i.e., the mechanism of action may or may not be known). For example, drugs in development or approved to treat, for example, cancer, may have utility in being repurposed to treat PD. Such patient stratification methods can also be utilized to develop a companion diagnostic test (e.g., comprising the specific genes/genotypes found in patients that are indicative of drug response) for a particular drug, either concurrently during the clinical trials for the drug or after drug approval (e.g., as a new indication or for the physician to use in guiding medical decisions for the patient).

Further links to PD pathology may be established via pathway analysis of the genes, which may take into consideration binding interactions (e.g., via yeast 2-hybrid screen) and molecular events (e.g., kinase activity or other enzymatic processes) if such information is available for the gene(s) of interest (e.g., specified in the analysis). Both commercial (e.g., Ingenuity's IPA software and Thomson Reuter's GeneGo software) and open source software (e.g., String: string-db.org/) are available for such analyses. To assess connections to established PD biology, analyses can be performed for the set of candidate PD genes independently or against known causative PD genes singly or as a group. For example, see FIG. 10.

A method of screening a subject for a disease or disorder can comprise assaying a nucleic acid sample from the subject to detect sequence information for more than one genetic loci and comparing the sequence information to a panel of nucleic acid biomarkers and screening the subject for the presence or absence of PD if one or more of low frequency biomarkers in the panel are present in the sequence information. The panel may comprise at least one nucleic acid biomarker for each of the more than one genetic loci. For example, the panel can comprise 2, 3, 4, 5, 6, 7, 8, 9, 10, 15, 20, 25, 30, 35, 40, 45, 50, 75, 100, 150, 200 or more nucleic acid biomarkers for each of the more than one genetic loci. The panel may comprise at least 25 low frequency biomarkers. For example, the panel can comprise at least 30, 35, 40, 45, 50, 55, 60, 65, 70, 75, 80, 85, 90, 95, 100, 135, 150, 175, 200, 250, 500, or 1000 or more low frequency biomarkers. A low frequency biomarker can occur at a frequency of 0.1% or less in a population of subjects without a diagnosis of the disease or disorder. For example, a low frequency biomarker can occur at a frequency of 0.05%, 0.01%, 0.005%, 0.001%, 0.0005%, 0.0001%, 0.00005%, or 0.00001% or less in a population of subjects without a diagnosis of the disease or disorder.

In some embodiments, the presence or absence of PD in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence.

In one embodiment, PD candidate CNV subregions and genes associated with these regions may be determined or identified by comparing genetic data from a cohort of normal individuals (NVE) to that of a cohort of individuals known to have, or be susceptible to PD.

In some embodiments, genomic DNA samples from individuals within a NVE cohort and/or a PD cohort can be considered test subject DNA samples and hybridized against one or more, sex-matched reference DNA samples from individuals. For example, reference DNA samples can be labeled with a fluorophore such as Cy5, using methods described herein, and test subject DNA samples can be labeled with a different fluorophore, such as Cy3. After labeling, samples can be combined and can be co-hybridized to a microarray and analyzed using any of the methods described herein, such as aCGH. Arrays can then be scanned and the data can be analyzed with software. Genetic alterations, such as CNVs, can be called using any of the methods described herein. A list of the genetic alterations, such as CNVs, can be generated for each cohort. The list of CNVs can be used to generate a master list of non-redundant CNVs and/or CNV subregions for each cohort. The list can be based on the presence or absence of the CNV subregion in individuals within the cohort. In this manner, the master list can contain a number of distinct CNV subregions, some of which are uniquely present in a single individual and some of which are present in multiple individuals.

In some embodiments, CNV subregions of interest may be obtained by annotation of each CNV subregion with relevant information, such as overlap with known genes and/or exons. In some embodiments, CNV subregions of interest can be obtained by calculating the OR for a CNV subregion according to the following formula: OR=(PD/((# individuals in PD cohort)−PD))/(NVE/((# individuals in NVE cohort)−NVE)), where: PD=number of PD individuals with a CNV subregion of interest and NVE=number of NVE individuals with the CNV subregion of interest. If NVE=0, it can be set to 1 to avoid dealing with infinities in cases where no CNVs are seen in the NVE.

The number of individuals in any given cohort may be at least about 10, 50, 100, 200, 300, 400, 500, 600, 700, 800, 900, 1000, 2500, 5000, 7500, 10,000, 100,000, or more.

In some embodiments, a CNV subregion/gene can be of interest if the CNV subregion overlaps a known gene, and is associated with an OR of at least 6, e.g., at least 35. For example, a CNV subregion/gene can be of interest if the CNV subregion overlaps a known gene, and is associated with an OR of at least 7, 8, 9, 10, 12, 14, 16, 18, 20, 25, 30, 35, 40, 45, 50, or more. In some embodiments, a CNV subregion/gene can be of interest if the CNV subregion overlaps a known gene, and is associated with an OR from about 6-100, 6-50, 6-40, 6-30, 6-20, 6-10, 6-9, 6-8, 6-7, 8-100, 8-50, 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7. The CNV subregion/gene can be an exonic or intronic part of the gene, or both.

In some embodiments, a CNV subregion/gene can be of interest if the CNV subregion does not overlap a known gene (e.g., is non-genic or intergenic) and is associated with an OR of at least 4 or higher. For example, a CNV subregion/gene can be of interest if the CNV subregion does not overlap a known gene (e.g., is non-genic or intergenic) and is associated with an OR of at least 5, 6, 7, 9, 9, 10, 12, 14, 16, 18, 20, 25, 30, 35, 40, 45, 50, or more. In some embodiments, a CNV subregion/gene can be of interest if the CNV subregion does not overlap a known gene (e.g., is non-genic or intergenic) and is associated with an OR from about 5-100, 5-50, 5-40, 5-30, 5-20, 20-100, 20-50, 20-40, 20-30, 30-100, 30-50, 30-40, 40-100, 40-50, 50-100, or 9-11.

In some embodiments, a CNV subregion/gene can be of interest based on the OR associated with the sum of PD cases and the sum of NVE cases affecting the same gene (including distinct CNV subregions). For example, a CNV subregion/gene can be of interest if the OR associated with the sum of PD cases and the sum of NVE cases affecting the same gene (including distinct CNV subregions) is at least 4, 5, 6, 7, 8, 9, 10, 12, 14, 16, 18, 20, 25, 30, 35, 40, 45, 50, or more. In some embodiments, a CNV subregion/gene can be of interest if the OR associated with the sum of PD cases and the sum of NVE cases affecting the same gene (including distinct CNV subregions) is from about 4-100, 4-50, 4-40, 4-30, 4-20, 4-10, 4-9, 4-8, 4-7, 8-100, 8-50, 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7.

Computer-Implemented Aspects

As understood by those of ordinary skill in the art, the methods and information described herein (genetic variation association with PD) can be implemented, in all or in part, as computer executable instructions on known computer readable media. For example, the methods described herein can be implemented in hardware. Alternatively, the method can be implemented in software stored in, for example, one or more memories or other computer readable medium and implemented on one or more processors. As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transportable computer storage mechanism.

The steps of the claimed methods can be operational with numerous other general purpose or special purpose computing system environments or configurations. Examples of well-known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-executable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transportable computer storage mechanism or over a communication channel, for example a telephone line, the internet, or wireless communication. Modifications and variations can be made in the techniques and structures described and illustrated herein without departing from the spirit and scope of the present disclosure.

PD Therapeutics

There is no cure for Parkinson's disease, but medications, surgery and multidisciplinary management can provide relief from the symptoms. Therapeutic options include L-dopa/DDC-inhibitors, COMT-inhibitors, e.g., entacapone or tolcapone, MAO-B-inhibitors, e.g., selegiline or rasagiline, NMDA-antagonists, e.g., amantadine or budipin, ergolin dopamine-agonists, e.g., bromocriptine, cabergoline, α-dihydroergocriptine, lisuride or pergolide, non-ergolin dopamine-agonists, e.g., apomorphine, piribedil, pramipexole, ropinirole or rotigotine, anti-depressives, e.g., SSRI (such as mirtazapine), anti-psychotics, e.g., neuroleptics (clozapine or quetiapine), anti-dementia agents, e.g., AChEI (donepezil, rivastigmine, galantamine) or NMDA-antagonists (e.g., memantine), as well as pardoprunox (SLV 308), which is a partial $D_{2/3}$agonist and full $5HT_{1A}$agonist, safinamide (PNU 151774E) which is a MAO-B/DA-reuptake/Glu-release inhibitor, AFQ056, which is a metabotropic-glutamate-receptor 5 antagonist, perampanel (E2007), which is a AMPA-glutamate-receptor antagonist, istradefylline (KW-6002), which is an adenosine A2a-receptor-antagonist or pitolisant (BF 2.649), which is histamine H3-antagonist. As disclosed herein, therapeutic options may be matched to each PD case based on one or more genetic variations, e.g., one or more CNVs, in each patient.

Thus, PD patients having a particular genetic variation may benefit from specific disease modifying therapies. For example for motor fluctuations, ACR 325, a dopamine-receptor stabilizer, AP09004 (safety), a dual release gastric retentive, or XP21279, an L-dopa prodrug absorbed in the colon; for motor dysfunction, exenatide, a glucose metabolism/insulin regulator, nicotine, a nicotinic acetylcholine receptor agonist, PYM50028, an oral neurotrophic factor-inducing drug or V1512 (levodopa methylester+carbidopa) may be useful or have improved efficacy in PD patients having a particular genetic variation. Others include caffeine, an adenosine receptor antagonist, for excessive daytime somnolence, fipamezole, an alpha-2 adrenergic antagonist, for orthostatic hypotension/LID. Also for motor dysfunction, IPX066, an extended-release carbidopa-1-dopa, preladenant; for motor fluctuations, treating *H. Pylori* and apomorphinenasal powder/nasal spray; for depression, citalopram, paroxetine or venlafaxine; for early cognitive impairment, donepezil (early dementia) or piribedil (vigilance and cognitive functions, may be useful or have improved efficacy in PD patients having a particular genetic variation. Others include eszopiclone for insomnia, pimavanserintartrate (ACP-103) for psychosis, rivastigmine for apathy without dementia, desmopressin for nocturnal micturition frequency, lubiprostone for constipation, memantine for gait disorders and attention deficit, naltrexone for impulse control disorders, rasagiline for apathy, rasagiline for depression, rasagiline for hyposmia, rasagiline for sleep disturbances, and rivastigmine for dementia.

The main families of drugs useful for treating motor symptoms are dopamine oriented including levodopa (usually combined with a dopa decarboxylase inhibitor or COMT inhibitor), direct dopamine agonists, COMT inhibitor and MAO-B inhibitors. The stage of the disease determines which group is most useful. Two stages are usually distinguished: an initial stage in which the individual with PD has already developed some disability for which he needs pharmacological treatment, then a second stage in which an individual develops motor complications related to levodopa usage. Treatment in the initial stage aims for an optimal tradeoff between good symptom control and side-effects resulting from enhancement of dopaminergic function. The start of levodopa (or L-DOPA) treatment may be delayed by using other medications such as MAO-B inhibitors and dopamine agonists, in the hope of delaying the onset of dyskinesias. In the second stage the aim is to reduce symptoms while controlling fluctuations of the response to medication. Sudden withdrawals from medication or overuse have to be managed. When medications are not enough to control symptoms, surgery and deep brain stimulation can be of use. In the final stages of the disease, palliative care is provided to enhance quality of life.

Levodopa has been the most widely used treatment for over 30 years. L-DOPA is converted into dopamine in the dopaminergic neurons by dopa decarboxylase. Since motor symptoms are produced by a lack of dopamine in the substantia nigra, the administration of L-DOPA temporarily diminishes the motor symptoms. Only 5-10% of L-DOPA crosses the blood-brain barrier. The remainder is often metabolized to dopamine elsewhere, causing a variety of side effects including nausea, dyskinesias and joint stiffness. Carbidopa and benserazide are peripheral dopa decarboxylase inhibitors, which help to prevent the metabolism of L-DOPA before it reaches the dopaminergic neurons, therefore reducing side effects and increasing bioavailability. They are generally given as combination preparations with levodopa. Existing preparations are carbidopa/levodopa (co-careldopa) and benserazide/levodopa (co-beneldopa). Levodopa has been related to dopamine dysregulation syndrome, which is a compulsive overuse of the medication, and punding. There are controlled release versions of levodopa in the form intravenous and intestinal infusions that spread out the effect of the medication. These slow-release levodopa preparations have not shown an increased control of motor symptoms or motor complications when compared to immediate release preparations.

Tolcapone inhibits the COMT enzyme, which degrades dopamine, thereby prolonging the effects of levodopa. It has been used to complement levodopa; however, its usefulness is limited by possible side effects such as liver damage. A similarly effective drug, entacapone, has not been shown to cause significant alterations of liver function. Licensed preparations of entacapone contain entacapone alone or in combination with carbidopa and levodopa.

Levodopa preparations lead in the long term to the development of motor complications characterized by involuntary movements called dyskinesias and fluctuations in the response to medication. When this occurs a person with PD can change from phases with good response to medication and few symptoms ("on" state), to phases with no response to medication and significant motor symptoms ("off" state). For this reason, levodopa doses are kept as low as possible while maintaining functionality. Delaying the initiation of therapy with levodopa by using alternatives (dopamine agonists and MAO-B inhibitors) is common practice. A former strategy to reduce motor complications was to withdraw L-DOPA medication for some time. This is discouraged now, since it can bring dangerous side effects such as neuroleptic malignant syndrome. Most people with PD eventually need levodopa and later develop motor side effects.

Several dopamine agonists that bind to dopaminergic post-synaptic receptors in the brain have similar effects to levodopa. These were initially used for individuals experiencing on-off fluctuations and dyskinesias as a complementary therapy to levodopa; they are now mainly used on their own as an initial therapy for motor symptoms with the aim of delaying motor complications. When used in late PD they are useful at reducing the off periods. Dopamine agonists include bromocriptine, pergolide, pramipexole, ropinirole, piribedil, cabergoline, apomorphine and lisuride.

Dopamine agonists produce significant, although usually mild, side effects including drowsiness, hallucinations, insomnia, nausea and constipation. Sometimes side effects appear even at a minimal clinically effective dose, leading the physician to search for a different drug. Compared with levodopa, dopamine agonists may delay motor complications of medication use but are less effective at controlling symptoms. Nevertheless, they are usually effective enough to manage symptoms in the initial years. They tend to be more expensive than levodopa. Dyskinesias due to dopamine agonists are rare in younger people who have PD, but along with other side effects, become more common with age at onset. Thus dopamine agonists are the preferred initial treatment for earlier onset, as opposed to levodopa in later onset. Agonists have been related to impulse control disorders (such as compulsive sexual activity and eating, and pathological gambling and shopping) even more strongly than levodopa.

Apomorphine, a non-orally administered dopamine agonist, may be used to reduce off periods and dyskinesia in late PD. It is administered by intermittent injections or continuous subcutaneous infusions. Since secondary effects such as confusion and hallucinations are common, individuals receiving apomorphine treatment should be closely monitored. Two dopamine agonists that are administered through skin patches (lisuride and rotigotine) have been recently found to be useful for patients in initial stages and preliminary positive results has been published on the control of off states in patients in the advanced state.

MAO-B inhibitors (selegiline and rasagiline) increase the level of dopamine in the basal ganglia by blocking its metabolism. They inhibit monoamine oxidase-B (MAO-B) which breaks down dopamine secreted by the dopaminergic neurons. The reduction in MAO-B activity results in increased L-DOPA in the striatum. Like dopamine agonists, MAO-B inhibitors used as monotherapy improve motor symptoms and delay the need for levodopa in early disease, but produce more adverse effects and are less effective than levodopa. There are few studies of their effectiveness in the advanced stage, although results suggest that they are useful to reduce fluctuations between on and off periods. An initial study indicated that selegiline in combination with levodopa increased the risk of death, but this was later disproven.

Other drugs such as amantadine and anticholinergics may be useful as treatment of motor symptoms. However, the evidence supporting them lacks quality, so they are not first choice treatments. In addition to motor symptoms, PD is accompanied by a diverse range of symptoms. A number of drugs have been used to treat some of these problems. Examples are the use of clozapine for psychosis, cholinesterase inhibitors for dementia, and modafinil for daytime sleepiness. A 2010 meta-analysis found that non-steroidal anti-inflammatory drugs (apart from acetaminophen and aspirin), have been associated with at least a 15 percent (higher in long-term and regular users) reduction of incidence of the development of Parkinson's disease.

Treating motor symptoms with surgery was once a common practice, but since the discovery of levodopa, the number of operations declined. Studies in the past few decades have led to great improvements in surgical techniques, so that surgery is again being used in people with advanced PD for whom drug therapy is no longer sufficient. Surgery for PD can be divided in two main groups: lesional and deep brain stimulation (DBS). Target areas for DBS or lesions include the thalamus, the globus pallidus or the subthalamic nucleus. Deep brain stimulation (DBS) is the most commonly used surgical treatment. It involves the implantation of a medical device called a brain pacemaker, which sends electrical impulses to specific parts of the brain. DBS is recommended for people who have PD who suffer from motor fluctuations and tremor inadequately controlled by medication, or to those who are intolerant to medication, as long as they do not have severe neuropsychiatric problems. Other, less common, surgical therapies involve the formation of lesions in specific subcortical areas (a technique known as pallidotomy in the case of the lesion being produced in the globus pallidus).

There is some evidence that speech or mobility problems can improve with rehabilitation, although studies are scarce and of low quality. Regular physical exercise with or without physiotherapy can be beneficial to maintain and improve mobility, flexibility, strength, gait speed, and quality of life. However, when an exercise program is performed under the supervision of a physiotherapist, there are more improvements in motor symptoms, mental and emotional functions, daily living activities, and quality of life compared to a self-supervised exercise program at home. In terms of improving flexibility and range of motion for patients experiencing rigidity, generalized relaxation techniques such as gentle rocking have been found to decrease excessive muscle tension. Other effective techniques to promote relaxation include slow rotational movements of the extremities and trunk, rhythmic initiation, diaphragmatic breathing, and meditation techniques. As for gait and addressing the challenges associated with the disease such as hypokinesia (slowness of movement), shuffling and decreased arm swing; physiotherapists have a variety of strategies to improve functional mobility and safety. Areas of interest with respect to gait during rehabilitation programs focus on but are not limited to improving gait speed, base of support, stride length, trunk and arm swing movement. Strategies include utilizing assistive equipment (pole walking and treadmill walking), verbal cueing (manual, visual and auditory), exercises (marching and PNF patterns) and altering environments (surfaces, inputs, open vs. closed). Strengthening exercises have shown improvements in strength and motor function for patients with primary muscular weakness and weakness related to inactivity with mild to moderate Parkinson's disease. However, reports show a significant interaction between strength and the time the medications was taken. Therefore, it is recommended that patients should perform exercises 45 minutes to one hour after medications, when the patient is at their best. Also, due to the forward flexed posture, and respiratory dysfunctions in advanced Parkinson's disease, deep diaphragmatic breathing exercises are beneficial in improving chest wall mobility and vital capacity. Exercise may improve constipation.

One of the most widely practiced treatments for speech disorders associated with Parkinson's disease is the Lee Silverman voice treatment (LSVT). Speech therapy and specifically LSVT may improve speech. Occupational therapy (OT) aims to promote health and quality of life by helping people with the disease to participate in as many of their daily living activities as possible. There have been few studies on the effectiveness of OT and their quality is poor, although there is some indication that it may improve motor skills and quality of life for the duration of the therapy.

Muscles and nerves that control the digestive process may be affected by PD, resulting in constipation and gastroparesis (food remaining in the stomach for a longer period of time than normal). A balanced diet, based on periodical nutritional assessments, is recommended and should be designed to avoid weight loss or gain and minimize consequences of gastrointestinal dysfunction. As the disease advances, swallowing difficulties (dysphagia) may appear. In such cases it may be helpful to use thickening agents for liquid intake and an upright posture when eating, both measures reducing the risk of choking. Gastrostomy to deliver food directly into the stomach is possible in severe cases.

Levodopa and proteins use the same transportation system in the intestine and the blood-brain barrier, thereby competing for access. When they are taken together, this results in a reduced effectiveness of the drug. Therefore, when levodopa is introduced, excessive protein consumption is discouraged and well balanced Mediterranean diet is recommended. In advanced stages, additional intake of low-protein products such as bread or pasta is recommended for similar reasons. To minimize interaction with proteins, levodopa should be taken 30 minutes before meals. At the same time, regimens for PD restrict proteins during breakfast and lunch, allowing protein intake in the evening. A person skilled in the art will appreciate and understand that the genetic variants described herein in general may not, by themselves, provide an absolute identification of individuals who can develop a ND or related conditions. The variants described herein can indicate increased and/or decreased likelihood that individuals carrying the at-risk or protective variants of the disclosure can develop symptoms associated with a ND. This information can be used to, for example, initiate preventive measures at an early stage, perform regular physical and/or mental exams to monitor the progress and/or appearance of symptoms, or to schedule exams at a regular interval to identify early symptoms, so as to be able to apply treatment at an early stage. This is in particular important since NDs and related disorders are heterogeneous disorders with symptoms that can be individually vague. Screening criteria can comprise a number of symptoms to be present over a period of time; therefore, it is important to be able to establish additional risk factors that can aid in the screening, or facilitate the screening through in-depth phenotyping and/or more frequent examination, or both. For example, individuals with early symptoms that typically are not individually associated with a clinical screening of a ND and carry an at-risk genetic variation can benefit from early therapeutic treatment, or other preventive measure, or more rigorous supervision or more frequent examination. Likewise, individuals that have a family history of the disease, or are carriers of other risk factors associated with a ND can, in the context of additionally carrying at least one at-risk genetic variation, benefit from early therapy or other treatment.

Early symptoms of behavioral disorders such as a ND and related conditions may not be sufficient to fulfill standardized screening criteria. To fulfill those, a certain pattern of symptoms and behavioral disturbance needs to manifest itself over a period of time. Sometimes, certain physical characteristics can also be present. This makes at-risk genetic variants valuable in a screening setting, in particular high-risk variants. Determination of the presence of such variants warrants increased monitoring of the individual in question. Appearance of symptoms combined with the presence of such variants facilitates early screening, which makes early treatment possible. Genetic testing can thus be used to aid in the screening of disease in its early stages, before all criteria for formal screening criteria are all fulfilled. It is well established that early treatment is extremely important for NDs and related disorders, which lends further support to the value of genetic testing for early diagnosis, prognosis, or theranosis of these disorders.

Disease modifying (neuroprotective therapies) that may be useful or have improved efficacy in PD patients having a particular genetic variation include those for oxidative stress, e.g., antioxidants (e.g., Vitamin E, Vitamin C, Fe chelators), for mitochondrial dysfunction, e.g., bioenergetics substances (e.g., CoQ10), for excitotoxicity, e.g., NMDA antagonists (e.g., MK801), for inflammation, e.g., anti-inflammatory substances (e.g., Cox 2 inhibitors), for protein-degradation, e.g., proteasomal enhancer, such as rapamycin, fpr neuronal dysfunction, e.g., trophic factors (for instance, GDNF, nurturing, neuregulin), and for apoptosis, anti-apoptotic substances (e.g., DA agonists, AKT, caspase inhibitors). See Table 4.

Table 4

TABLE 4

| Drug | Primary Mechanism | BBB (transverses blood brain barrier) |
|---|---|---|
| Ascorbic acid | Antioxidant | + |
| Amantadine | Glutamate antagonist | + |
| Aculenyl nitrone | Antioxidant | + |
| Caffeine | Andenosine antagonist | + |
| Coenzyme Q10 | Antioxidant/mitochondrial stabilizer | + |
| COX I-II inhibitors | Anti-inflammatory | + |
| Creatine | Mitochondrial stabilizer | + |
| Erythropoietin | U ndetermined/multiple | + |
| Estrogen | Undetermined/multiple | + |
| Folate | U ndetermined/multiple | + |
| GPI 1485 | Tophic factor | + |
| GM-1 ganglioside | Trophic factor | + |
| Minocycline | Anti-inflammatory/anti-apoptic | + |
| Modafanil | Unknown | + |
| N-acetyl cysteine | Antioxidant | + |
| Nicotine | Unknown | + |
| Pramipexole | Antioxidant/vesicular trafficking | + |
| Ropinirole | Antioxidant | + |
| Rasagiline | Anti-oxidant/anti-apoptotic | + |
| Remacemide | Glutamate antagonist | + |
| Selegeline | Antioxidant/anti-apoptotic | + |

Exemplary neuroprotective therapies include but are not limited to Coenzyme Q10, a mitochondrial enhancer, GPI 1485, a novel immunophilin compound, deferiprone, an iron chelator, green tea polyphenols, antioxidants, inosine, a nucleoside, isradipine, a calcium channel blocker, mitoquinone, a mitochondrial antioxidant, exenatide, a glucose metabolism/insulin regulator, paliroden (SR57667B), minocycline, a tetracycline, creatine, a dietary supplement, nicotine, a nicotinic acetylcholine receptor agonist, granulocyte-CSF, a hematopoietic growth factor, PYM50028, an oral neurotrophic factor inducer, sNN0031, intracerebroventricular platelet derived growth factor, SPM962, creatine, a dietary supplement, rasagiline, a monoamine oxidase-B inhibitor, ProSavin, a lentivector delivery system to transfer three genes, aromatic amino acid dopa decarboxylase, tyrosine hydroxylase and GTP-cyclohydrolase 1, to the striatum, reprogramming transduced cells to secrete dopamine, GAD-gene therapy, adeno-associated virus delivery of aglutamic acid decarboxylase gene to the subthalamic nucleus, CERE-120, an adeno-associated virus serotype 2 (AAV2) delivery of the gene for the neurotrophin neurturin, or stem cell therapy.

The present disclosure provides methods for matching compounds or agents and a subject having a ND and one or more specific genetic variations. The genetic variations and associated proteins of the disclosure are also useful as targets for the identification and/or development of therapeutic agents. In certain embodiments, such methods include assaying the ability of an agent or compound to modulate the activity and/or expression of a nucleic acid that is associated with at least one genetic variation described herein, encoded products of the gene sequence, and any other molecules or proteins associated with these genes. This in turn can be used to identify agents or compounds that inhibit, enhance, or alter the undesired activity, localization, binding and/or expression of the encoded nucleic acid product, such as mRNA or polypeptides. The genes associated with the CNVs are shown in FIGS. 10A-D. Assays for performing such experiments can be performed in cell-based systems or in cell-free systems, as known to the skilled person. Cell-based systems include cells naturally expressing the nucleic acids of interest, or recombinant cells that have been genetically modified so as to express a certain desired nucleic acid molecule.

Variant gene expression in a subject can be assessed by expression of a variant-containing nucleic acid sequence or by altered expression of a normal/wild-type nucleic acid sequence due to variants affecting the level or pattern of expression of the normal transcripts, for example variants in the regulatory or control region of the gene. Assays for gene expression include direct nucleic acid assays (mRNA), assays for expressed protein levels, or assays of collateral compounds involved in a pathway, for example a signal pathway. Furthermore, the expression of genes that are up- or down-regulated in response to the signal pathway can also be assayed. One embodiment includes operably linking a reporter gene, such as luciferase, to the regulatory region of one or more gene of interest.

Modulators of gene expression can in some embodiments be identified when a cell is contacted with a candidate compound or agent, and the expression of mRNA is determined. The expression level of mRNA in the presence of the candidate compound or agent is compared to the expression level in the absence of the compound or agent. Based on this comparison, candidate compounds or agents for treating a ND can be identified as those modulating the gene expression of the variant gene, or gene expression of one or more other genes occurring within the same biological pathway or known, for example, to be binding partners of the variant gene. When expression of mRNA or the encoded protein is statistically significantly greater in the presence of the candidate compound or agent than in its absence, then the candidate compound or agent is identified as a stimulator or up-regulator of expression of the nucleic acid. When nucleic acid expression or protein level is statistically significantly less in the presence of the candidate compound or agent than in its absence, then the candidate compound can be identified as an inhibitor or down-regulator of the nucleic acid expression. The disclosure further provides methods of treatment using a compound identified through drug (compound and/or agent) screening as a gene modulator.

The genetic variations described herein can be used to identify novel therapeutic targets for a ND. For example, genes containing, or in linkage disequilibrium with, the genetic variations, or their products, as well as genes or their products that are directly or indirectly regulated by or interact with these variant genes or their products, can be targeted for the development of therapeutic agents to treat a ND, or prevent or delay onset of symptoms associated with a ND. Therapeutic agents can comprise one or more of, for example, small non-protein and non-nucleic acids, proteins, peptides, protein fragments, nucleic acids (DNA, RNAJ, PNA (peptide nucleic acids)), or their derivatives or mimetics which can modulate the function and/or levels of the target genes or their gene products. In some embodiments, treatment of PD can comprise treatment of one of the genes, or gene products derived thereof, such as mRNA or a polypeptide, with one or more of the therapeutics disclosed herein. In some embodiments, treatment of PD can comprise treatment of 2 or 3, or 4, or 5, or 6, or 7, or 8, or 9, or 10 or more of the genes, or gene products derived there from, with 2 or 3, or 4, or 5, or 6, or 7, or 8, or 9, or 10 or more of the therapeutics disclosed herein.

RNA Therapeutics

The nucleic acids and/or variants of the disclosure, or nucleic acids comprising their complementary sequence, can be used as antisense constructs to control gene expression in cells, tissues or organs. The methodology associated with antisense techniques is well known to the skilled artisan, and is described and reviewed in Antisense Drug Technology: Principles, Strategies, and Applications, Crooke, Marcel Dekker Inc., New York (2001) In general, antisense nucleic acids are designed to be complementary to a region of mRNA expressed by a gene, so that the antisense molecule hybridizes to the mRNA, thus blocking translation of the mRNA into protein Several classes of antisense oligonucleotide are known to those skilled in the art, including cleavers and blockers. The former bind to target RNA sites, activate intracellular nucleases (e.g., Rnase H or Rnase L) that cleave the target RNA. Blockers bind to target RNA, inhibit protein translation by steric hindrance of the ribosomes. Examples of blockers include nucleic acids, morpholino compounds, locked nucleic acids and methylphosphonates (Thompson, *Drug Discovery Today,* 7:912 (2002)) Antisense oligonucleotides are useful directly as therapeutic agents, and are also useful for determining and validating gene function, for example by gene knock-out or gene knock-down experiments. Antisense technology is further described in Lavery et al., *Curr. Opin. Drug Discov. Devel.,* 6:561 (2003), Stephens et al. *Curr. Ooin. Mol Ther.,* 5:118 (2003), Kurreck, *Eur. J. Biochem.,* 270:1628 (2003), Dias et al, *Mol. Cancer Ter.,* 1:347 (2002), Chen, *Methods Mol. Med.,* 75:621 (2003), Wang et al., *Curr. Cancer Drug Targets,* 1:177 (2001), and Bennett, *Antisense Nucleic Acid Drug. Dev.,* 12:215 (2002).

The variants described herein can be used for the selection and design of antisense reagents that are specific for particular variants (e.g., particular genetic variations or polymorphic markers in linkage disequilibrium with particular genetic variations). Using information about the variants described herein, antisense oligonucleotides or other antisense molecules that specifically target mRNA molecules that contain one or more variants of the disclosure can be designed. In this manner, expression of mRNA molecules that contain one or more variants of the present disclosure (markers and/or haplotypes) can be inhibited or blocked. In some embodiments, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus protein expression, the molecules can be used to treat PD. The methodology can involve cleavage by means of ribozymes containing nucleotide sequences complementary to one or more regions in the mRNA that attenuate the ability of the mRNA to be translated. Such mRNA regions include, for example, protein-coding regions, in particular protein-coding regions corresponding to catalytic activity, substrate and/or ligand binding sites, or other functional domains of a protein.

The phenomenon of RNA interference (RNAi) has been actively studied for the last decade, since its original discovery in C. elegans (Fire et al., *Nature* 391:806 (1998)), and in recent years its potential use in treatment of human disease has been actively pursued (reviewed in Kim & Rossi, *Nature Rev. Genet.,* 8:173 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a protein-RNA complex to specific sites on a target mRNA, leading to cleavage of the mRNA (Thompson, *Drug Discovery Today,* 7:912 (2002)). The siRNA molecules are typically about 20, 21, 22 or 23 nucleotides in length. Thus, one aspect of the disclosure relates to isolated nucleic acid sequences, and the use of those molecules for RNA interference, for example as small interfering RNA molecules (siRNA). In some embodiments, the isolated nucleic acid sequences can be 18-26 nucleotides in length, or 19-25 nucleotides in length, or 20-24 nucleotides in length, or 21, 22 or 23 nucleotides in length.

Another pathway for RNAi-mediated gene silencing originates in endogenously encoded primary microRNA (pn-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, *Nature Rev. Genet.,* 8:173 (2007)).

Clinical applications of RNAi include the incorporation of synthetic siRNA duplexes, which are approximately 20-23 nucleotides in size, and may have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, such as about 27 nucleotides), as well as small hairpin RNAs (shRNAs; typically about 29 nucleotides in length). The latter are naturally expressed, as described in Amarzguioui et al. (*FEBS Lett.* 579:5974 (2005)). Chemically synthetic siRNAs and shRNAs are substrates for in vivo processing, and in some cases provide more potent gene-silencing than shorter designs (Kim et al., *Nature Biotechnol.*, 23:222 (2005); Siola et al., *Nature Biotechnol.*, 23:227 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the shRNA takes place (Marques et al., *Nature Biotechnol.*, 23:559 (2006), Brummelkamp et al., *Science,* 296:550 (2002)).

Since RNAi molecules, including siRNA, miRNA and shRNA, act in a sequence-dependent manner, variants described herein can be used to design RNAi reagents that recognize specific nucleic acids comprising specific genetic variations, alleles and/or haplotypes, while not recognizing nucleic acid sequences not comprising the genetic variation, or comprising other alleles or haplotypes. These RNAi reagents can thus recognize and destroy the target nucleic acid sequences. As with antisense reagents, RNAi reagents can be useful as therapeutic agents (i.e., for turning off disease-associated genes or disease-associated gene variants), but can also be useful for characterizing and validating gene function (e.g., by gene knock-out or gene knock-down experiments).

Delivery of RNAi can be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles Viral delivery methods include use of lentivirus, adenovirus and adeno-associated virus The siRNA molecules are in some embodiments chemically modified to increase their stability. This can include modifications at the 2' position of the ribose, including 2'-O-methylpunnes and 2'-fluoropyrimidmes, which provide resistance to RNase activity. Other chemical modifications are possible and known to those skilled in the art.

The following references provide a further summary of RNAi, and possibilities for targeting specific genes using RNAi: Kim & Rossi, *Nat. Rev. Genet.*, 8:173 (2007), Chen & Rajewsky, *Nat. Rev. Genet.* 8:93 (2007), Reynolds, et al., *Nat. Biotechnol.*, 22:326 (2004), Chi et al., *Proc. Natl. Acad. Sa. USA,* 100:6343 (2003), Vickers et al., *J. Biol. Chem.* 278:7108 (2003), Agami, *Curr. Opin. Chem. Biol.*, 6:829 (2002), Lavery, et al., *Curr. Opin. Drug Discov. Devel.*, 6:561 (2003), Shi, Trends Genet., 19:9 (2003), Shuey et al., *Drug Discov. Today,* 7:1040 (2002), McManus et al., Nat. Rev. Genet., 3:737 (2002), Xia et al., *Nat. Biotechnol.*, 20:1006 (2002), Plasterk et al., *Curr. Opin Genet. Dev.*, 10:562 (2000), Bosher et al., *Nat. Cell Biol.*, 2:E31 (2000), and Hunter, *Curr. Biol.* 9:R440 (1999).

A genetic defect leading to increased predisposition or risk for development of PD or a defect causing the disease, can be corrected permanently by administering to a subject carrying the defect a nucleic acid fragment that incorporates a repair sequence that supplies the normal/wild-type nucleotide(s) at the site of the genetic defect. Such site-specific repair sequence can encompass an RNA/DNA oligonucleotide that operates to promote endogenous repair of a subject's genomic DNA. The administration of the repair sequence can be performed by an appropriate vehicle, such as a complex with polyethelamine, encapsulated in anionic liposomes, a viral vector such as an adenovirus vector, or other pharmaceutical compositions suitable for promoting intracellular uptake of the administered nucleic acid The genetic defect can then be overcome, since the chimeric oligonucleotides induce the incorporation of the normal sequence into the genome of the subject, leading to expression of the normal/wild-type gene product. The replacement is propagated, thus rendering a permanent repair and alleviation of the symptoms associated with the disease or condition.

Double stranded oligonucleotides are formed by the assembly of two distinct oligonucleotide sequences where the oligonucleotide sequence of one strand is complementary to the oligonucleotide sequence of the second strand; such double stranded oligonucleotides are generally assembled from two separate oligonucleotides (e.g., siRNA), or from a single molecule that folds on itself to form a double stranded structure (e.g., shRNA or short hairpin RNA). These double stranded oligonucleotides known in the art all have a common feature in that each strand of the duplex has a distinct nucleotide sequence, wherein only one nucleotide sequence region (guide sequence or the antisense sequence) has complementarity to a target nucleic acid sequence and the other strand (sense sequence) comprises nucleotide sequence that is homologous to the target nucleic acid sequence.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation. It is generally considered that the major mechanism of RNA induced silencing (RNA interference, or RNAi) in mammalian cells is mRNA degradation. RNA interference (RNAi) is a mechanism that inhibits gene expression at the stage of translation or by hindering the transcription of specific genes. Specific RNAi pathway proteins are guided by the dsRNA to the targeted messenger RNA (mRNA), where they "cleave" the target, breaking it down into smaller portions that can no longer be translated into protein. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of protein synthesis. Thus, long dsRNA is not a viable option for RNAi in mammalian systems. Another outcome is epigenetic changes to a gene— histone modification and DNA methylation—affecting the degree the gene is transcribed.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell. A description of the mechanisms for siRNA activity, as well as some of its applications are described in Provost et al., *EMBO J.,* 21:5864 (2002); Tabara et al., *Cell* 109:861 (2002); Martinez et al., *Cell,* 110:563 (2002); Hutvagner & Zamore, *Science,* 297:2056 (2002).

From a mechanistic perspective, introduction of long double stranded RNA into plants and invertebrate cells is broken down into siRNA by a Type III endonuclease known as Dicer. Sharp, RNA interference-2001, *Genes Dev.,* 15:485 (2001). Dicer, a ribonuclease-III-like enzyme, processes the dsRNA into 19-23 base pair short interfering RNAs with characteristic two base 3' overhangs. Bernstein, Caudy, Hammond, & Hannon, *Nature,* 409:363 (2001). The siRNAs are then incorporated into an RNA-induced silencing complex (RISC) where one or more helicases unwind the siRNA duplex, enabling the complementary antisense strand to guide target recognition (Nykanen, Haley, & Zamore, *Cell,* 107:309 (2001)). Upon binding to the appropriate target mRNA, one or more endonucleases within the RISC cleaves the target to induce silencing. Elbashir, Lendeckel, & Tuschl, *Genes Dev.,* 15:188 (2001).

Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example, Schwarz et al., *Cell,* 115:199 (2003)). In this instance the sense sequence is believed to direct the RISC complex to a sequence (off-target sequence) that is distinct from the intended target sequence, resulting in the inhibition of the off-target sequence. In these double stranded nucleic acid sequences, each strand is complementary to a distinct target nucleic acid sequence. However, the off-targets that are affected by these dsRNAs are not entirely predictable and are non-specific.

The term "siRNA" refers to small inhibitory RNA duplexes that induce the RNA interference (RNAi) pathway. These molecules can vary in length (generally between 18-30 basepairs) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region. Small interfering RNA (siRNA), sometimes known as short interfering RNA or silencing RNA, are a class of 20-25 nucleotide-long double-stranded RNA molecules that play a variety of roles in biology.

While the two RNA strands do not need to be completely complementary, the strands should be sufficiently complementary to hybridize to form a duplex structure. In some instances, the complementary RNA strand can be less than 30 nucleotides, less than 25 nucleotides in length, about 19 to 24 nucleotides in length, or 20-23 nucleotides in length, including 22 nucleotides in length. The dsRNA of the present disclosure can further comprise at least one single-stranded nucleotide overhang. The dsRNA of the present disclosure can further comprise a substituted or chemically modified nucleotide. As discussed in detail below, the dsRNA can be synthesized by standard methods known in the art.

siRNA can be divided into five (5) groups including non-functional, semi-functional, functional, highly functional, and hyper-functional based on the level or degree of silencing that they induce in cultured cell lines. As used herein, these definitions are based on a set of conditions where the siRNA is transfected into the cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing. "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) can be used to compare siRNAs to a particular target for applications such as functional genomics, target identification and therapeutics.

microRNAs (miRNA) are single-stranded RNA molecules of about 21-23 nucleotides in length, which regulate gene expression. miRNAs are encoded by genes that are transcribed from DNA but not translated into protein (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression.

Antibody-Based Therapeutics

The present disclosure embodies agents that modulate a peptide sequence or RNA expressed from a gene associated with PD. The term biomarker, as used herein, can comprise a genetic variation of the present disclosure or a gene product, for example, RNA and polypeptides, of any one of the genes listed in FIGS. 8-11. Such modulating agents include, but are not limited to, proteins, peptides, peptidomimetics, peptoids, or any other forms of a molecule, which bind to, and alter the signaling or function associated with the PD associated biomarker, have an inhibitory or stimulatory effect on the PD associated biomarkers, or have a stimulatory or inhibitory effect on the expression or activity of the PD associated biomarkers' ligands, for example, polyclonal antibodies and/or monoclonal antibodies that specifically bind one form of the gene product but not to the other form of the gene product are also provided, or which bind a portion of either the variant or the reference gene product that contains the polymorphic site or sites.

In some embodiments, the present disclosure provides antibody-based agents targeting PD associated biomarkers. The antibody-based agents in any suitable form of an antibody, e.g., monoclonal, polyclonal, or synthetic, can be utilized in the therapeutic methods disclosed herein. The antibody-based agents include any target-binding fragment of an antibody and also peptibodies, which are engineered therapeutic molecules that can bind to human drug targets and contain peptides linked to the constant domains of antibodies. In some embodiments, the antibodies used for targeting PD associated biomarkers are humanized antibodies. Methods for humanizing antibodies are well known in the art. In some embodiments, the therapeutic antibodies comprise an antibody generated against PD associated biomarkers described in the present disclosure, wherein the antibodies are conjugated to another agent or agents, for example, a cytotoxic agent or agents.

The term "antibody" as used herein refers to immunoglobulin molecules and immunologically active portions of immunoglobulin molecules, i.e., molecules that contain antigen-binding sites that specifically bind an antigen. A molecule that specifically binds to a polypeptide of the disclosure is a molecule that binds to that polypeptide or a fragment thereof, but does not substantially bind other molecules in a sample, e.g., a biological sample, which naturally contains the polypeptide. Examples of immunologically active portions of immunoglobulin molecules include F(ab) and F(ab')2 fragments which can be generated by treating the antibody with an enzyme such as pepsin. The disclosure provides polyclonal and monoclonal antibodies that bind to a polypeptide of the disclosure. The term "monoclonal antibody" or "monoclonal antibody composition", as used herein, refers to a population of antibody molecules that contain only one species of an antigen binding site capable of immunoreacting with a particular epitope of a polypeptide of the disclosure. A monoclonal antibody composition thus typically displays a single binding affinity for a particular polypeptide of the disclosure with which it immunoreacts.

Polyclonal antibodies can be prepared as described above by immunizing a suitable subject with a desired immunogen, e.g., polypeptide of the disclosure or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein, *Nature,* 256:495 (1975), the human B cell hybridoma technique (Kozbor et al., *Immunol. Today,* 4:72 (1983)), the EBV-hybridoma technique (Cole et al., *Monoclonal Antibodies and Cancer Therapy*, Alan R. Liss (1985) Inc., pp. 77-96) or trioma techniques. The technology for producing hybridomas is well known (see generally *Current Protocols in Immunology* (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the disclosure.

Any of the many well-known protocols used for fusing lymphocytes and immortalized cell lines can be applied for the purpose of generating a monoclonal antibody to a polypeptide of the disclosure (see, e.g., *Current Protocols in Immunology*, supra; Galfre et al., *Nature,* 266:55052 (1977); R. H. Kenneth, in *Monoclonal Antibodies: A New Dimension In Biological Analyses*, Plenum Publishing Corp., New York, N.Y. (1980); and Lerner, *J. Biol. Med.,* 54:387 (1981)). Moreover, the ordinarily skilled worker can appreciate that there are many variations of such methods that also would be useful. Alternative to preparing monoclonal antibody-secreting hybridomas, a monoclonal antibody to a polypeptide of the disclosure can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP® Phage Display Kit, Catalog No. 240612). Additionally, examples of methods and reagents particularly amenable for use in generating and screening antibody display library can be found in, for example, U.S. Pat. No. 5,223,409; PCT Publication Nos. WO 92/18619, WO 91/17271, WO 92/20791, WO 92/15679; WO 93/01288, WO 92/01047, WO 92/09690, and WO 90/02809; Fuchs et al., *Bio/Technology,* 9:1370 (1991); Hay et al., *Hum. Antibod. Hvbndomas,* 3:81 (1992); Huse et al., *Science,* 246:1275 (1989); and Griffiths et al., *EMBO J.,* 12:725 (1993).

Additionally, recombinant antibodies, such as chimeric and humanized monoclonal antibodies, comprising both human and non-human portions, which can be made using standard recombinant DNA techniques, are within the scope of the disclosure. Such chimeric and humanized monoclonal antibodies can be produced by recombinant DNA techniques known in the art.

In general, antibodies of the disclosure (e.g., a monoclonal antibody) can be used to isolate a polypeptide of the disclosure by standard techniques, such as affinity chromatography or immunoprecipitation. A polypeptide-specific antibody can facilitate the purification of natural polypeptide from cells and of recombinants produced polypeptide expressed in host cells Moreover, an antibody specific for a polypeptide of the disclosure can be used to detect the polypeptide (e.g., in a cellular lysate, cell supernatant, or tissue sample) in order to evaluate the abundance and pattern of expression of the polypeptide. Antibodies can be used diagnostically, prognostically, or theranostically to monitor protein levels in tissue as part of a clinical testing procedure, e.g., to, for example, determine the efficacy of a given treatment regimen. The antibody can be coupled to a detectable substance to facilitate its detection. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotnazinylamine fluorescein, dansyl chloride or phycoerythnn; an example of a luminescent material includes luminol; examples of bioluminescent materials include luciferase, luciferin, and aequorin, and examples of suitable radioactive material include $^{125}$I, $^{131}$I, $^{35}$S or $^{3}$H. Antibodies can also be useful in pharmacogenomic analysis. In such embodiments, antibodies against variant proteins encoded by nucleic acids according to the disclosure, such as variant proteins that are encoded by nucleic acids that contain at least one genetic variation of the disclosure, can be used to identify individuals that can benefit from modified treatment modalities.

Antibodies can furthermore be useful for assessing expression of variant proteins in disease states, such as in active stages of a disease, or in an individual with a predisposition to a disease related to the function of the protein, in particular PD. Antibodies specific for a variant protein of the present disclosure that is encoded by a nucleic acid that comprises at least one polymorphic marker or haplotype as described herein can be used to screen for the presence of the variant protein, for example to screen for a predisposition to PD as indicated by the presence of the variant protein.

Antibodies can be used in other methods. Thus, antibodies are useful as screening tools for evaluating proteins, such as variant proteins of the disclosure, in conjunction with analysis by electrophoretic mobility, isoelectric point, tryptic or other protease digest, or for use in other physical assays known to those skilled in the art. Antibodies can also be used in tissue typing. In one such embodiment, a specific variant protein has been correlated with expression in a specific tissue type, and antibodies specific for the variant protein can then be used to identify the specific tissue type.

Subcellular localization of proteins, including variant proteins, can also be determined using antibodies, and can be applied to assess aberrant subcellular localization of the protein in cells in various tissues. Such use can be applied in genetic testing, but also in monitoring a particular treatment modality. In the case where treatment is aimed at correcting the expression level or presence of the variant protein or aberrant tissue distribution or, for instance, endometrial or blood cell expression of the variant protein, antibodies specific for the variant protein or fragments thereof can be used to monitor therapeutic efficacy.

Antibodies are further useful for inhibiting variant protein function, for example by blocking the binding of a variant protein to a binding molecule or partner. Such uses can also be applied in a therapeutic context in which treatment involves inhibiting a variant protein's function. An antibody can be for example used to block or competitively inhibit binding, thereby modulating (i.e., agonizing or antagonizing) the activity of the protein. Antibodies can be prepared against specific protein fragments containing sites for specific function or against an intact protein that is associated with a cell or cell membrane.

The present disclosure also embodies the use of any pharmacologic agent that can be conjugated to an antibody or an antibody binding fragment, and delivered in active form. Examples of such agents include cytotoxins, radioisotopes, hormones such as a steroid, anti-metabolites such as cytosines, and chemotherapeutic agents. Other embodiments can include agents such as a coagulant, a cytokine, growth factor, bacterial endotoxin or a moiety of bacterial endotoxin. The targeting antibody-based agent directs the toxin to, and thereby selectively modulates the cell expressing the targeted surface receptor. In some embodiments, therapeutic antibodies employ cross-linkers that provide high in vivo stability (Thorpe et al., *Cancer Res.*, 48:6396 (1988)). In any event, it is proposed that agents such as these can, if desired, be successfully conjugated to antibodies or antibody binding fragments, in a manner that can allow their targeting, internalization, release or presentation at the site of the targeted cells expressing the EN associated biomarkers using known conjugation technology. For administration in vivo, for example, an antibody can be linked with an additional therapeutic payload, such as radionuclide, an enzyme, an immunogenic epitope, or a cytotoxic agent, including bacterial toxins (diphtheria or plant toxins, such as ricin). The in vivo half-life of an antibody or a fragment thereof can be increased by pegylation through conjugation to polyethylene glycol.

Methods of Treatment

One embodiment of the present disclosure relates to methods of using compositions, e.g., pharmaceutical or neutraceutical compositions, and kits comprising agents that can reduce or increase the function and/or activity of polypeptides and/or nucleic acids that are associated with PD to inhibit or decrease PD progression, and/or are associated with complex I, II, III or IV, or lysosomal storage or metabolism. Another embodiment of the present disclosure provides methods, pharmaceutical or neutraceutical compositions, and kits for the treatment of animal subjects. The term "animal subject" as used herein includes humans as well as other mammals. The term "treating" as used herein includes achieving a therapeutic benefit and/or a prophylactic benefit. By therapeutic benefit is meant eradication or amelioration of the underlying cause of PD. Also, a therapeutic benefit is achieved with the eradication or amelioration of one or more of the physiological symptoms associated PD such that an improvement is observed in the animal subject, notwithstanding the fact that the animal subject can still be afflicted with PD.

For embodiments where a prophylactic benefit is desired, a composition of the disclosure can be administered to a subject at risk of developing PD, or to a subject reporting one or more of the physiological symptoms of PD, even though a screening of the condition cannot have been made. Administration can prevent PD from developing, or it can reduce, lessen, shorten and/or otherwise ameliorate the progression of PD, or symptoms that develop. The pharmaceutical or neutraceutical composition can modulate a target PD associated biomarker. Wherein, the term modulate includes inhibition of PD associated biomarkers, complex I, II, III or IV, or lysosomal storage or metabolism associated genes, or alternatively activation of PD associated biomarkers or complex I, II, III or IV, or lysosomal storage or metabolism associated genes.

Reducing the activity and/or function of polypeptides and/or nucleic acids found to be associated with PD, and/or are associated with complex I, II, III or IV, or lysosomal storage or metabolism is also referred to as "inhibiting" the polypeptides and/or nucleic acids. The term "inhibits" and its grammatical conjugations, such as "inhibitory," do not require complete inhibition, but refer to a reduction in PD associated biomarkers' activities. In some embodiments, such reduction is by at least 5%, at least 10%, at least 20%, at least 30%, at least 40%, at least 50%, at least 75%, at least 90%, and can be by at least 95% of the activity of the enzyme in the absence of the inhibitory effect, e.g., in the absence of an inhibitor. Conversely, the phrase "does not inhibit" and its grammatical conjugations refer to situations where there is less than 20%, less than 10%, and can be less than 5%, of reduction in enzyme activity in the presence of the agent. Further the phrase "does not substantially inhibit" and its grammatical conjugations refer to situations where there is less than 30%, less than 20%, and in some embodiments less than 10% of reduction in enzyme activity in the presence of the agent.

Increasing the activity and/or function of polypeptides and/or nucleic acids found to be associated with PD, and/or are associated with complex I, II, III or IV, or lysosomal storage or metabolism is also referred to as "activating" the polypeptides and/or nucleic acids. The term "activated" and its grammatical conjugations, such as "activating," do not require complete activation, but refer to an increase in PD associated biomarkers' activities. In some embodiments such increase is by at least 5%, at least 10%, at least 20%, at least 30%, at least 40%, at least 50%, at least 60%, at least 70%, at least 75%, at least 80%, at least 85%, at least 90%, and can be by at least 95% of the activity of the enzyme in the absence of the activation effect, e.g., in the absence of an activator. Conversely, the phrase "does not activate" and its grammatical conjugations refer to situations where there can be less than 20%, less than 10%, and less than 5%, of an increase in enzyme activity in the presence of the agent. Further the phrase "does not substantially activate" and its grammatical conjugations refer to situations where there is less than 30%, less than 20%, and in some embodiments less than 10% of an increase in enzyme activity in the presence of the agent.

The ability to reduce enzyme activity is a measure of the potency or the activity of an agent, or combination of agents, towards or against the enzyme. Potency can be measured by cell free, whole cell and/or in vivo assays in terms of IC50, Ki and/or ED50 values. An IC50 value represents the concentration of an agent to inhibit enzyme activity by half (50%) under a given set of conditions. A Ki value represents the equilibrium affinity constant for the binding of an inhibiting agent to the enzyme. An ED50 value represents the dose of an agent to affect a half-maximal response in a biological assay. Further details of these measures will be appreciated by those of ordinary skill in the art, and can be found in standard texts on biochemistry, enzymology, and the like.

The present disclosure also includes kits that can be used to treat PD or ET. These kits comprise an agent or combination of agents that inhibits PD or ET, inhibits a PD or ET associated biomarker and/or modulates complex I, II, III or IV, or lysosomal storage or metabolism associated genes or regions, and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

Kits, Arrays and Panels

Kits, arrays or panels useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a genetic variation, or a nucleic acid associated with a genetic variation, etc. The kits can for example include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example reagents for use with other screening assays for PD or ET.

In some embodiments, the disclosure pertains to a kit, array or panel for assaying a sample from a subject to detect the presence of a genetic variation, wherein the kit comprises reagents necessary for selectively detecting at least one particular genetic variation in the genome of the individual. In some embodiments, the disclosure pertains to a kit for assaying a sample from a subject to detect the presence of at least particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In some embodiments, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In some embodiments, the kit comprises one or more labeled nucleic acids capable of allele-specific detection of one or more specific polymorphic markers or haplotypes with a genetic variation, and reagents for detection of the label. In some embodiments, a kit, array or panel for detecting SNP markers can comprise a detection oligonucleotide probe, that hybridizes to a segment of template DNA containing a SNP polymorphisms to be detected, an enhancer oligonucleotide probe, detection probe, primer and/or an endonuclease, for example as described by Kutyavin et al. (Nucleic Acid Res., 34:e128 (2006)).

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical or neutraceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a carrier of at least one variant of the present disclosure is instructed to take a prescribed dose of the therapeutic agent. In one such embodiment, an individual identified as a carrier of at least one variant of the present disclosure is instructed to take a prescribed dose of the therapeutic agent. In some embodiments, an individual identified as a non-carrier of at least one variant of the present disclosure is instructed to take a prescribed dose of the therapeutic agent.

Also provided herein are articles of manufacture, comprising a probe that hybridizes with a region of human chromosome as described herein and can be used to detect a polymorphism described herein. For example, any of the probes for detecting polymorphisms described herein can be combined with packaging material to generate articles of manufacture or kits, arrays or panels. The kit can include one or more other elements including: instructions for use; and other reagents such as a label or an agent useful for attaching a label to the probe. Instructions for use can include instructions for screening applications of the probe for making a diagnosis, prognosis, or theranosis to PD or ET in a method described herein. Other instructions can include instructions for attaching a label to the probe, instructions for performing in situ analysis with the probe, and/or instructions for obtaining a sample to be analyzed from a subject. In some cases, the kit can include a labeled probe that hybridizes to a region of human chromosome as described herein.

The kit, array or panel can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a biological sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the sample for analysis, e.g., to a laboratory. The kit can include one or more containers for the sample, or the sample can be in a standard blood collection vial. The kit can also include one or more of an informed consent form, a test requisition form, and instructions on how to use the kit in a method described herein. Methods for using kits, arrays or panels are also included herein. One or more of the forms (e.g., the test requisition form) and the container holding the sample can be coded, for example, with a bar code for identifying the subject who provided the sample.

In some embodiments, an in vitro screening test can comprise one or more devices, tools, and equipment configured to collect a genetic sample from an individual. In some embodiments of an in vitro screening test, tools to collect a genetic sample can include one or more of a swab, a scalpel, a syringe, a scraper, a container, and other devices and reagents designed to facilitate the collection, storage, and transport of a genetic sample. In some embodiments, an in vitro screening test can include reagents or solutions for collecting, stabilizing, storing, and processing a genetic sample.

Such reagents and solutions for nucleotide collecting, stabilizing, storing, and processing are well known by those of skill in the art and can be indicated by specific methods used by an in vitro screening test as described herein. In some embodiments, an in vitro screening test as disclosed herein, can comprise a microarray apparatus and reagents, a flow cell apparatus and reagents, a multiplex nucleotide sequencer and reagents, and additional hardware and software necessary to assay a genetic sample for certain genetic markers and to detect and visualize certain genetic markers.

The present disclosure further relates to kits, arrays or panels for using antibodies in the methods described herein. This includes, but is not limited to, kits, arrays or panels for detecting the presence of a variant protein in a test sample. One embodiment comprises antibodies such as a labeled or labelable antibody and a compound or agent for detecting variant proteins in a biological sample, means for determining the amount or the presence and/or absence of variant protein in the sample, and means for comparing the amount of variant protein in the sample with a standard, as well as instructions for use of the kit. In certain embodiments, the kit further comprises a set of instructions for using the reagents comprising the kit.

Unless otherwise explained, all technical and scientific terms used herein have the same meaning as commonly understood by one of ordinary skill in the art to which this disclosure belongs. The following references contain embodiments of the methods and compositions that can be used herein: The Merck Manual of Diagnosis and Therapy, 18th Edition, published by Merck Research Laboratories, 2006 (ISBN 0-911910-18-2); Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

Standard procedures of the present disclosure are described, e.g., in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques, Vol. 152, S. L. Berger and A. R. Kimmerl (eds.), Academic Press Inc., San Diego, USA (1987)). Current Protocols in Molecular Biology (CPMB) (Fred M. Ausubel, et al. ed., John Wiley and Sons, Inc.), Current Protocols in Protein Science (CPPS) (John E. Coligan, et. al., ed., John Wiley and Sons, Inc.), Current Protocols in Immunology (CPI) (John E. Coligan, et. al., ed. John Wiley and Sons, Inc.), Current Protocols in Cell Biology (CPCB) (Juan S. Bonifacino et. al. ed., John Wiley and Sons, Inc.), Culture of Animal Cells: A Manual of Basic Technique by R. Ian Freshney, Publisher: Wiley-Liss; 5th edition (2005), and Animal Cell Culture Methods (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifications that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art can recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which can be limited only by the appended claims.

Unless defined otherwise, all technical and scientific terms used herein have the meanings that would be commonly understood by one of skill in the art in the context of the present specification.

It should be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While some embodiments of the present disclosure have been shown and described herein, it can be obvious to those skilled in the art that such embodiments are provided by way of example only. Numerous variations, changes, and substitutions can now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

Formulations, Routes of Administration, and Effective Doses

Yet another aspect of the present disclosure relates to formulations, routes of administration and effective doses for compositions comprising an agent or combination of agents of the instant disclosure. Such compositions can be used to treat a ND progression and a ND associated symptoms as described above.

Compounds of the disclosure can be administered as formulations including those suitable for oral (including buccal and sub-lingual), rectal, nasal, topical, transdermal patch, pulmonary, vaginal, suppository, or parenteral (including intramuscular, intraarterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999).

In various embodiments, the composition includes carriers and excipients (including but not limited to buffers, carbohydrates, mannitol, proteins, polypeptides or amino acids such as glycine, bacteriostats, chelating agents, suspending agents, thickening agents and/or preservatives), water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In some embodiments, the pharmaceutical or neutraceutical preparation is substantially free of preservatives. In other embodiments, the pharmaceutical or neutraceutical preparation can contain at least one preservative. General methodology on pharmaceutical dosage forms is found in Ansel et al., Pharmaceutical Dosage Forms and Drug Delivery Systems (Lippencott, Williams, & Wilkins, Baltimore Md. (1999)). It can be recognized that, while any suitable carrier known to those of ordinary skill in the art can be employed to administer the compositions of this disclosure, the type of carrier can vary depending on the mode of administration.

Compounds can also be encapsulated within liposomes using well-known technology. Biodegradable microspheres can also be employed as carriers for the pharmaceutical or neutraceutical compositions of this disclosure. Suitable biodegradable microspheres are disclosed, for example, in U.S. Pat. Nos. 4,897,268, 5,075,109, 5,928,647, 5,811,128, 5,820,883, 5,853,763, 5,814,344 and 5,942,252.

The compound can be administered in liposomes or microspheres (or microparticles). Methods for preparing liposomes and microspheres for administration to a subject are well known to those of skill in the art. U.S. Pat. No. 4,789,734, the contents of which are hereby incorporated by reference, describes methods for encapsulating biological materials in liposomes. Essentially, the material is dissolved in an aqueous solution, the appropriate phospholipids and lipids added, and optionally along with surfactants, and the material dialyzed or sonicated, as necessary. A review of known methods is provided by G. Gregoriadis, Chapter 14, "Liposomes," Drug Carriers in Biology and Medicine, pp. 2.sup. 87-341 (Academic Press, 1979).

Microspheres formed of polymers or proteins are well known to those skilled in the art, and can be tailored for passage through the gastrointestinal tract directly into the blood stream. Alternatively, the compound can be incorporated and the microspheres, or composite of microspheres, implanted for slow release over a period of time ranging from days to months. See, for example, U.S. Pat. Nos. 4,906,474, 4,925,673 and 3,625,214, and Jein, TIPS 19:155-157 (1998), the contents of which are hereby incorporated by reference.

The concentration of drug can be adjusted, the pH of the solution buffered and the isotonicity adjusted to be compatible with intravenous injection, as is well known in the art.

The compounds of the disclosure can be formulated as a sterile solution or suspension, in suitable vehicles, well known in the art. The compositions can be sterilized by conventional, well-known sterilization techniques, or can be sterile filtered. The resulting aqueous solutions can be packaged for use as is, or lyophilized, the lyophilized preparation being combined with a sterile solution prior to administration. Suitable formulations and additional carriers are described in Remington "The Science and Practice of Pharmacy" (20th Ed., Lippincott Williams & Wilkins, Baltimore Md.), the teachings of which are incorporated by reference in their entirety herein.

The agents or their pharmaceutically acceptable salts can be provided alone or in combination with one or more other agents or with one or more other forms. For example a formulation can comprise one or more agents in particular proportions, depending on the relative potencies of each agent and the intended indication. For example, in compositions for targeting two different host targets, and where potencies are similar, about a 1:1 ratio of agents can be used. The two forms can be formulated together, in the same dosage unit e.g., in one cream, suppository, tablet, capsule, aerosol spray, or packet of powder to be dissolved in a beverage; or each form can be formulated in a separate unit, e.g., two creams, two suppositories, two tablets, two capsules, a tablet and a liquid for dissolving the tablet, two aerosol sprays, or a packet of powder and a liquid for dissolving the powder, etc.

The term "pharmaceutically acceptable salt" means those salts which retain the biological effectiveness and properties of the agents used in the present disclosure, and which are not biologically or otherwise undesirable. For example, a pharmaceutically acceptable salt does not interfere with the beneficial effect of an agent of the disclosure in inhibiting a ND associated biomarkers' components Typical salts are those of the inorganic ions, such as, for example, sodium, potassium, calcium, magnesium ions, and the like. Such salts include salts with inorganic or organic acids, such as hydrochloric acid, hydrobromic acid, phosphoric acid, nitric acid, sulfuric acid, methanesulfonic acid, p toluenesulfonic acid, acetic acid, fumaric acid, succinic acid, lactic acid, mandelic acid, malic acid, citric acid, tartaric acid or maleic acid. In addition, if the agent(s) contain a carboxy group or other acidic group, it can be converted into a pharmaceutically acceptable addition salt with inorganic or organic bases. Examples of suitable bases include sodium hydroxide, potassium hydroxide, ammonia, cyclohexylamine, dicyclohexyl-amine, ethanolamine, diethanolamine, triethanolamine, and the like.

A pharmaceutically acceptable ester or amide refers to those which retain biological effectiveness and properties of the agents used in the present disclosure, and which are not biologically or otherwise undesirable. For example, the ester or amide does not interfere with the beneficial effect of an agent of the disclosure in inhibiting a ND associated biomarkers' components. Typical esters include ethyl, methyl, isobutyl, ethylene glycol, and the like. Typical amides include unsubstituted amides, alkyl amides, dialkyl amides, and the like.

In some embodiments, an agent can be administered in combination with one or more other compounds, forms, and/or agents, e.g., as described above. Pharmaceutical or neutraceutical compositions comprising combinations of a ND associated biomarkers' inhibitors with one or more other active agents can be formulated to comprise certain molar ratios. For example, molar ratios of about 99:1 to about 1:99 of a ND associated biomarkers' inhibitors to the other active agent can be used. In some subset of the embodiments, the range of molar ratios of ND associated biomarkers' inhibitors: other active agents are selected from about 80:20 to about 20:80; about 75:25 to about 25:75, about 70:30 to about 30:70, about 66:33 to about 33:66, about 60:40 to about 40:60; about 50:50; and about 90:10 to about 10:90. The molar ratio of ND associated biomarkers' inhibitors: other active agents can be about 1:9, and in some embodiments can be about 1:1. The two agents, forms and/or compounds can be formulated together, in the same dosage unit e.g., in one cream, suppository, tablet, capsule, or packet of powder to be dissolved in a beverage; or each agent, form, and/or compound can be formulated in separate units, e.g., two creams, suppositories, tablets, two capsules, a tablet and a liquid for dissolving the tablet, an aerosol spray a packet of powder and a liquid for dissolving the powder, etc.

If necessary or desirable, the agents and/or combinations of agents can be administered with still other agents. The choice of agents that can be co-administered with the agents and/or combinations of agents of the instant disclosure can depend, at least in part, on the condition being treated.

The agent(s) (or pharmaceutically acceptable salts, esters or amides thereof) can be administered per se or in the form of a pharmaceutical or neutraceutical composition wherein the active agent(s) is in an admixture or mixture with one or more pharmaceutically acceptable carriers. A pharmaceutical or neutraceutical composition, as used herein, can be any composition prepared for administration to a subject. Pharmaceutical or neutraceutical compositions for use in accordance with the present disclosure can be formulated in conventional manner using one or more physiologically acceptable carriers, comprising excipients, diluents, and/or auxiliaries, e.g., which facilitate processing of the active agents into preparations that can be administered. Proper formulation can depend at least in part upon the route of administration chosen. The agent(s) useful in the present disclosure, or pharmaceutically acceptable salts, esters, or amides thereof, can be delivered to a subject using a number of routes or modes of administration, including oral, buccal, topical, rectal, transdermal, transmucosal, subcutaneous, intravenous, and intramuscular applications, as well as by inhalation.

For oral administration, the agents can be formulated readily by combining the active agent(s) with pharmaceutically acceptable carriers well known in the art. Such carriers enable the agents of the disclosure to be formulated as tablets, including chewable tablets, pills, dragees, capsules, lozenges, hard candy, liquids, gels, syrups, slurries, powders, suspensions, elixirs, wafers, and the like, for oral ingestion by a subject to be treated. Such formulations can comprise pharmaceutically acceptable carriers including solid diluents or fillers, sterile aqueous media and various non-toxic organic solvents. A solid carrier can be one or more substances which can also act as diluents, flavoring agents, solubilizers, lubricants, suspending agents, binders, preservatives, tablet disintegrating agents, or an encapsulating material. In powders, the carrier generally is a finely divided solid which is a mixture with the finely divided active component. In tablets, the active component generally is mixed with the carrier having the necessary binding capacity in suitable proportions and compacted in the shape and size desired. The powders and tablets may contain from about one (1) to about seventy (70) percent of the active compound. Suitable carriers include but are not limited to magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. Generally, the agents of the disclosure can be included at concentration levels ranging from about 0.5%, about 5%, about 10%, about 20%, or about 30% to about 50%, about 60%, about 70%, about 80% or about 90% by weight of the total composition of oral dosage forms, in an amount sufficient to provide a desired unit of dosage.

Aqueous suspensions for oral use can contain agent(s) of this disclosure with pharmaceutically acceptable excipients, such as a suspending agent (e.g., methyl cellulose), a wetting agent (e.g., lecithin, lysolecithin and/or a long-chain fatty alcohol), as well as coloring agents, preservatives, flavoring agents, and the like.

In some embodiments, oils or non-aqueous solvents can be used to bring the agents into solution, due to, for example, the presence of large lipophilic moieties. Alternatively, emulsions, suspensions, or other preparations, for example, liposomal preparations, can be used. With respect to liposomal preparations, any known methods for preparing liposomes for treatment of a condition can be used. See, for example, Bangham et al., *J. Mol. Biol.* 23: 238 (1965) and Szoka et al., *Proc. Natl Acad. Sci. USA* 75: 4194 (1978), incorporated herein by reference. Ligands can also be attached to the liposomes to direct these compositions to particular sites of action. Agents of this disclosure can also be integrated into foodstuffs, e.g., cream cheese, butter, salad dressing, or ice cream to facilitate solubilization, administration, and/or compliance in certain subject populations.

Pharmaceutical or neutraceutical preparations for oral use can be obtained as a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; flavoring elements, cellulose preparations such as, for example, maize starch, wheat starch, rice starch, potato starch, gelatin, gum tragacanth, methyl cellulose, hydroxypropylmethyl cellulose, sodium carboxymethylcellulose, and/or polyvinyl pyrrolidone (PVP). If desired, disintegrating agents can be added, such as the cross linked polyvinyl pyrrolidone, agar, or alginic acid or a salt thereof such as sodium alginate. The agents can also be formulated as a sustained release preparation.

Dragee cores can be provided with suitable coatings. For this purpose, concentrated sugar solutions can be used, which can optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments can be added to the tablets or dragee coatings for identification or to characterize different combinations of active agents.

Pharmaceutical or neutraceutical preparations that can be used orally include push fit capsules made of gelatin, as well as soft, sealed capsules made of gelatin and a plasticizer, such as glycerol or sorbitol. The push fit capsules can contain the active ingredients in admixture with filler such as lactose, binders such as starches, and/or lubricants such as talc or magnesium stearate and, optionally, stabilizers. In soft capsules, the active agents can be dissolved or suspended in suitable liquids, such as fatty oils, liquid paraffin, or liquid polyethylene glycols. In addition, stabilizers can be added. All formulations for oral administration should be in dosages suitable for administration.

Other forms suitable for oral administration include liquid form preparations including emulsions, syrups, elixirs, aqueous solutions, aqueous suspensions, or solid form preparations which are intended to be converted shortly before use to liquid form preparations. Emulsions can be prepared in solutions, for example, in aqueous propylene glycol solutions or can contain emulsifying agents, for example, such as lecithin, sorbitan monooleate, or acacia. Aqueous solutions can be prepared by dissolving the active component in water and adding suitable colorants, flavors, stabilizers, and thickening agents. Aqueous suspensions can be prepared by dispersing the finely divided active component in water with viscous material, such as natural or synthetic gums, resins, methylcellulose, sodium carboxymethylcellulose, and other well known suspending agents. Suitable fillers or carriers with which the compositions can be administered include agar, alcohol, fats, lactose, starch, cellulose derivatives, polysaccharides, polyvinylpyrrolidone, silica, sterile saline and the like, or mixtures thereof used in suitable amounts. Solid form preparations include solutions, suspensions, and emulsions, and can contain, in addition to the active component, colorants, flavors, stabilizers, buffers, artificial and natural sweeteners, dispersants, thickeners, solubilizing agents, and the like.

A syrup or suspension can be made by adding the active compound to a concentrated, aqueous solution of a sugar, e.g., sucrose, to which can also be added any accessory ingredients. Such accessory ingredients can include flavoring, an agent to retard crystallization of the sugar or an agent to increase the solubility of any other ingredient, e.g., as a polyhydric alcohol, for example, glycerol or sorbitol.

When formulating compounds of the disclosure for oral administration, it can be desirable to utilize gastroretentive formulations to enhance absorption from the gastrointestinal (GI) tract. A formulation which is retained in the stomach for several hours can release compounds of the disclosure slowly and provide a sustained release that can be in some embodiments of the disclosure. Disclosure of such gastroretentive formulations are found in Klausner, E. A.; Lavy, E.; Barta, M.; Cserepes, E.; Friedman, M.; Hoffman, A., *Pharm. Res.*, 20:1466 (2003), Hoffman, A.; Stepensky, D.; Lavy, E.; Eyal, S. Klausner, E.; Friedman, M., *Int. J. Pharm.*, 11:141 (2004), Streubel, A.; Siepmann, J.; Bodmeier, R.; *Expert Opin. Drug Deliver.*, 3:217 (2006), and Chavanpatil, M. D.; Jain, P.; Chaudhari, S.; Shear, R.; Vavia, P. R., *Int. J. Pharm.* (2006). Expandable, floating and bioadhesive techniques can be utilized to maximize absorption of the compounds of the disclosure.

The compounds of the disclosure can be formulated for parenteral administration (e.g., by injection, for example bolus injection or continuous infusion) and can be presented in unit dose form in ampoules, pre-filled syringes, small volume infusion or in multi-dose containers with an added preservative. The compositions can take such forms as suspensions, solutions, or emulsions in oily or aqueous vehicles, for example solutions in aqueous polyethylene glycol.

For injectable formulations, the vehicle can be chosen from those known in art to be suitable, including aqueous solutions or oil suspensions, or emulsions, with sesame oil, corn oil, cottonseed oil, or peanut oil, as well as elixirs, mannitol, dextrose, or a sterile aqueous solution, and similar pharmaceutical vehicles. The formulation can also comprise polymer compositions which are biocompatible, biodegradable, such as poly(lactic-co-glycolic)acid. These materials can be made into micro or nanospheres, loaded with drug and further coated or derivatized to provide superior sustained release performance. Vehicles suitable for periocular or intraocular injection include, for example, suspensions of therapeutic agent in injection grade water, liposomes and vehicles suitable for lipophilic substances. Other vehicles for periocular or intraocular injection are well known in the art.

In an embodiment, the composition is formulated in accordance with routine procedures as a pharmaceutical or neutraceutical composition adapted for intravenous administration to human beings. Typically, compositions for intravenous administration are solutions in sterile isotonic aqueous buffer. Where necessary, the composition can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients can be mixed prior to administration.

When administration is by injection, the active compound can be formulated in aqueous solutions, specifically in physiologically compatible buffers such as Hanks solution, Ringer's solution, or physiological saline buffer. The solution can contain formulatory agents such as suspending, stabilizing and/or dispersing agents. Alternatively, the active compound can be in powder form for constitution with a suitable vehicle, e.g., sterile pyrogen-free water, before use. In some embodiments, the pharmaceutical or neutraceutical composition does not comprise an adjuvant or any other substance added to enhance the immune response stimulated by the peptide. In some embodiments, the pharmaceutical or neutraceutical composition comprises a substance that inhibits an immune response to the peptide. Methods of formulation are known in the art, for example, as disclosed in Remington's Pharmaceutical Sciences, latest edition, Mack Publishing Co., Easton P.

In addition to the formulations described previously, the agents can also be formulated as a depot preparation. Such long acting formulations can be administered by implantation or transcutaneous delivery (for example subcutaneously or intramuscularly), intramuscular injection or use of a transdermal patch. Thus, for example, the agents can be formulated with suitable polymeric or hydrophobic materials (for example as an emulsion in an acceptable oil) or ion exchange resins, or as sparingly soluble derivatives, for example, as a sparingly soluble salt.

In some embodiments, pharmaceutical or neutraceutical compositions comprising one or more agents of the present disclosure exert local and regional effects when administered topically or injected at or near particular sites of infection. Direct topical application, e.g., of a viscous liquid, solution, suspension, dimethylsulfoxide (DMSO)-based solutions, liposomal formulations, gel, jelly, cream, lotion, ointment, suppository, foam, or aerosol spray, can be used for local administration, to produce for example local and/or regional effects. Pharmaceutically appropriate vehicles for such formulation include, for example, lower aliphatic alcohols, polyglycols (e.g., glycerol or polyethylene glycol), esters of fatty acids, oils, fats, silicones, and the like. Such preparations can also include preservatives (e.g., p-hydroxybenzoic acid esters) and/or antioxidants (e.g., ascorbic acid and tocopherol). See also Dermatological Formulations: Percutaneous absorption, Barry (Ed.), Marcel Dekker Incl, 1983.

Pharmaceutical or neutraceutical compositions of the present disclosure can contain a cosmetically or dermatologically acceptable carrier. Such carriers are compatible with skin, nails, mucous membranes, tissues and/or hair, and can include any conventionally used cosmetic or dermatological carrier within this context. Such carriers can be readily selected by one of ordinary skill in the art. In formulating skin ointments, an agent or combination of agents of the instant disclosure can be formulated in an oleaginous hydrocarbon base, an anhydrous absorption base, a water-in-oil absorption base, an oil-in-water water-removable base and/or a water-soluble base. Examples of such carriers and excipients include, but are not limited to, humectants (e.g., urea), glycols (e.g., propylene glycol), alcohols (e.g., ethanol), fatty acids (e.g., oleic acid), surfactants (e.g., isopropyl myristate and sodium lauryl sulfate), pyrrolidones, glycerol monolaurate, sulfoxides, terpenes (e.g., menthol), amines, amides, alkanes, alkanols, water, calcium carbonate, calcium phosphate, various sugars, starches, cellulose derivatives, gelatin, and polymers such as polyethylene glycols.

Ointments and creams can, for example, be formulated with an aqueous or oily base with the addition of suitable thickening and/or gelling agents. Lotions can be formulated with an aqueous or oily base and can in general also containing one or more emulsifying agents, stabilizing agents, dispersing agents, suspending agents, thickening agents, or coloring agents. The construction and use of transdermal patches for the delivery of pharmaceutical agents is well known in the art. See, e.g., U.S. Pat. Nos. 5,023,252, 4,992,445 and 5,001,139. Such patches can be constructed for continuous, pulsatile, or on demand delivery of pharmaceutical agents.

Lubricants which can be used to form pharmaceutical or neutraceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil, and soybean oil), zinc stearate, ethyl oleate, ethyl laureate, agar, or mixtures thereof. Additional lubricants include, for example, a syloid silica gel, a coagulated aerosol of synthetic silica, or mixtures thereof. A lubricant can optionally be added, in an amount of less than about 1 weight percent of the pharmaceutical or neutraceutical composition.

The compositions according to the present disclosure can be in any form suitable for topical application, including aqueous, aqueous-alcoholic or oily solutions, lotion or serum dispersions, aqueous, anhydrous or oily gels, emulsions obtained by dispersion of a fatty phase in an aqueous phase (O/W or oil in water) or, conversely, (W/O or water in oil), microemulsions or alternatively microcapsules, microparticles or lipid vesicle dispersions of ionic and/or nonionic type. These compositions can be prepared according to conventional methods. Other than the agents of the disclosure, the amounts of the various constituents of the compositions according to the disclosure are those conventionally used in the art. These compositions in particular constitute protection, treatment or care creams, milks, lotions, gels or foams for the face, for the hands, for the body and/or for the mucous membranes, or for cleansing the skin. The compositions can also consist of solid preparations constituting soaps or cleansing bars.

Compositions of the present disclosure can also contain adjuvants common to the cosmetic and dermatological fields, such as hydrophilic or lipophilic gelling agents, hydrophilic or lipophilic active agents, preserving agents, antioxidants, solvents, fragrances, fillers, sunscreens, odor-absorbers and dyestuffs. The amounts of these various adjuvants are those conventionally used in the fields considered and, for example, are from about 0.01% to about 20% of the total weight of the composition. Depending on their nature, these adjuvants can be introduced into the fatty phase, into the aqueous phase and/or into the lipid vesicles.

In some embodiments, ocular viral infections can be effectively treated with ophthalmic solutions, suspensions, ointments or inserts comprising an agent or combination of agents of the present disclosure. Eye drops can be prepared by dissolving the active ingredient in a sterile aqueous solution such as physiological saline, buffering solution, etc., or by combining powder compositions to be dissolved before use. Other vehicles can be chosen, as is known in the art, including but not limited to: balance salt solution, saline solution, water soluble polyethers such as polyethyene glycol, polyvinyls, such as polyvinyl alcohol and povidone, cellulose derivatives such as methylcellulose and hydroxypropyl methylcellulose, petroleum derivatives such as mineral oil and white petrolatum, animal fats such as lanolin, polymers of acrylic acid such as carboxypolymethylene gel, vegetable fats such as peanut oil and polysaccharides such as dextrans, and glycosaminoglycans such as sodium hyaluronate. If desired, additives ordinarily used in the eye drops can be added. Such additives include isotonizing agents (e.g., sodium chloride, etc.), buffer agent (e.g., boric acid, sodium monohydrogen phosphate, sodium dihydrogen phosphate, etc.), preservatives (e.g., benzalkonium chloride, benzethonium chloride, chlorobutanol, etc.), thickeners (e.g., saccharide such as lactose, mannitol, maltose, etc.; e.g., hyaluronic acid or its salt such as sodium hyaluronate, potassium hyaluronate, etc.; e.g., mucopolysaccharide such as chondroitin sulfate, etc.; e.g., sodium polyacrylate, carboxyvinyl polymer, crosslinked polyacrylate, polyvinyl alcohol, polyvinyl pyrrolidone, methyl cellulose, hydroxy propyl methylcellulose, hydroxyethyl cellulose, carboxymethyl cellulose, hydroxy propyl cellulose or other agents known to those skilled in the art).

The solubility of the components of the present compositions can be enhanced by a surfactant or other appropriate co-solvent in the composition. Such cosolvents include polysorbate 20, 60, and 80, Pluronic F68, F-84 and P-103, cyclodextrin, or other agents known to those skilled in the art. Such co-solvents can be employed at a level of from about 0.01% to 2% by weight.

The compositions of the disclosure can be packaged in multidose form. Preservatives can be preferred to prevent microbial contamination during use. Suitable preservatives include: benzalkonium chloride, thimerosal, chlorobutanol, methyl paraben, propyl paraben, phenylethyl alcohol, edetate disodium, sorbic acid, Onamer M, or other agents known to those skilled in the art. In the prior art ophthalmic products, such preservatives can be employed at a level of from 0.004% to 0.02%. In the compositions of the present application the preservative, e.g., benzalkonium chloride, can be employed at a level of from 0.001% to less than 0.01%, e.g. from 0.001% to 0.008%, e.g., about 0.005% by weight. It has been found that a concentration of benzalkonium chloride of 0.005% can be sufficient to preserve the compositions of the present disclosure from microbial attack.

In some embodiments, ND associated symptoms of the ear can be effectively treated with otic solutions, suspensions, ointments or inserts comprising an agent or combination of agents of the present disclosure.

In some embodiments, the agents of the present disclosure are delivered in soluble rather than suspension form, which allows for more rapid and quantitative absorption to the sites of action. In general, formulations such as jellies, creams, lotions, suppositories and ointments can provide an area with more extended exposure to the agents of the present disclosure, while formulations in solution, e.g., sprays, provide more immediate, short-term exposure.

In some embodiments relating to topical/local application, the pharmaceutical or neutraceutical compositions can include one or more penetration enhancers. For example, the formulations can comprise suitable solid or gel phase carriers or excipients that increase penetration or help delivery of agents or combinations of agents of the disclosure across a permeability barrier, e.g., the skin. Many of these penetration-enhancing compounds are known in the art of topical formulation, and include, e.g., water, alcohols (e.g., terpenes like methanol, ethanol, 2-propanol), sulfoxides (e.g., dimethyl sulfoxide, decylmethyl sulfoxide, tetradecylmethyl sulfoxide), pyrrolidones (e.g., 2-pyrrolidone, N-methyl-2-pyrrolidone, N-(2-hydroxyethyl)pyrrolidone), laurocapram, acetone, dimethylacetamide, dimethylformamide, tetrahydrofurfuryl alcohol, L-α-amino acids, anionic, cationic, amphoteric or nonionic surfactants (e.g., isopropyl myristate and sodium lauryl sulfate), fatty acids, fatty alcohols (e.g., oleic acid), amines, amides, clofibric acid amides, hexamethylene lauramide, proteolytic enzymes, α-bisabolol, d-limonene, urea and N,N-diethyl-m-toluamide, and the like. Additional examples include humectants (e.g., urea), glycols (e.g., propylene glycol and polyethylene glycol), glycerol monolaurate, alkanes, alkanols, ORGELASE, calcium carbonate, calcium phosphate, various sugars, starches, cellulose derivatives, gelatin, and/or other polymers. In some embodiments, the pharmaceutical or neutraceutical compositions can include one or more such penetration enhancers.

In some embodiments, the pharmaceutical or neutraceutical compositions for local/topical application can include one or more antimicrobial preservatives such as quaternary ammonium compounds, organic mercurials, p-hydroxy benzoates, aromatic alcohols, chlorobutanol, and the like.

Gastrointestinal ND symptoms can be effectively treated with orally- or rectally delivered solutions, suspensions, ointments, enemas and/or suppositories comprising an agent or combination of agents of the present disclosure.

Respiratory ND symptoms can be effectively treated with aerosol solutions, suspensions or dry powders comprising an agent or combination of agents of the present disclosure. Administration by inhalation is particularly useful in treating viral infections of the lung, such as influenza. The aerosol can be administered through the respiratory system or nasal passages. For example, one skilled in the art can recognize that a composition of the present disclosure can be suspended or dissolved in an appropriate carrier, e.g., a pharmaceutically acceptable propellant, and administered directly into the lungs using a nasal spray or inhalant. For example, an aerosol formulation comprising a ND associated biomarkers' inhibitors can be dissolved, suspended or emulsified in a propellant or a mixture of solvent and propellant, e.g., for administration as a nasal spray or inhalant. Aerosol formulations can contain any acceptable propellant under pressure, such as a cosmetically or dermatologically or pharmaceutically acceptable propellant, as conventionally used in the art.

An aerosol formulation for nasal administration is generally an aqueous solution designed to be administered to the nasal passages in drops or sprays. Nasal solutions can be similar to nasal secretions in that they are generally isotonic and slightly buffered to maintain a pH of about 5.5 to about 6.5, although pH values outside of this range can additionally be used. Antimicrobial agents or preservatives can also be included in the formulation.

An aerosol formulation for inhalations and inhalants can be designed so that the agent or combination of agents of the present disclosure is carried into the respiratory tree of the subject when administered by the nasal or oral respiratory route. Inhalation solutions can be administered, for example, by a nebulizer. Inhalations or insufflations, comprising finely powdered or liquid drugs, can be delivered to the respiratory system as a pharmaceutical or neutraceutical aerosol of a solution or suspension of the agent or combination of agents in a propellant, e.g., to aid in disbursement. Propellants can be liquefied gases, including halocarbons, for example, fluorocarbons such as fluorinated chlorinated hydrocarbons, hydrochlorofluorocarbons, and hydrochlorocarbons, as well as hydrocarbons and hydrocarbon ethers.

Halocarbon propellants useful in the present disclosure include fluorocarbon propellants in which all hydrogens are replaced with fluorine, chlorofluorocarbon propellants in which all hydrogens are replaced with chlorine and at least one fluorine, hydrogen-containing fluorocarbon propellants, and hydrogen-containing chlorofluorocarbon propellants. Halocarbon propellants are described in Johnson, U.S. Pat. No. 5,376,359; Byron et al., U.S. Pat. No. 5,190,029; and Purewal et al., U.S. Pat. No. 5,776,434. Hydrocarbon propellants useful in the disclosure include, for example, propane, isobutane, n-butane, pentane, isopentane and neopentane. A blend of hydrocarbons can also be used as a propellant. Ether propellants include, for example, dimethyl ether as well as the ethers. An aerosol formulation of the disclosure can also comprise more than one propellant. For example, the aerosol formulation can comprise more than one propellant from the same class, such as two or more fluorocarbons; or more than one, more than two, more than three propellants from different classes, such as a fluorohydrocarbon and a hydrocarbon. Pharmaceutical or neutraceutical compositions of the present disclosure can also be dispensed with a compressed gas, e.g., an inert gas such as carbon dioxide, nitrous oxide or nitrogen.

Aerosol formulations can also include other components, for example, ethanol, isopropanol, propylene glycol, as well as surfactants or other components such as oils and detergents. These components can serve to stabilize the formulation and/or lubricate valve components.

The aerosol formulation can be packaged under pressure and can be formulated as an aerosol using solutions, suspensions, emulsions, powders and semisolid preparations. For example, a solution aerosol formulation can comprise a solution of an agent of the disclosure such as a ND associated biomarkers' inhibitors in (substantially) pure propellant or as a mixture of propellant and solvent. The solvent can be used to dissolve the agent and/or retard the evaporation of the propellant. Solvents useful in the disclosure include, for example, water, ethanol and glycols. Any combination of suitable solvents can be use, optionally combined with preservatives, antioxidants, and/or other aerosol components.

An aerosol formulation can also be a dispersion or suspension. A suspension aerosol formulation can comprise a suspension of an agent or combination of agents of the instant disclosure, e.g., a ND associated biomarkers' inhibitors, and a dispersing agent. Dispersing agents useful in the disclosure include, for example, sorbitan trioleate, oleyl alcohol, oleic acid, lecithin and corn oil. A suspension aerosol formulation can also include lubricants, preservatives, antioxidant, and/or other aerosol components.

An aerosol formulation can similarly be formulated as an emulsion. An emulsion aerosol formulation can include, for example, an alcohol such as ethanol, a surfactant, water and a propellant, as well as an agent or combination of agents of the disclosure, e.g., a ND associated biomarkers' inhibitors: The surfactant used can be nonionic, anionic or cationic. One example of an emulsion aerosol formulation comprises, for example, ethanol, surfactant, water and propellant. Another example of an emulsion aerosol formulation comprises, for example, vegetable oil, glyceryl monostearate and propane.

The compounds of the disclosure can be formulated for administration as suppositories. A low melting wax, such as a mixture of triglycerides, fatty acid glycerides, Witepsol S55 (trademark of Dynamite Nobel Chemical, Germany), or cocoa butter is first melted and the active component is dispersed homogeneously, for example, by stirring. The molten homogeneous mixture is then poured into convenient sized molds, allowed to cool, and to solidify.

The compounds of the disclosure can be formulated for vaginal administration. Pessaries, tampons, creams, gels, pastes, foams or sprays containing in addition to the active ingredient such carriers as are known in the art to be appropriate.

It is envisioned additionally, that the compounds of the disclosure can be attached releasably to biocompatible polymers for use in sustained release formulations on, in or attached to inserts for topical, intraocular, periocular, or systemic administration. The controlled release from a biocompatible polymer can be utilized with a water soluble polymer to form an instillable formulation, as well. The controlled release from a biocompatible polymer, such as for example, PLGA microspheres or nanospheres, can be utilized in a formulation suitable for intra ocular implantation or injection for sustained release administration, as well any suitable biodegradable and biocompatible polymer can be used.

In one aspect of the disclosure, the subject's carrier status of any of the genetic variation risk variants described herein, or genetic variants identified via other analysis methods within the genes or regulatory loci that are identified by the CNVs described herein, can be used to help determine whether a particular treatment modality for a ND, such as any one of the above, or a combination thereof, should be administered. The present disclosure also relates to methods of monitoring progress or effectiveness of a treatment option for a ND. The treatment option can include any of the above mentioned treatment options commonly used. This can be done based on the outcome of determination of the presence of a particular genetic variation risk variant in the individual, or by monitoring expression of genes that are associated with the variants of the present disclosure. Expression levels and/or mRNA levels can thus be determined before and during treatment to monitor its effectiveness. Alternatively, or concomitantly, the status with respect to a genetic variation, and or genotype and/or haplotype status of at least one risk variant for a ND presented herein can determined before and during treatment to monitor its effectiveness.

Alternatively, biological networks or metabolic pathways related to the genes within, or associated with, the genetic variations described herein can be monitored by determining mRNA and/or polypeptide levels. This can be done for example, by monitoring expression levels or polypeptides for several genes belonging to the network and/or pathway, in samples taken before and during treatment. Alternatively, metabolites belonging to the biological network or metabolic pathway can be determined before and during treatment. Effectiveness of the treatment is determined by comparing observed changes in expression levels/metabolite levels during treatment to corresponding data from healthy subjects.

In a further aspect, the genetic variations described herein and/or those subsequently found (e.g., via other genetic analysis methods such as sequencing) via targeted analysis of those genes initially identified by the genetic variations described herein, can be used to increase power and effectiveness of clinical trials. Thus, individuals who are carriers of at least one at-risk genetic variation can be more likely to respond to a particular treatment modality for a ND. In some embodiments, individuals who carry at-risk variants for gene(s) in a pathway and/or metabolic network for which a particular treatment is targeting are more likely to be responders to the treatment. In some embodiments, individuals who carry at-risk variants for a gene, which expression and/or function is altered by the at-risk variant, are more likely to be responders to a treatment modality targeting that gene, its expression or its gene product. This application can improve the safety of clinical trials, but can also enhance the chance that a clinical trial can demonstrate statistically significant efficacy, which can be limited to a certain sub-group of the population. Thus, one possible outcome of such a trial is that carriers of certain genetic variants are statistically significant and likely to show positive response to the therapeutic agent. Further, one or more of the genetic variations employed during clinical trials for a given therapeutic agent can be used in a companion diagnostic test that is administered to the patient prior to administration of the therapeutic agent to determine if the patient is likely to have favorable response to the therapeutic agent.

In a further aspect, the genetic variations described herein can be used for targeting the selection of pharmaceutical or neutraceutical agents for specific individuals. The agent can be any of the agents described in the above. Personalized selection of treatment modalities, lifestyle changes or combination of the two, can be realized by the utilization of the at-risk genetic variations or surrogate markers in linkage disequilibrium with the genetic variations. Thus, the knowledge of an individual's status for particular genetic variations can be useful for selection of treatment options, for example for treatments that target genes or gene products affected by one or more of the genetic variations. Certain combinations of variants, including those described herein, but also combinations with other risk variants for a ND, can be suitable for one selection of treatment options, while other variant combinations can target other treatment options. Such combinations of variants can include one variant, two variants, three variants, or four or more variants, as needed to determine with clinically reliable accuracy the selection of treatment module.

The invention will be further described by the following non-limiting examples.

Example 1

Sanger sequencing was performed on all 477 cases in the PD cohort. Exons and flanking sequence of the PD candidate gene NUBPL were sequenced bi-directionally. Briefly, PCR amplification was carried out in an 5 µl amplification solution comprising AmpliTaq Gold.®, PCR Master Mix (Applied Biosystems), a solution containing the target polynucleotide, and a forward PCR primer and reverse PCR primer (as indicated below).

The PCR samples were thermal cycled to conduct PCR in a thermal cycler. A two-step "boost/nest" PCR strategy was used. An initial boost reaction generating a larger fragment was performed, followed by a nest reaction, using the initial product as a template for the nest. The nest product was then sequenced. All products were sequenced on ABI 3730XL DNA sequencers.

Millipore Montage PCR384 plates were used for PCR cleanup (the boost reaction was not cleaned up, only the nest reaction). The primers utilized were as follows:

TABLE 5

| SEQ_ID | NUBPL variants[a] | Gene location (hg18) | dbSNP | PD Cases (477 Total)[b] | Controls (Total number)[c] | OR [95% CI][d] | FET[d] | Variant information[e] |
|---|---|---|---|---|---|---|---|---|
| Wild-type (normal) | | | | | | | | |
| SEQ_ID 1043 | none | chr14:31, 099, 342- 31, 401, 180 | | | | | | |
| CNVs & indels | | | | | | | | |
| SEQ_ID 1058 | chr rearrangement | chr14:30, 936, 940- 31, 350, 226 | novelf | 1 | 0 (1,005) | 6.47 [0.26-159.04] | 0.3173 | CI def. mutation |
| SEQ_ID 1059 | Loss | chr14:31, 189, 082- 31, 191, 639 | novel | 14 | 1 (1,005) | 30.06 [4.06-236.16] | 9.94E−07 | Intronic loss |
| SEQ_ID 1044 | Indel | chr14:31, 365, 813- 31, 365, 815 | novel | 19 | 0 (1,000) | 87.24 [5.26-1448.14] | 8.68E−11 | Loss of TAAAAA and gain of GA |
| SNVs | | | | | | | | |
| SEQ_ID 1045 | c. − 1C > T | chr14:31, 100, 396 | rs45468395 | 5 | 505 (16,795) | 0.34 [0.14-0.83] | 0.0086 | 1 bp from transcription start site |
| SEQ_ID 1046 | c.120C > G; p.(A40=) | chr14:31, 101, 036 | novel | 1 | 0 (12,060) | 75.93 [3.09-1866.48] | 0.0380 | High to low frequency codon change; possibly aberrant splicing |
| SEQ_ID 1047 | c.256 + 14T > C | chr14:31, 101, 186 | rs377077969 | 1 | 153 (32,858) | 0.45 [0.06-3.22] | 0.7297 | Possibly aberrant splicing |

TABLE 5-continued

| SEQ_ID | NUBPL variants[a] | Gene location (hg18) | dbSNP | PD Cases (477 Total)[b] | Controls (Total number)[c] | OR [95% CI][d] | FET[d] | Variant information[e] |
|---|---|---|---|---|---|---|---|---|
| SEQ_ID 1048 | c.413G > A; p.(G138D) | chr14:31, 212, 342 | rs201412882 | 2 | 74 (32,116) | 1.82 [0.45-7.45] | 0.3058 | Possibly damaging |
| SEQ_ID 1049 | c.514 − 32A > G | chr14:31, 326, 705 | rs7159193 | 13 | 1,079 (32,515) | 0.82 [0.47-1.42] | 0.6047 | Near splice site |
| SEQ_ID 1050 | c.545T > C; p.(V182A) | chr14:31, 326, 768 | rs61752327 | 4 | 308 (33,313) | 0.91 [0.34-2.44] | 1.0000 | Possibly damaging |
| SEQ_ID 1051 | c.593A > C; p.(N198T) | chr14:31, 326, 816 | rs11558436 | 4 | 401 (33,120) | 0.69 [0.26-1.86] | 0.6696 | Possibly damaging |
| SEQ_ID 1052 | c.685C > T; p.(H229Y) | chr14:31, 365, 663 | rs35867418 | 2 | 132 (33,347) | 1.06 [0.26-4.29] | 0.7142 | Possibly damaging |
| SEQ_ID 1053 | c.693 + 7G > A | chr14:31, 365, 678 | rs201736046[g] | 1 | 5 (33,314) | 14.00 [1.63-120.03] | 0.0818 | Near splice site |
| SEQ_ID 1054 | c.694 − 18A > T | chr14:31, 385, 410 | novel | 1 | 0 (15,188) | 95.63 [3.89-2350.55] | 0.0305 | Near splice site |
| SEQ_ID 1055 | c.815 − 27T > C | chr14:31, 389, 049 | rs118161496 | 3 | 320 (32,358) | 0.63 [0.20-1.98] | 0.6372 | CI def. mutation |
| SEQ_ID 1056 | c.815 − 13T > C | chr14:31, 389, 063 | novel[g] | 1 | 0 (32,904) | 207.16 [8.43-5092.14] | 0.0143 | Near splice site |
| SEQ_ID 1057 | c.897 + 49T > G | chr14:31, 389, 207 | rs190757053 | 1 | 3 (30,198) | 21.14 [2.20-203.65] | 0.0608 | Near splice site |

[a]CNVs detected using array CGH and SNVs detected with Sanger sequencing. SNV cDNA and protein annotation uses HGVS nomenclature [www.hgvs.org/mutnomen/] and NUBPL RefSeq NM_025152.2 for numbering.
[b]PD cohort sizes, after quality control filtering, were 467 cases for CNV analysis and 477 cases for SNV analysis.
[c]Control data for the two CNVs was 1,005 PDx controls and for indel was 1000 genomes data. Control data for the SNVs was 12-34 thousand European (Non-Finnish ancestry subjects with exome sequencing data aggregated by the Exome Aggregation Consortium (ExAC), Cambridge, MA (URL: http://exac.broadinstitute.org) [February 2015 accessed].
[d]Odds ratio (OR) values with 95% confidence interval (CI) in brackets and Fisher's Exact Test (FET) values were calculated as described herein. p-values < 0.05 are in bold.
[e]The CNV chromosomal (chr) rearrangement comprises a loss and a gain and was functionally validated by Calvo et al. 2010 [PMID 20818383]. Synonymous variant c. 120C > G [p.(40A=)] results in use of a low frequency codon, which can impact protein structure (see Kimchi-Sarfaty et al. 2007 [PMID 17185560]; Sauna & Kimch Sarfaty 2011 [PMID 21878961]). Intronic variants may result in aberrant splicing and non-synonymous variants are predicted to be 'probably damaging' via PolyPhen analysis reported by EVS. CI deficiency mutation c.815 − 27T > C was first reported by Calvo et al. 2010 [PMID 20818383], functionally validated in Tucker et al. 2012 [PMID 22072591], and found in 7 other CI deficiency patients (see Calvo et al. 2010 [PMID 20818383]; Tucket et al. 2012 [PMID 22072591]; Tenisch et al. 2012 [PMID 22826544]; Kevelam et al. 2013 [PMID 23553477]).
[f]Only 2 cases are known to have this CNV, the PD patient listed and 1 CI deficiency patient [PMID 20818383]; the CNV has not been reported in dbVar or the Database of Genomic Variants (DGV).
[g]These two variants involve the same cDNA position as two mutations (c.693 + 1G > A; c.815 − 27T > C) known to causes CI deficiency (see Calvo et al. 2010 [PMID 20818383]; Tucker et al. 2012 [PMID 22072591]; Kevelam et al. 2013 [PMID 23553477]).

In Table 5, the primers can be described as follows: BST 5' and BST 3' are the boost primers, 5' and 3' respectively; NST 5' and 3' are the nest primers; B-LEN and N-LEN are the lengths of the boost and nest products.

Sequencing of the DNA was performed asd follows: A 5 microliter reaction volume was thermocycled using an Eppendorf Mastercycler 384 according to the following program: (a) 1 minute hold at 96° C., (b) 25 cycles of 10 seconds at 96° C., then 5 seconds at 50° C., followed by 60° C. for 4 minutes. The samples were then held at 4° C. BigDye 3.1 chemistry was used for sequencing. Millipore SEQ384 plates were used for dye terminator removal.

Known and novel variants (SNPs/SNVs/indels) were identified and interpreted using NCBI's dbSNP, the Exome Variant Server (EVS) database hosted by a website at the University of Washington (evs.gs.washington.edu/EVS/), or the Exome Aggregation Consortium (ExAC) database hosted by a website at the Broad Institute (exac.broadinstitute.org) to assess their frequency in the general population. NUBPL was selected for Sanger sequencing on the basis of its high odds ratio—(OR) and strong links to PD relevant biology. It is impacted by CNVs in 15 PD cases (2 familial and 13 idiopathic). Assessment (via PubMed and OMIM) of NUBPL's gene function revealed a direct link to mitochondrial dysfunction (Calvo et al. 2010), specifically complex I deficiency, a well-known phenotype in PD patients (Schapira et al. 1989; Schapira 1993). However, Complex I deficiency (OMIM 252010) is a mitochondrial disorder (often occurring in newborns) considered to be distinct from PD and NUBPL mutations have never been reported in PD patients. All 10 exons of NUBPL in 477 PD patients were sequenced. The majority of sequencing variants (SNVs or small indels) were found at greater than ~1% frequency in dbSNP, the EVS database, or the ExAC database and thus assumed to be benign. Some NUBPL variants were found in these databases at low frequency (<1% frequency) or were novel (not present in the databases) and these may be rare, benign variants or are potentially causative of disease. For example, pathogenic mutations that cause autosomal recessive disorders will be found in the general or unselected population in a heterozygous state. Pathogenic mutations can also be found in general or unselected populations in homozygous (autosomal recessive), heterozygous (autosomal dominant), or compound heterozygous (autosomal recessive) states wherein such individuals have milder symptoms of the disorder and remain undiagnosed, or may develop the disease at a later age (e.g., Alzheimer's disease or Parkinsons' disease, which typical manifest as late onset disorders). NUBPL variants (CNVs, indel, and SNVs) were found in the PD cohort of 467 cases (CGH experiments passing quality control) or 477 cases (Sanger sequencing experiments on full cohort). Three SNVs were novel (never reported in dbSNP, EVS exome, ExAC exome databases) and found to be significantly associated with PD (p-value <0.05). One is a synonymous variant [c.120C>G; p.(A40=)], and two are intronic variants adjacent to exons (13 or 18 nucleotides from the slice site).

Example 2

Mitochondrial dysfunction has been repeatedly associated with Parkinson's disease (PD). While four redox complexes (I-IV) comprise the electron transport chain in mitochondria, reduced complex I (CI) activity is the most common mitochondrial defect and is found in PD (Mounsey et al., *Parkin. Dis.* 61:7472 (2011); Schapira et al., *Lancet,* 1:1269 (1989)). Despite the biochemical evidence for impaired CI activity, no nuclear CI genes have been associated with PD. While there have been reports associating genetic variants in mitochondrial DNA and PD, these have been inconsistent, and sometimes conflicting (Hudsone et al., *Neurology,* 80:2042 (2013); Coskun et al., *BBA* 1820:553 (2012)). By contrast, CI deficiency (MIM 252010), a rare heterogeneous disorder that often manifests in children with failure to thrive, developmental delay, and lactic acidosis, is known to occur via an autosomal recessive mechanism. To date, mutations in 23 nuclear-encoded CI genes and 6 mitochondrial-encoded CI genes have been described as causative of CI deficiency (Fassone & Rahman, *J. Med. Genet.* 49:578 (2011)).

Genetic findings, such as those shown in Table 6, support a potential association between PD and the CI gene nucleotide binding protein-like (NUBPL, gene aliases IND1, hulnd1, C14orf127). Since the identification of NUBPL as a CI assembly factor in 2008 (Bych et al., EMBO J., 27:1736 (2008); Sheftel et al., *Mol. Cell Biol.,* 29:6059 (2009)) and a 2010 report on a pediatric patient with CI deficiency with both alleles of NUBPL impacted by pathogenic mutations (Calvo et al., *Nat. Genet.,* 42:851 (2010)), NUBPL mutations have been reported in six additional unrelated cases with CI deficiency (Kevelam et al., *Neurology,* 80:1577 (2013); Tenish et al., *Neurology,* 79:391 (2012)). Interestingly, all patients carrying mutations in the NUBPL gene also had signs of leukoencephalopathy characterized by MRI patterns with specific abnormalities in the cerebellar cortex and subcortical white matter (Kevelem et al., 2013). Furthermore, three new cases of CI deficiency are reported herein (Table 6, cases 8 and 9, wherein case 8 corresponds to a family with two affected siblings).

NUBPL was identified as a potential PD gene in a genome-wide screen for copy number variants (CNVs). In a study of 467 PD cases, one patient was found with a complex chromosomal rearrangement that disrupted NUBPL and was identical to the one found in the first reported case of CI deficiency caused by NUBPL (Calvo et al., 2010; Tucker et al., Hum. Mutant, 33:411 (2012)). Exon sequencing of our PD cohort revealed additional known and novel sequence variants in the NUBPL gene associated with PD that, along with the chromosomal rearrangement, provide the first evidence that heterozygous carriers of NUBPL mutations may be at risk for developing PD.

Materials and Methods

PD Cohort

Genomic DNA samples from blood and clinical data from 477 PD patients undergoing clinical care at the Parkinson's Institute comprise the PD cohort used in the genetic studies herein. The demographics of the cohort are the following: familial (27%) and sporadic (73%) cases, a greater number of male (65%) vs. female (35%) patients, and both early-onset (<50 years of age, 10%) and late-onset cases (>50 years of age; 90%) with a median age of 67 years. Patients with known mutations in PD genes SNCA (PARK1/4), LRRK2 (PARK8), PARK2 (Parkin), PINK1 (PARK6), PARK7 (DJ-1), and GBA were excluded from this study. All subjects have been clinically assessed by movement disorder specialists with a neurological history and physical examination that includes standardized diagnostic rating by Gelb criteria (Gelb et al., *Arch. Neurol.,* 56:33 (1999)). An Institutional Review Board approved the study and all participants provided informed consent.

Control Cohort

For control samples, a cohort biobanked at Population Diagnostics, Inc. (Melville, N.Y.) was used, which is comprised of genomic DNA samples derived from blood. Briefly, the cohort is comprised of 1,005 reportedly healthy donors of European ancestry (505 males and 500 females) greater than 45 years of age. Further details on this control cohort are provided elsewhere (Prasad et al., *G3* (*Bethesda*), 2:1665 (2012)). Donors were consented and de-identified via a protocol approved by the Institutional Review Board. Genome-wide CNV data on this control cohort were used to interpret the CNV data generated on the PD cohort.

Genome-Wide Copy Number Variant (CNV) Analysis

CNV detection on DNA samples from the control and PD cohorts was performed on commercially available comparative genomic hybridization microarrays containing 1 million probes (1M CGH array) (catalog design #021529; Agilent Technologies, Santa Clara, Calif.). The experiments were performed using a 2-color labeling and hybridization format wherein the control or PD DNA sample is labeled with Cy3 and the Reference DNA is labeled with Cy5, followed by co-hybridization of the two labeled samples to the microarray. All experiments were performed with the same, sex-matched Reference DNA (healthy male or female donor, genomic DNA was isolated from whole blood). Raw data were generated in an ISO-certified service laboratory (Oxford Gene Technology, Oxford, UK) and array images and feature-extracted data files were archived and further processed at Population Diagnostics, Inc. UK, Oxford, UK using the CNV-calling algorithm DNAcopy to generate the CNV calls [14]. Quality control (QC) metrics that assesses sample and array data quality were applied to the PD experiments, with 98% of the 477 PD samples passing QC (yielding 467 PD experiments for CNV analysis).

NUBPL Chromosomal Rearrangement Breakpoint Sequencing

The chromosomal rearrangement identified in patient PI-1256 was validated using the polymerase chain reaction (PCR) primers described in Prasad et al. (2012) to confirm it was identical to the one found in a pediatric case with CI deficiency (Calvo et al. (2010); Prasad et al. (2012)).

NUBPL Exon Sequencing

Sanger sequencing was performed on all 477 cases in the PD cohort. Exons and flanking sequence of NUBPL were sequenced bi-directionally by Polymorphic DNA Technologies Inc. (Alameda, Calif.). Known and novel NUBPL variants in Table 6 were identified and interpreted using control data from NCBI's dbSNP, the 1000 Genomes Project (Genomes Project C, *Nature,* 491:56 (2012)), the Exome Variant Server, NHLBI GO Exome Sequencing Project (ESP) database [URL: evs.gs.washington.edu/EVS], and the Exome Aggregation Consortium (ExAC) database [exac.broadinstitute.org].

TABLE 6

Comparision of NUBPL rare and pathogenic variants and clinical summary of CI deficiency and PD cases.

| NUBPL variant | Predicted effect | Gene location | Ref[a] | CI deficiency cases[b] | | | | | | | | | PD cases[c] | | | | | | | | |
|---|---|---|---|---|---|---|---|---|---|---|---|---|---|---|---|---|---|---|---|---|---|
| | | | | 1 | 2 | 3 | 4 | 5 | 6 | 7 | 8 | 9 | 1 | 2 | 3 | 4 | 5 | 6 | 7 | 8 | 9 |
| Del/Dup[d] | Disrupted protein | Ex 1-7 | 1, N | + | | | | | | | | | + | | | | | | | | |
| c.120C > G | p.A40= | Ex 2 | N | | | | | | | | | | | + | | | | | | | |
| c.166G > A[e] | p.G56R | Ex 2 | 1, 3 | + | + | + | + | + | + | ? | | + | | | | | | | | | |
| c.205_206delGT | p.V69Yfs*80 | Ex 2 | 2 | | | | | | | + | | | | | | | | | | | |
| c.311T > C | p.L104P | Ex 4 | N | | | | | | | | + | | | | | | | | | | |
| c.313G > T | p.D105Y | Ex 4 | 3 | | | | + | | | | | | | | | | | | | | |
| c.579A > C | p.L193F | Ex 7 | 3 | | | | | | | + | | | | | | | | | | | |
| c.667_668ins[e] | p.E223Afs*4 | Ex 8 | 3 | | | + | | | | | | | | | | | | | | | |
| c.693 + 1G > A | Altered splicing | In 8 | 3, N | | | | | + | | | | + | | | | | | | | | |
| c.693 + 7G > A | Altered splicing | In 8 | N | | | | | | | | | | | | | + | | | | | |
| c.694 − 18A > T | Altered splicing | In 8 | N | | | | | | | | | | | | | | + | | | | |
| c.815 − 27T > C[f] | Altered splicing | In 9 | 1-3, N | + | + | + | + | + | + | + | + | + | | | | | | + | + | + | |
| c.815 − 13T > C | Altered splicing | In 9 | N | | | | | | | | | | | | | | | | | | + |
| c.897 + 49T > G | Altered splicing | In 10 | N | | | | | | | | | | | | | | | | | | + |

Clinical summary.

| | 1 | 2 | 3 | 4 | 5 | 6 | 7 | 8 | 9 | 1 | 2 | 3 | 4 | 5 | 6 | 7 | 8 | 9 |
|---|---|---|---|---|---|---|---|---|---|---|---|---|---|---|---|---|---|---|
| CI activity (% of lowest reference value)[f] | 19 | na | 27 | 60 | na | 83 | 31 | 100 | 100 | ———na——— | | | | | | | | |
| PD subclass: F = familial, S = sporadic | | | | | | | | | | S | S | F | F | S | S | S | S | S |
| PD cases with other movement disorders[g] | | | | | | | | | | R | | R | | | | | | D |
| Family history of movement disorders[g] | na | na | na | R, ET | na | na | na | R, T, ET | P, T ET | R | | P | P | | | | T | |

| NUBPL variant | ExAC European subjects[d] | |
|---|---|---|
| | Genotypes | Freq. (%) |
| Del/Dup[d] | Novel | |
| c.120C > G | Novel | |
| c.166G > A[e] | AA = 0/AG = 16/GG = 29,802 | 0.054 |
| c.205_206delGT | Novel | |
| c.311T > C | CC = 0/CT = 20/ TT = 33,186 | 0.060 |
| c.313G > T | TT = 0/TG = 1/GG = 33,213 | 0.003 |
| c.579A > C | Novel | |
| c.667_668ins[e] | Novel | |
| c.693 + 1G > A | AA = 0/AG = 1/GG = 33,324 | 0.003 |
| c.693 + 7G > A | AA = 0/AG = 5/GG = 33,309 | 0.015 |
| c.694 − 18A > T | Novel | |
| c.815 − 27T > C[f] | CC = 2/CT = 316/TT = 32,040 | 0.983 |
| c.815 − 13T > C | Novel | |
| c.897 + 49T > G | GG = 0/GT = 3/TT = 30,195 | 0.010 |

[a]Variants first reported herein in PD or CI deficiency cases are indicated as new (N) and previously reported variants in CI deficiency cases are as follows: 1. Calvo et al. 2010 [8], 2. Tenisch et al. 2012 [10], 3. Kevelam et al. 2013 [9].
[b]CI deficiency cases 1-7 were previously reported (see Footnote [a]) and cases 8 (two siblings) and 9 are newly reported (see Methods, FIG. 2-4). All PD cases are newly reported findings. Each case found with a particular variant is indicated by a plus symbol (+) and all cases are heterozygous for the reported variants except for CI deficiency case 2 (presumed to be homozygous for both variants [9]). CI deficiency notes: cases 4 and 8 correspond to two affected siblings; case 7 (see also Footnote [e]) is reported herein as having the c.815 − 27T > C variant, although the variant was reported by Tenisch et al. [10] as c.815 − 217T > C (we presume this was a typographical error, since the corresponding protein variant was reported as p.Asp273Ginfs*32, which appears to be the same as the p.D273QfsX31 protein variant reported by Tucker et al. [11]). Countries of origin for the cases are as follows:
    CI deficiency: 1 Australia    4 Canada    7 France    PD: 1-9 United States
    2 Argentina    5 United States    8 United States
    3 Germany    6 Netherlands    9 United States
[c]Variant frequencies (Freq.) in the general population (ExAC exome database; see Methods and Table 1, Footnote [c] are reported as percentages.
[d]Del/Dup is the chromosomal rearrangement (257Kb Del/138Kb Dup), see Methods and Table 1. The full description for c.667_668ins is c.667_668insCCTTGTGCTG[9].
[e]Variants c.166G > A and c. 815 − 27T > C are found on the same haplotype in CI deficiency cases 1-6 and 9 (case 2 may be an exception [9]). For case 7 (?), c.166G > A allele status is unknown [10]. CI deficiency case 8 and PD cases 5-7 do not have the same c.166G > A variant.
[f]CI activity are ETC assay results on patient fibroblasts except for cases 7 and 8 (muscle biopsy); results for CI deficiency cases 2 and 5 and the PD cases were not available (na). CI deficiency case 4, which represents a pair of siblings, is the average of their CI activities (individual values were 56 and 64). All values were previously reported [8-10] except for cases 8 (Sibling A) and 9 (see Methods, S1 File), who both tested in the normal range for CI activity (reported as 100).
[g]Presence of other movement disorders in PD cases or movement disorders in family members of CI deficiency or PD cases are indicated by: D = dystonia, ET = essential tremor, R = restless legs syndrome, P = Parkinson's disease, T = tremor (see Methods, S1 Table, S1 file). Movement disorder family history for CI deficiency cases 8 and 9 are detailed in FIG. 4 and was obtained for previously published case 4 (see Footnote [b]), but were not available (na) for other previously reported CI deficiency cases (1-3, 5-7).

NUBPL Splice Site Prediction

Splice site prediction was performed on intronic variants and the synonymous variant (p.A40=) in Table 6 using the Human Splicing Finder (HSF, v.2.4.1), which is hosted at: www.umd.be/HSF/ (Desmet et al., *Nucl. Acids Res.*, 37:e67 (2009)). Splice site analysis for the synonymous variant predicted potentially altered splicing via three mechanisms: activation of an exonic cryptic donor site, destruction of an exonic splicing enhancer (ESE) motif, and creation of an exonic splicing silencer (ESS) motif. Splice site analysis for the six intronic variants predicted altered splicing via creation or destruction of ESE or ESS motifs, alteration of the splice donor and/or acceptor site, or alteration of the branch point.

Results

Genome-Wide CNV Analysis Identifies a PD Patient with a Chromosomal Rearrangement Impacting NUBPL The genome-wide CNV screen identified one PD patient with a complex chromosomal rearrangement on chromosome 14 that disrupts the NUBPL gene (FIGS. 1A, B) via deleted (254 Kb) and duplicated (134 Kb) regions. The rearrangement was not found in 1,005 controls and PCR analysis (FIG. 1B) and breakpoint sequencing confirmed that this rearrangement is identical to the previously described alteration in a child with CI deficiency (Calvo et al., 2010; Tucker et al., 2012).

Sequencing of NUBPL Identifies Three Novel NUBPL Variants in the PD Cohort

Three unique SNVs were identified in the NUBPL gene that were statistically significant (FET <0.05), were not reported in unselected (i.e., 'control') populations (dbSNP, 1000 Genomes, EVS, and ExAC databases), and had odds ratios (ORs) of 75.93-207.16: a synonymous SNV [c.120C>G; p.(A40=)] and two intronic SNVs (c.694-18A>T and c.815-13T>C). Three additional known SNVs were found in the PD cohort at higher frequency relative to controls (ORs 1.82-21.14), but did not reach significance, although c.693+7G>A and c. 897+49T>G were nominally associated (FET 0.06-0.08). The c.-1C>T variant is potentially protective against PD, with an OR value of 0.34 (FET=0.0086). The remaining SNVs were found at appreciable frequency in the SNV databases and are likely benign (ORs 0.45-1.06), with the exception of c.815-27T>C, as discussed below.

Three PD cases in the cohort were found to have a c.815-27T>C aberrant splicing mutation that was previously found in all 7 unrelated CI deficiency cases (Calvo et al., 2010; Kevelem et al., 2013; Tucker et al., 2012; Tenisch et al. 2012). However, the PD cases did not carry a second non-synonymous c.166G>A (p.G56R) variant that was present on the same allele in all CI deficiency patients with the c.815-27T>C mutation. Thus, the three PD cases have an alternate haplotype than is found in the majority of CI deficiency patients. The frequency of the two haplotypes (c.815-27T>C found in this PD cohort and c.815-27T>C plus c.166G>A found in CI deficiency patients) is presently unknown in the general population but the frequency of each variant, independent of haplotype, in the ExAC db of about 33,000 European (non-Finnish) ancestry subjects is 0.98% for the c.815-27T>C variant and 0.054% for the c.166G>A variant, which indicates that the CI deficiency patients have a rarer haplotype as was found in the present PD cases.

In Silico Analysis of Functional Impact of NUBPL Variants

The novel synonymous SNV [c.120C>G; p.(A40=)] corresponding to an alanine at position 40 in the NUBPL protein may be pathogenic (Hunt et al., *Methods Mol. Biol.* 578:23 (2009); Kimchi-Sarfaty et al., *Science* 315:525 (2007); Sauna et al., *Nat. Rev. Genet.*, 12:683 (2011)). There is ample evidence that these variants can be causative by producing splicing defects, altering RNA stability/structure, or impacting protein translation rates (Sauna et al., 2011). Analysis of the c.120C>G [p.(A40=)] variant revealed that the GCC codon (wild-type) is more frequently used than the GCG codon (novel in this PD cohort), a change from 27.7 to 7.4, which is one of highest differentials found for the 20 amino acids (Nakamura et al., *Nucl. Acids Res.*, 28:292 (2000)). While this change in codon frequency suggests a potential mechanism of pathogenicity, functional validation will be required.

Clinical Summary for Patients with PD-Associated NUBPL Variants

Clinically, all patients had typical late-onset PD (3 familial, 6 sporadic) with an age of onset range of 60-73 years. Most patients had a good response to levodopa except for the patient with the complex rearrangement of the NUBPL gene, who presented with a more rapidly progressing form of PD and autonomic involvement. See Table 7 for an overview of the patient's clinical features.

Interestingly, newly reported cases of CI deficiency (Table 6, cases 8 and 9) and newly ascertained family history on a previously reported case (Table 6, case 4) report a family history of ET, PD, or RLS in the maternal and paternal lines for these cases, which further supports the association of NUBPL variants with PD. In fact, thus far, all families with one or more patients diagnosed with NUBPL Complex I deficiency report a history of movement disorders in older family members (family histories could not be ascertained for 6 of 9 families, cases 1-3 and 5-7 in Table 6).

Of further note there are certain clinical symptoms that have been reported in PD patients and/or their family members, which are known to be (or are likely) carriers of NUBPL mutations or variants, including but not limited to tremor, which is a symptom in both PD and essential tremor (ET), and restless legs syndrome (RLS). For example, tremor was reported in the mother of PD patient ID 1870, who is reported to have the NUBPL variant c.815-13T>C. Furthermore, two PD patient (IDs 1256 and 1801) with NUBPL variants were diagnosed with RLS and the sister (NUBPL variant status unknown, DNA was unavailable) of patient ID 1256 was also diagnosed with RLS. Overlapping phenotypes and co-occurrence of RLS and PD have been reported (e.g., see Peeraully and Tan 2012, PMID 23211049) but more studies are needed, especially if a correlation exists only for PD cases with specific genetic subtypes. For example, the genetic subtype of PD may consist of clinical features more consistent with multiple system atrophy (MSA). Evidence for this was found for the clinical presentation in PD patient ID 1256 (who has a chromosomal rearrangement that disrupts NUBPL), which was compatible with diagnosis of PD, but differential diagnosis of multiple system atrophy (MSA) was also considered because of the presence of urinary incontinence, low blood pressure, and absence of clear benefit from L-dopa (e.g., see Stamelou et al. 2013, PMID 23720239; Fereshtehnejad and Lokk, PMID 24634790). Given the constellation of movement disorder symptoms and overlap between neurological diseases such as PD, ET, RLS, and MSA, it can be appreciated by those skilled in the art that co-occurrence of two or more clinical diagnoses (e.g., PD and ET, PD and RLS, or ET and RLS) is not unexpected and in fact has been reported in the literature (e.g., see Peeraully and Tan 2012, PMID 23211049; Zimprich 2011, PMID 21734494; Vilarino-Guell et al. 2010, PMID 20369371; Raiput et al. 2014, PMID 25118025). The molecular pathology of neurological disorders can also be distinct or overlapping. For example, high or low irons levels can be a hallmark feature of a particular disorder, such as high brain iron levels in PD patients and iron deficiency in RLS patients, yet there are many reported cases of PD co-occurring with RLS. Thus, it can be appreciated by those skilled in the art that, depending on the specific molecular (e.g., decreased complex I activity) or genetic (e.g., pathogenic NUBPL mutations) subtype of the disorder, a tailored treatment regimen may involve use of opposing therapeutic strategies such as iron supplementation vs. iron chelation (e.g., see Satija and Ondo 2008, PMID 1848792; Hare et al. 2013, PMID 23874300; Ayton et al. 2014, PMID 25011704) depending on which molecular or genetic subtype is found in the patient. In other words, some diagnosed cases of PD (and/or RLS, ET, MSA, etc.) may 2003 study did not pinpoint a specific gene in the linkage interval, the region is immediately adjacent to the NUBPL locus, which is a complex repetitive region in the genome. In fact, a second linkage peak reported in Bonati et al. 2003 does encompass the NUBPL gene, which lies between microsatellite markers D14S275 and D14S70. It can be appreciated by those skilled in the art that other genes involved in mitochondrial dysfunction, particularly variants found in other complex I genes, including but not limited to NDUFAF2, NDUFC2, NDUFC2-KCTD14, NDUFS4, and NDUFV1, may have associations not only with PD, but also ET, RLS, and MSA, or any combination of symptoms described for this set of neurological disorders.

TABLE 7

Clinical information for PD patients with rare or pathogenic NUBPL variants

| NUBPL variants[a] | Patient ID | Case type | Gender | Age of onset | Initial symptoms | Cardinal symptoms[b] | Levodopa response | Additional features[c] | Family history[d] |
|---|---|---|---|---|---|---|---|---|---|
| 257Kb Del/138Kb Dup | PI-1256 | Sporadic | F | 64 | Weakness and loss of dexterity in right hand | AS, B, R, T, PI | No clear benefit | Autonomic: low blood pressure, urinary incontinence; restless leg syndrome | Restless legs syndrome in sister |
| c.120C > G; p.(A40=) | PI_1399 | Sporadic | F | 73 | Tremor right hand | AS, B, PI, R, T | Good (650 mg) | N/A | None |
| c.693 + 7G > A | PI-1801 | Familial | M | 63 | Tremor in left leg | AS, B, R, T | Not used; DA agonist (ropinirole) | Restless leg syndrome | PD in maternal grandmother; ALS in maternal uncle; psychiatric illness in mother |
| c.694 − 18A > T | PI-1730 | Familial | M | 68 | Tremor in left arm and leg | AS, B, R, T | Good (700 mg) | Depression, anxiety, brain MRI normal | Dementia in father and mother; PD in uncle and cousin |
| c.815 − 27T > C | PI-1035 | Sporadic | M | 62 | Tremor in right hand, slowing of gait | AS, B, PI, T | Good (1500 mg) | MMSE 29/30 | None |
|  | PI-1370 | Sporadic | M | 62 | Slowing of gait, change in hand writing | AS, B, R, T | Good (350 mg) | Anxiety | MS in sister |
|  | PI-1297 | Sporadic | M | 63 | Changes in right hand dexterity, reduced arm swing | AS, B, R | Good (1150 mg) | Dystonie right foot, mild to moderate dyskinesis | None |
| c.815 − 13T > C | PI-1870 | Sporadic | F | 66 | Tremor in left hand | AS, B, R, T | Good (650 mg) | Had stroke in 2005, MOCA 22/30 | AD in maternal aunt; tremor in mother |
| c.897 + 49T > G | PI-1016 | Sporadic | M | 25 | Tremor in head, raspy speech | AS, B, R, T | No clear benefit | Segmental dystonia; MRI, EEG, EMG were normal | None |

[a]NUBPL variants found in PD cases that are rare in the population (ExAC European frequency < 0.0002) and/or functionally validated as pathogenic (see Table 1)
[b]AS = asymmetry at onset, B = bradykinesia, PI = postural instability, R = rigity, T = tremor
[c]N/A = no additional features noted in clinical record; MSE = Mini Mental State Examination, MOCA = Montreal cognitive assessment
[d]none = no known family history of PD; AD = Alzheimer's disease, ALS = amyotrophic lateral sclerosis, MS = multiple sclerosis, PD = Parkinson's disease benefit from iron supplementation, whereas other cases may benefit from iron chelation therapy. Genetic and molecular evidence have been found that pathogenic or associated variants in NUBPL, an Fe—S protein required for proper assembly of complex I, link the neurological disorders complex I deficiency, PD, ET, and RLS, which is consistent with the genotype-phenotype correlations reported herein (Table 6). Furthermore, genetic evidence for the role of NUBPL in RLS is corroborated by report of a linkage peak on chromosome 14 that was mapped in an Italian kindred (see Bonati et al. PMID 12764067). While the Bonati et al.

Discussion

This study provides the first genetic evidence of an association between PD and the NUBPL gene, which had previously been reported to cause CI deficiency in seven pediatric cases via a recessive mechanism (Calvo et al. Nat Genet. 2010 October; 42(10):851-8; Kevelam et al. Neurology. 2013 Apr. 23; 80(17):1577-83; Tenisch et al. Neurology. 2012 Jul. 24; 79(4):391; Tucker et al. Hum Mutat. 2012 February; 33(2):411-8). Precedents exist for genes causing early onset and severe clinical presentation when both alleles contain pathogenic mutations, and milder symptoms and later onset when only one allele is impacted by a deleterious mutation. As with the established association between PD and the GBA gene that causes the rare disorder Gaucher disease (MIM 606463) (Sidransky et al. N Engl J Med. 2009 Oct. 22; 361(17):1651-61; Sidransky Discov Med. 2012 October; 14(77):273-81), it can be appreciated by those skilled in the art that individuals heterozygous for NUBPL mutations may have an increased risk for development of PD. Also reported herein are three new patients with CI deficiency in two unrelated families that are compound heterozygotes for known mutations and one novel mutation (p.L104P) and, for the first time, report the presence of ET, PD, RLS, or tremor in families with a CI deficiency patient. Indeed, out of three such families, for which family histories were available, all demonstrate this association (two new families described herein and one family from a previously reported case (Kevelam et al. 2013). These new genetic findings in PD and CI deficiency, along with the link to other movement disorders, add to the extensive evidence for mitochondrial dysfunction in early and late onset neurological disorders and provide a basis for the nomination of NUBPL as a new gene that causes or contributes to PD pathology, and ET and RLS.

The important findings are that one of the PD patients has an identical chromosomal rearrangement of the NUBPL gene as was found in a patient with CI deficiency and that three novel NUBPL SNVs (Table 6) in the PD cohort have an OR >76 and are statistically significant. It is not surprising to discover a genetic association between PD and mitochondrial complex I gene NUBPL given that mitochondrial impairment is one of the major disease-associated mechanisms of neurodegeneration found in PD (reviewed in (Schapira et al., 1989; Henchcliffe and Beal *Nat. Clin. Pract. Neurol.*, 4:600 (2005)). Furthermore, several mitochondrial toxins (e.g., MPTP or rotenone) inhibit CI activity and cause nigrostriatal cell death and have been utilized extensively in vivo and in vitro to model PD.

The NUBPL protein is required for assembly of the CI enzyme (NADH:ubiquinone oxidoreductase), which is the largest (about 1 MDa) of the respiratory chain components and is comprised of 45 subunits (38 are nuclear-encoded, 7 are mitochondrial-encoded (Scheftel et al., 2009). Nine assembly factors have recently been found to cause CI deficiency (Nouws et al. *Brain* 135:12 (2012)) but NUBPL may be particularly important, because, thus far, it is the only CI assembly factor that is an Fe/S protein and it likely transfers Fe/S to CI's 8 Fe/S clusters (Scheftel et al., 2009), which is critical for the mitochondrial electron transport.

An interesting parallel to the present NUBPL genetic findings is the GBA gene and the increased risk for heterozygous carriers developing PD. In 1996, the first report of GBA mutations in PD appeared (Neudorfer et al., *QJM* 89:691 (1990)), followed by numerous papers with supporting but inconclusive results. It was not until a large multi-center study conducted with over 5,000 patients and controls that firmly established GBA mutations were associated with typical late-onset PD (Sidransky et al., *NEJM* 361:1651 (2009)). Mutations in the GBA gene cause autosomal-recessive W Gaucher's disease but a single mutation in the GBA gene is predisposing (5-fold increased risk) to late-onset typical PD (Sidransky, *Discov. Med.*, 14:273 (2012)).

An analogous mechanism for the NUBPL gene is hypothesized, wherein loss of function mutations impacting both alleles cause CI deficiency in children and young adults, while carriers of NUBPL pathogenic mutations have a higher risk for developing late-onset PD. Another similar example was recently described in three PD cases who are heterozygous carriers of NPC1 mutations, which causes Niemann-Pick disease (MIM 257220) (Kluenemann et al., *J. Neuro. Sci.*, 335:219 (2013)).

Given the overlap in NUBPL mutations between CI deficiency and PD, the compelling and well-established mitochondrial dysfunction as a key mechanism of PD, and analogous findings for an increased risk in heterozygous GBA mutation carriers for PD, broader screening of larger cohorts of cases and controls via sequencing and copy number microarrays is warranted to support the association between NUBPL variants and PD. Functional validation of PD-associated variants will further confirm if heterozygous carriers of NUBPL variants that reduce CI activity are at increased risk for PD.

Example 3

The data was generated on the basis of a comparison of copy number variants (CNVs) identified in 2 cohorts:
 1. 1,005 Normal individuals (Normal Variation Engine—NVE);
 2. 565 Parkinsons Disease (PD) cases (477 samples obtained from The Parkinson's Institute and Clinical Center, Sunnyvale, Calif. 94085, USA and 87 samples obtained from the Coriell Institute, Camden, N.J., USA—NINDS cohort details can be found at ccr.coriell.org/Sections/Collections/NINDS/DNAPanelDetail.aspx.)

Genomic DNA Sample Hybridization—NVE and PD Cohorts

Genomic DNA samples from individuals within the Normal cohort (NVE 'test' subjects) and from the PD cohort (PD 'test' subjects) were hybridized against a single, sex-matched reference individual as follows. Reference DNA samples were labeled with Cy5 and test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 µm resolution, using Agilent's DNA microarray scanner, generating tiff images for later analysis.

All tiff images were analyzed using Agilent Feature Extraction (FE) software, with the following settings:
Human Genome Freeze: hg18:NCBI36:Mar2006
FE version: 10.7.3.1
Grid/design file: 021529_D_F_20091001
Protocol: CGH_107_Sep09

This procedure generates a variety of output files, one of which is a text-tab delimited file, containing about 1,000,000 rows of data, each corresponding to a specific feature on the array. This *.txt file was used to perform CNV calling using DNAcopy, an open source software package implemented in R via BioConductor (www.bioconductor.org/packages/release/bioc/html/DNAcopy). Losses or gains were determined according to a threshold log 2ratio, which was set at −/+0.35. In other words, all losses with a log 2ratio value <=−0.35 were counted, as were all gains with a log 2ratio >=+0.35. All log 2ratio values were determined according to Cy3/Cy5 (Test/Reference). A minimum probe threshold for CNV-calling was set at 2 (2 consecutive probes were sufficient to call a CNV). A CNV list was thus generated for each individual in the 2 cohorts.

There were a total of 162,316 CNVs in the NVE cohort of 1,005 individuals (an average of 162 CNVs per individual). Using custom scripts, these CNVs (many of which appeared in multiple individuals) were 'merged' into a master list (NVE-master) of non-redundant CNV-subregions, according to the presence or absence of the CNV-subregion in individuals within the cohort. Using this approach, the NVE-master list has 14,693 distinct CNV-subregions, some of which are uniquely present in a single individual and some of which are present in multiple individuals. For example, consider 3 individuals within the NVE cohort with the following hypothetical CNVs:

A. Chr1:1-100,000;
B. Chr1:10,001-100,000;
C. Chr1:1-89,999;

In the master list, these would be merged into 3 distinct CNV subregions, as follows:

| CNV-subregion 1 | Chr1: 1-10,000 | Patients A, C |
| CNV-subregion 2 | Chr1: 10,001-89,999 | Patients A, B, C |
| CNV-subregion 3 | Chr90,000: 1-100,000 | Patients A, B |

There were a total of 88,627 CNVs in the PD cohort of 565 individuals (an average of 157 CNVs per individual). Using custom scripts, these CNVs (many of which appeared in multiple individuals) were 'merged' into a master list (PD-master) of non-redundant CNV-subregions, according to the presence or absence of the CNV-subregion in individuals within the cohort. Using this approach, the PD-master list has 11,584 distinct CNV-subregions, some of which are uniquely present in a single individual and some of which are present in multiple individuals.

CNV-subregions of interest were obtained after:
1. Annotation using custom designed scripts in order to attach to each CNV region relevant information regarding overlap with known genes and exons;
2. A calculation of the odds ratio (OR) for each CNV-subregion, according to the following formula:
OR=(PD/(100−PD))/(NVE/(1005−NVE))
where:
PD=number of PD individuals with CNV-subregion of interest
NVE=number of NVE individuals with CNV-subregion of interest As an illustrative example, consider the CNV subregion chr2:99221389-99281387, which is found in 1 individual in the NVE cohort and 3 individuals in the PD cohort. The OR is:

(3/(562))/(1/(1004))=5.35

Note that, by one convention, if either of NVE or PD=0, a value of 0.5 is added to all 4 entries in the main formula above*, in order to avoid dealing with infinities. This has the effect of artificially lowering OR values in cases where no individuals within the NVE have the CNV. This method is applicable to all the calculations in FIGS. 8-11. This method is also used when calculating the Fisher's 2-tailed Exact Test (FET) in the event that any one of the variables is zero.

CNV-subregions/genes that fulfill one of the following criteria were identified:
1. Strong biology linking the CNV-subregion and/or the gene it overlaps, with known pathways/mechanisms or biology in PD (in some cases, statistical evidence is lacking but does not exclude the CNV-subregion as a candidate)
2. Statistical analysis combined with strong biology without obvious biological connection (best FET in this category was 3.25E-10);

It can be appreciated by those skilled in the art that the number of PD candidate CNV-subregions, irrespective of category, may increase or decrease as additional PD cohorts are analyzed.

Description of Sequence Data

The sequence file contains genomic sequence information for (in the following order):
A. All distinct CNVs listed in FIG. 8A;
B. The full genomic extent of the transcripts listed in 11A;
Note that:
1. Higher priority SEQ IDs have lower numbers. Thus, SEQ ID NO:1 represents the highest priority gene, etc;
2. SEQ ID NOs:1-197 are the CNV sequences from FIG. 8A;
3. SEQ ID NOs:198-805 are the transcript sequences from FIG. 11A.

Examples of sequences:
SEQ ID NO:1=80,262 bp CNV (gain) at chr2:99201125-99281387 involving genes LYG1, LYG2; and SEQ ID NO:198=LYG2, transcript NM_175735, which is 12,860 bp in length:

The basis of this application with novel PD genes was to mine the PD cohort CNV data for:
1. Gains or losses impacting 1-2 PD cases but are not found in Normals (n=1,005) and that impact genes with strong PD-relevant biology.
2. Gains or losses occurring in intergenic regions but are near genes with strong PD-relevant biology.

Thus, this data mining process is biology-driven. Even a single PD case with a CNV can be causal or contributing to PD on the basis of the following criteria:
1. There are fewer CNVs in the genome relative to other classes of variants (e.g., SNVs); so one PD case with a CNV that is not found in Normals may be relevant.
2. CNVs, due to their large size (> about 5,000 bp), are more likely to impact the function or expression of a gene as compared to an SNV (1 bp).
3. Assessment of the known biology for the gene with respect to PD.

Additional genes, regions are included in FIGS. 8D, 9D, 10D and 11D. Those include protective variants (PVs) as well as causal variants (CVs) Because PVs may be completely absent from PD cases, and, in order to define herein the extent and details of the CNVs that are protective, FIG. 8B lists the original CNVs for all participants in the study (cases and controls). Hence, some of the CNV entries listed in FIG. 8B are found only in controls. This is made clearer in FIG. 9B, wherein the actual CNV_subregions are detailed, including the multiple occurrences in NVE cases (normals) for those subregions not found in PD cases. An extra column has been added to FIG. 9B, to delineate which CNV_subregions are being tagged as PVs (low ORs);

FIG. 8 shows exemplary regions with genetic variations that are associated with PD. For each variation, the following may be provided: chromosome, original CNV start, original CNV stop, original CNV size, CNV type, PD case ID, RefSeq gene symbol, and SEQ ID No. corresponding to that region. FIGS. 8A-D list all CNVs of interest, with the exception that, for each entry, the original CNV start and stop positions are noted, along with original CNV size, type (loss or gain), case ID and gene annotation (for the CNV-subregion NOT original CNV). FIG. 8A provides CNVs corresponding regions associated with SEQ ID NOs:1-197. FIG. 8B provides CNVs corresponding to regions in SEQ ID NOs:1059-1340. FIG. 8C provides CNVs corresponding to regions in SEQ ID NOs:1621-2002. FIG. 8D provides CNVs corresponding to regions in SEQ ID NOs:806-916. The final column in FIG. 8A contains SEQ ID numbers for exemplary genes/CNV subregions, which also correspond to higher priority genes/CNV subregions. Thus, SEQ ID NO:1 has the highest priority, SEQ ID NO:2 has the next highest priority.

FIG. 9 shows exemplary subregions with genetic variations that are associated with PD. For each variation, the following may be provided: chromosome, CNV subregion start, CNV subregion stop, CNV subregion size, CNV type, PD case ID(s), RefSeq gene symbol, exon overlap, NVE cases, PD cases, FET, OR, and category. FIGS. 9A-D are similar to FIGS. 8A-D but there are a number of exceptions. Firstly, the CNV coordinates listed refer to the actual CNV-subregions found to be unique or significantly different between the disease and normal cohorts, as opposed to FIG. 8, which lists the original CNVs. Secondly, an extra column details whether genic CNV-subregions of interest overlap an exon or not. Third and fourth, 2 extra columns detail the number of normal cases and the number of disease cases that harbor the relevant CNV-subregion. Finally, 3 columns report Fisher's 2-tailed Exact Test (FET), odds ratio (OR) and the Category under which the CNV-subregion falls wrt significance. FIG. 9A provides CNV subregions corresponding to regions associated with SEQ ID NOs:1-197. FIG. 9B provides CNV subregions corresponding to SEQ ID NOs: 1059-1340. FIG. 9C provides CNV subregions corresponding to SEQ ID NOs:1621-2002. FIG. 9D provides CNV subregions corresponding to regions associated with SEQ ID NOs:806-916

FIG. 10 is a summary of the characteristics of the regions associated with PD. FIG. 10A provides CNV subregions corresponding to regions associated with SEQ ID NOs:1-197 in. FIG. 11B provides CNV subregions corresponding to SEQ ID NOs: 1059-1340. FIG. 10C provides CNV subregions corresponding to SEQ ID NOs: 1621-2002. FIG. 10D provides CNV subregions corresponding to SEQ ID NOs: 806-916

FIG. 11 is a summary of transcripts in the regions associated with PD and SEQ ID numbers therefor. FIG. 11A is a summary of transcripts associated with SEQ ID NOs:1-197, e.g., those having SEQ ID Nos. 198-805. FIG. 11B is a summary of transcripts associated with SEQ ID NOs: 1059-1340, e.g., those corresponding to SEQ ID Nos. 1341-1620. FIG. 11C is a summary of transcripts associated with SEQ ID NOs:1621-2002, e.g., those having SEQ ID NOs: 2003-2640. FIG. 11D is a summary of transcripts associated with SEQ ID NOs:806-915, e.g., those having SEQ ID Nos. 918-1042.

An example that illustrates this process is NUBPL on the basis of statistics alone (a total of 15 cases were found to have a CNV: 1 case with a large 364 Kb CNV+14 cases with an identical small 2.6Kb CNV). However, if only the large NUBPL CNV had been considered, the biology-driven analysis algorithm would have found:
1. The large CNV found in 1 PD case is not found in 1,005 Normals (OR=6.45).
2. The large CNV disrupts over half of the NUBPL gene, which would result in loss of function for this allele.
3. Assessment of the biology for NUBPL in the literature (PubMed) reveals that it is a cause of Complex I (CI) deficiency when both alleles are mutated (autosomal recessive disorder). Decreased CI activity is a hallmark pathology of PD that has been known for many years and lower CI activity has been observed for some mutations even if only 1 allele is mutated.

Example 4

Figure 2:
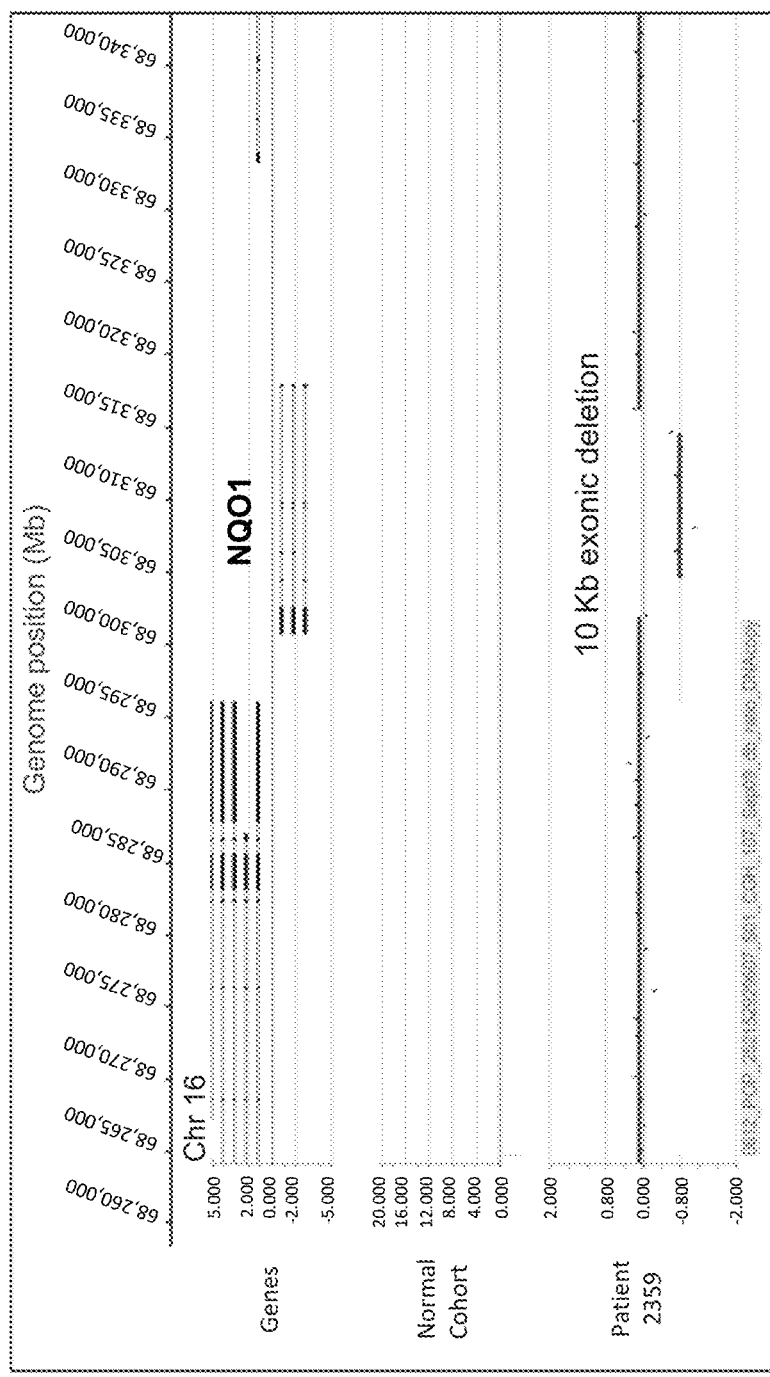
FIG. 2. A 10 Kb exonic deletion detected in 1 Parkinson's disease (PD) case and 0 normal subjects (OR=6.45, FET=0.10).

FIG. 2 illustrates a 10 exonic deletion in NQO1. While NQO1 common variants have been linked to PD, reassessment of these studies (www.pdgene.org) found there was no association for most. The GWAS catalog of published studies does not list any NQO1 variants for PD or for any disease or phenotype. However, there is ample evidence that up-regulation of NQO1 is neuroprotective in PD and this 10 Kb loss of function rare variant is likely to be pathogenic.

Figure 3:
FIG. 3. Triplication detected in 3 PD cases and 1 normal subject (OR=5.45, FET=0.13). The 82 Kb triplication impacts two neighboring lysozyme G-like genes (LYG2 and LYG1).

FIG. 3 shows a large triplication associated with lysozyme G-like genes. While limited gene information is available for the goose-type (G-like) genes, another lysozyme family member (LYZ) can form amyloid fibrils and LYZ mutations are know to cause Familial Amyloidosis (OMIM 153450). Gene triplication is a mutational mechanism that occurs for the known PD gene SNCA and, interestingly, 1 of the 3 PD cases with the LYG2/LYG1 triplication was suspected of having an SNCA triplication based on a brain pathology report but CGH analysis showed no copy number changes impacting the patient's SNCA gene.

Figure 4:
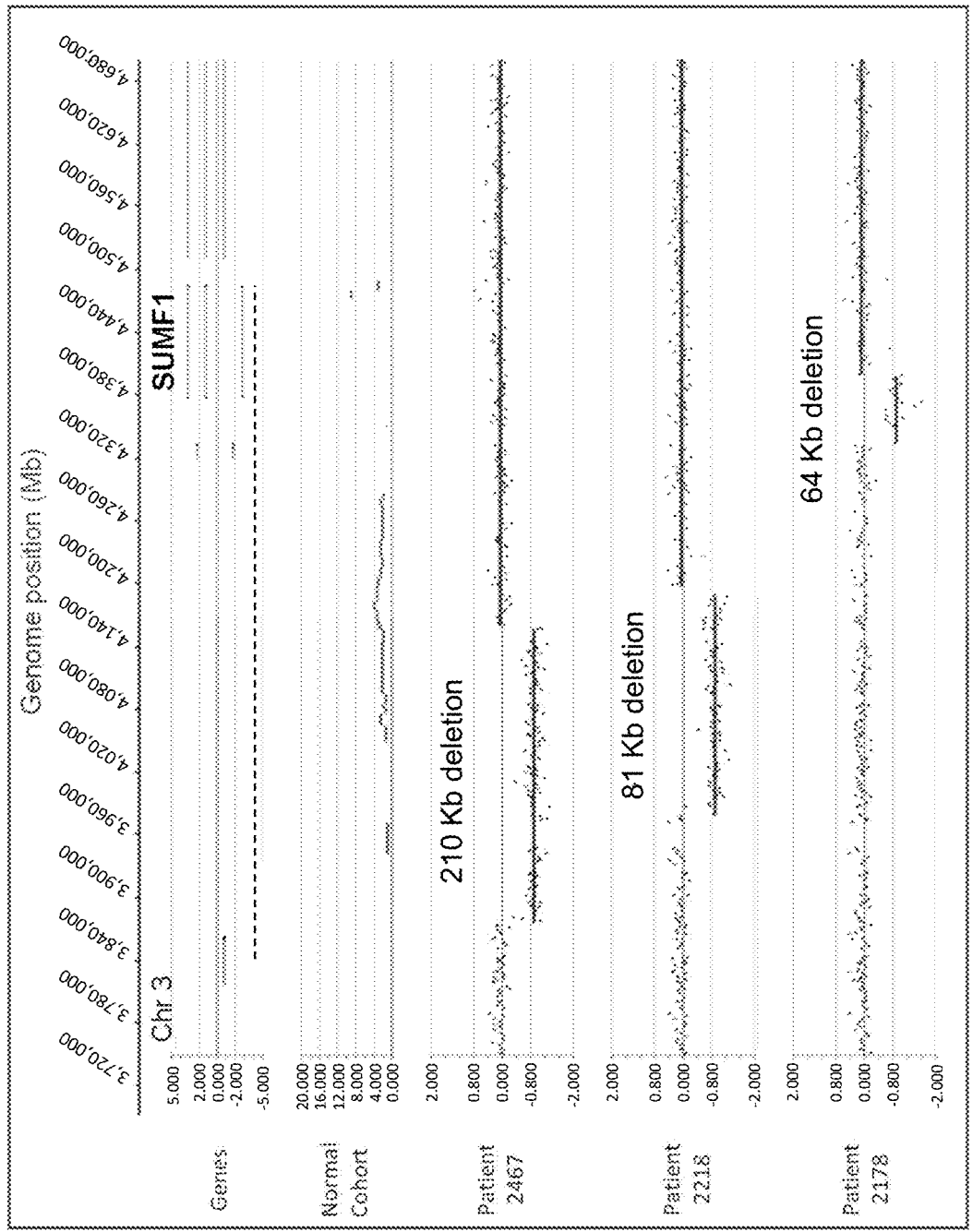
FIG. 4. Non-overlapping deletions detected in 3 PD cases and 0 normal subjects (OR=15.1, FET=0.01). The deletions impact sulfatase modifying factor 1 (SUMF1), which has transcripts of varying length annotated in RefSeq (light gray bars in the gene annotation track) and Ensembl (dashed line in the gene annotation track) databases.

FIG. 4 depicts nonoverlapping deletions in SUMF1. While the 210 Kb and 81 Kb deletions have partial overlap with CNVs found in normal subjects (see Normal Cohort annotation track, CNVs denoted by gray bars), there is a region of overlap for these two deletions with no CNVs found in normal subjects. Autosomal recessive mutations in SUMF1 are known to cause multiple sulfatase deficiency (OMIM 607939). Lysosomal defects associated with neurodegeneration are found in a mouse model with knockout of SUMF1.

Figure 5:
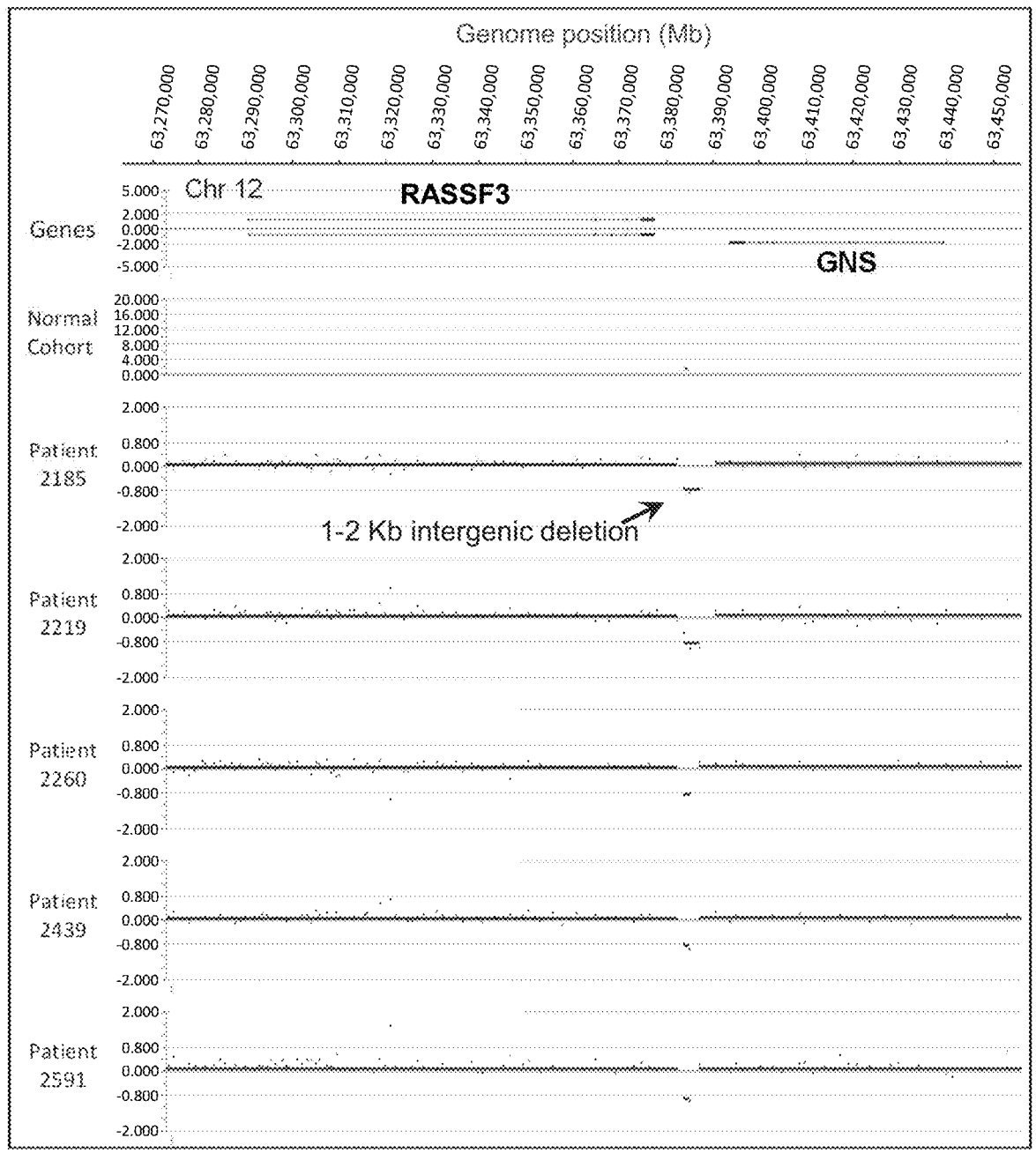
FIG. 5. A 1-2 Kb intergenic deletion detected in 5 PD cases and 1 normal subject (OR=10.8, FET=0.01). The deletion is located ~6 Kb away from the 3' end of the RASSF3 and GNS genes.

FIG. 5 illustrates an intergenic deletion. The deletion is located about 6 Kb away from the 3' end of the RASSF3 and GNS genes, which is a region that contains transcription factor (TF) binding sites, such as PD-relevant TFs REST (aka NRSF) and YY1. Autosomal recessive mutations in GNS, a lysosomal pathway gene, are known to cause mucopolysaccharidosis type IIID, also known as Sanfilippo syndrome type D (OMIM 607939).

Figure 6:
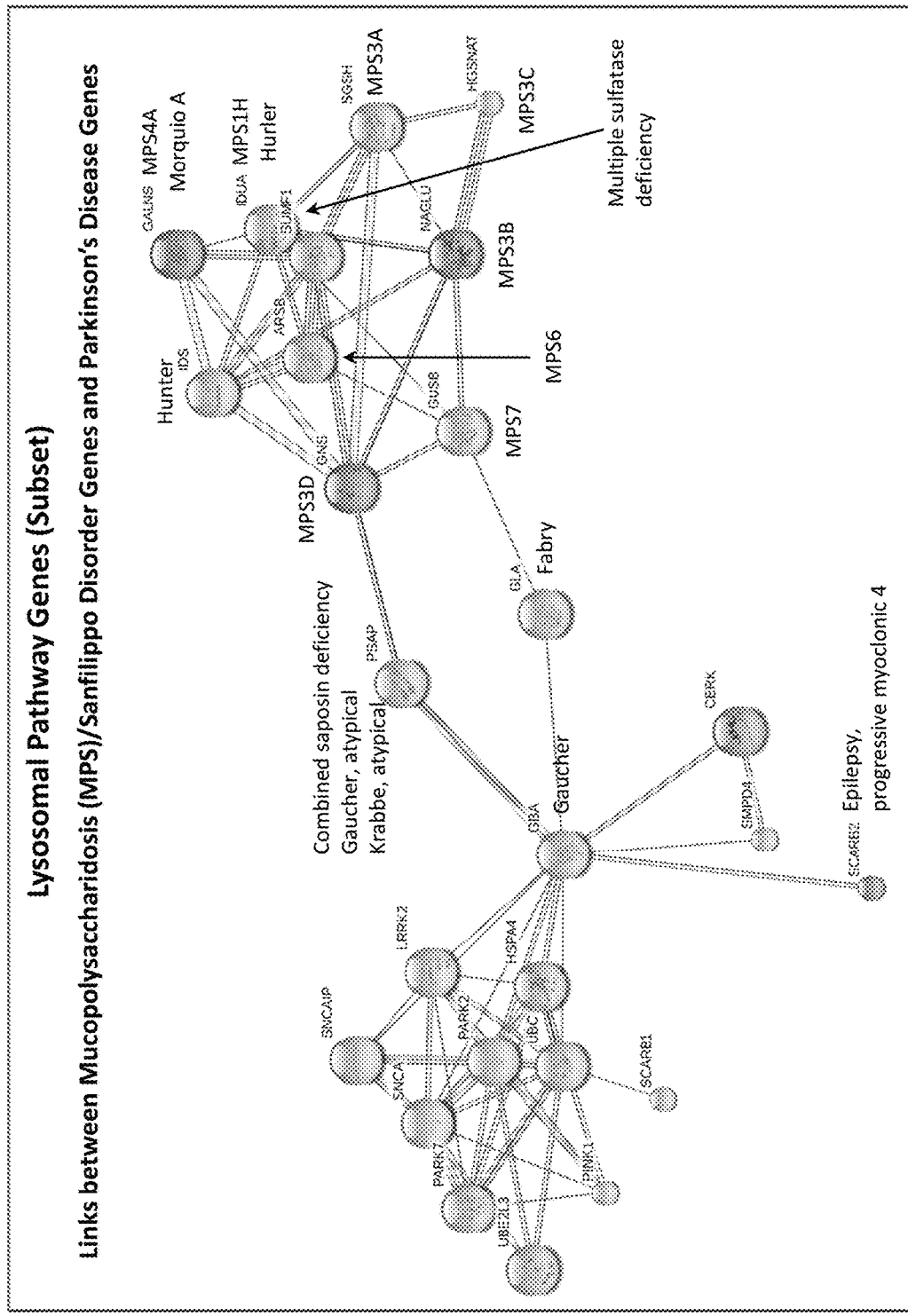
FIG. 6. Known and novel PD genes in the lysosomal pathway.

FIG. 6 is a schematic of PD genes in the lysosomal pathway. Gaucher's disease is an autosomal recessive disorder caused by mutations in GBA with well-established evidence that individuals heterozygous for GBA mutations have an increased risk for PD. Thus, a similar pathogenic mechanism may occur for other genes in the lysosomal pathway: severe, early onset disease when both gene copies are impacted by loss of function mutations, but late onset PD when one gene copy is knocked out. Similarly, several other lysosomal pathway genes cause autosomal recessive Mucopolysaccharidosis (MPS)/Sanfilippo disorders and other lysosomal storage disorders and potentially increase the risk for PD via an autosomal dominant mechanism. Loss of function CNVs (or those that may result in decreased gene expression) are reported herein for ARSB, CERK, GALNS, GNS (intergenic) PSAP, SCARB1, SCARB2, SMPD4, and SUMF1.

Figure 7:
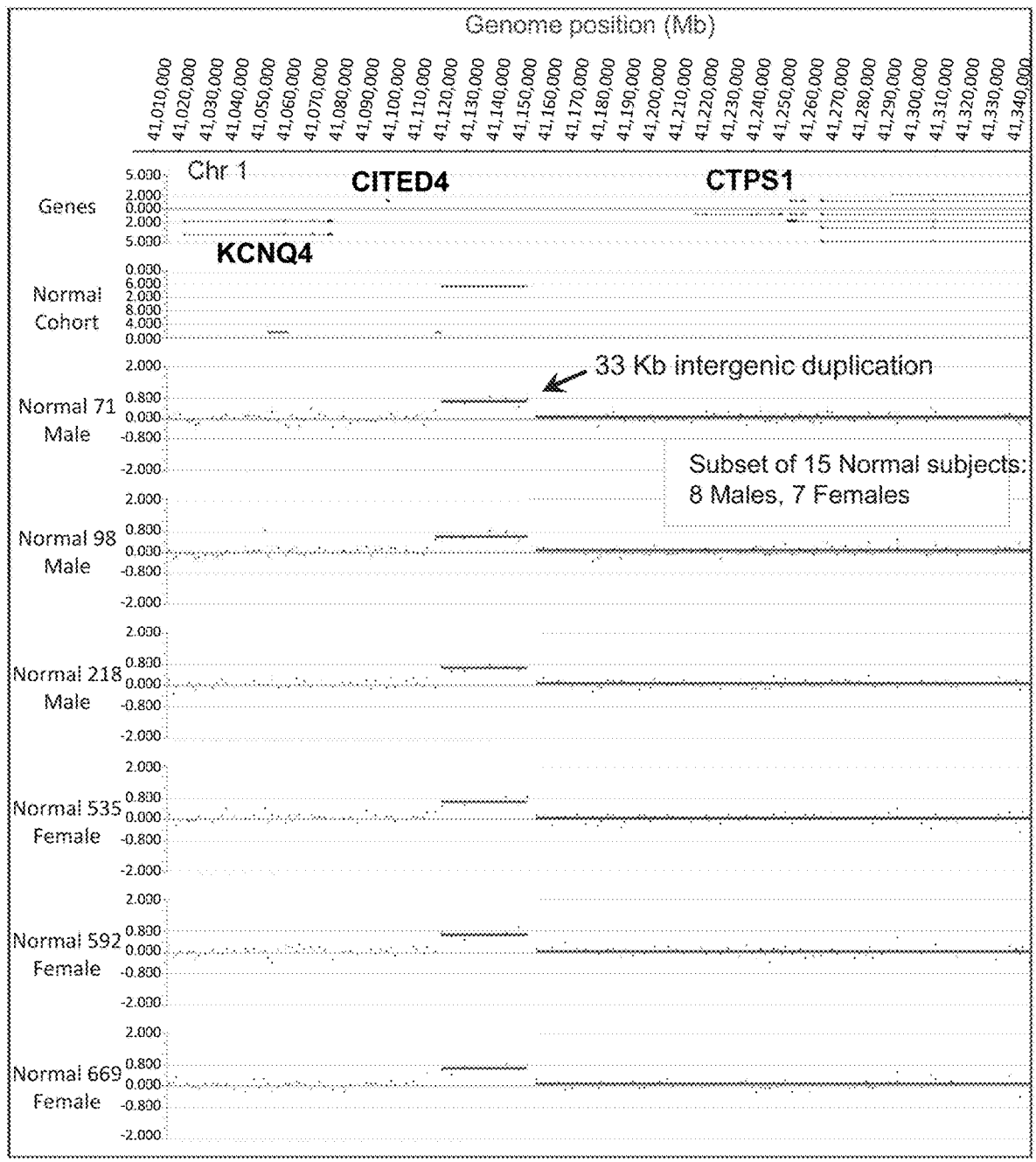
FIG. 7. Protective variant. A 33 Kb intergenic duplication was detected in 0 PD cases and 15 normal subjects (subset of 6 are shown, OR=0.07, FET=0.005).

FIG. 7 illustrates a protective variant. A 33 Kb intergenic duplication was detected in 0 PD cases and 15 normal subjects (subset of 6 are shown, OR=0.07, FET=0.005). The CNV is located in an intergenic region upstream of adjacent genes CITED4 and CTPS1 and impacts a strong transcription factor binding region (ENCODE annotation tracks, UCSC genome browser). The expression level of CITED4 and/or CTPS1 may be altered due to presence or absence of this CNV. Recently, nucleotide metabolism has been implicated in a PINK1 fly model of PD and CTP synthase 1 (CTPS1, aka CTP synthetase 1) is a key enzyme that converts UTP to CTP. CTP synthase 1 deficiency (OMIM 123860) is an autosomal recessive immunodeficiency disorder and SNCA was recently found to play a role in hematopoiesis, B cell lymphopoiesis and adaptive immune response.

Figure 12:
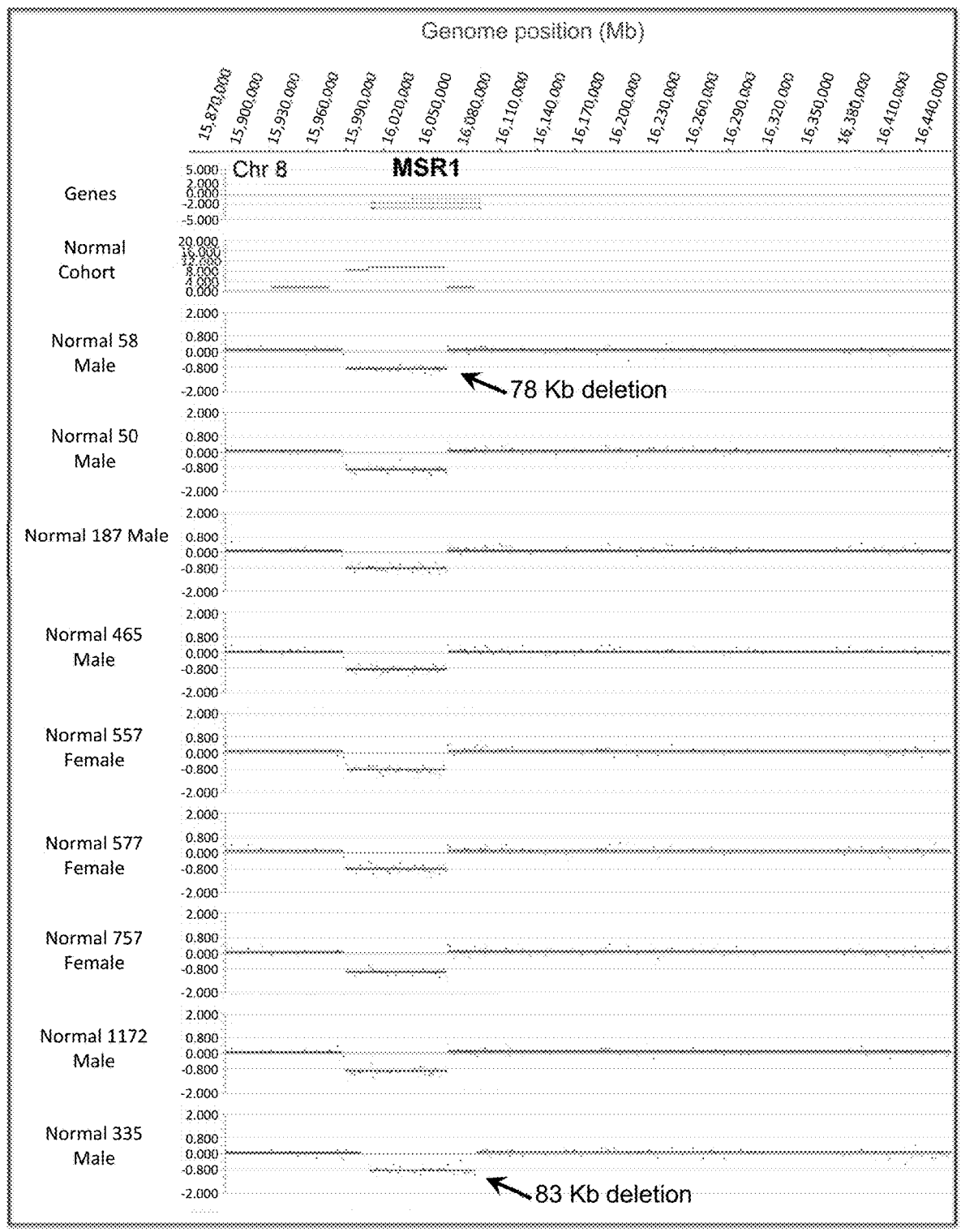
FIG. 12. Protective variant. A 78-83 Kb deletion was detected in 0 PD cases and 9 normal subjects (8 of 9 subjects have an identical deletion and the ninth subject's deletion is substantially overlapped, OR=0.11, FET=0.036).

FIG. 12 illustrates a protective variant. A 78-83 Kb deletion was detected in 0 PD cases and 9 normal subjects (8 of 9 subjects have an identical deletion and the ninth subject's deletion is substantially overlapped, OR=0.11, FET=0.036).

The CNV impacts MSR1 (macrophage scavenger receptor 1, aka SCARA1 and SR-A). The gene is linked to neuroinflammation and diabetes, both of which are increasingly implicated in pathological mechanisms of PD.

Other protective variants include:
RefSeq Gene RefSeq Gene Symbol_extra Symbol
AGMO_intergenic AGMO
AK8 AK8
ATG7 ATG7
BASP1 BASP1
CCSER1 CCSER1
CGNL1 CGNL1
CITED4_intergenic CITED4
CTNNA3 CTNNA3
CTPS1_intergenic CTPS1
DGKB_intergenic DGKB
DOCK4_intergenic DOCK4
FADD_intergenic FADD
GSTA2 GSTA2
IMMP2L_intergenic IMMP2L
IRX2 IRX2
IRX4 IRX4
ITSN2_intergenic ITSN2
KCNIP4_intergenic KCNIP4
LCN15_intergenic LCN15
LOC401177 LOC401177
LOR_intergenic LOR
MSR1 MSR1
NCOA1_intergenic NCOA1
NR1H4 NR1H4
NTRK2_intergenic NTRK2
PARK2 PARK2
PLXNA4_intergenic PLXNA4
PPFIA1_intergenic PPFIA1
PPM1L PPM1L
PREPL PREPL
PRR9_intergenic PRR9
RBM47 RBM47
SLC28A3_intergenic SLC28A3
SLC3A1 SLC3A1
SPAG16 SPAG16
ST3GAL4 ST3GAL4
SYNDIG1_intergenic SYNDIG1
TMEM141_intergenic TMEM141
TMEM2_intergenic TMEM2
TOP3B TOP3B
TRPM3_intergenic TRPM3
WDR72 WDR72

Example 5

A therapeutic approach for treating PD on the basis of a specific genetic subtype (i.e., presence of PD-associated variants within a specific gene) was assessed for PD genes. Two strategies were used to match therapies to genes:
1. Assess which PD genes are known drug targets (see, e.g., Agarwal et al., *Nat. Rev. Drug Discov.* 12(8):575-6 (2013)).
2. Studies that support a therapeutic mechanism of action related to a specific PD gene on the basis of two subcategories:
    a) prescription-based therapies requiring approval by the FDA (or related bodies in other countries, such as the European Medicines Agency) that are already approved or are in clinical trials,
    b) over-the-counter (OTC) therapies that do not require prescription.

Gene-specific therapeutic strategies are specified in FIG. 7. Column A lists the gene symbol (if the CNV is near a gene with PD-relevant biology, 'intergenic' is appended to the gene symbol). Column B indicates 'yes' if the gene is a known drug target according to the database described in Agarwal et al., supra. Column C lists specific types of therapies that require approval by government agencies. Column D lists specific types of therapies that are available over-the-counter (OTC), but also includes dietary actions.

All publications, patents, and patent applications mentioned in this specification are herein incorporated by reference to the same extent as if each individual publication, patent, or patent application was specifically and individually indicated to be incorporated by reference.

SEQUENCE LISTING (2640 sequences)

SEQ ID NO: 1 - DNA, 80263 bp, Homo sapiens
cattttcgtgctataagataagcagtccctgaatctcttctcatggtttatagccagaattcactggctaactgagccagccttcaccactctgctgtcacagcccgaatccatttcctgtacctccccaatcatttcagagaattgcagtcagccacaagataatagctgcacacagcaatggcatttatacctacaataaactataagataagacttcctttacaagtccatactaggcttgttcctgacttgattttagggagaaactattgagtagttcaacataagtaagacgttagctgacatttttgttggtgtcctttatcagatagagaggtttttttctctttctggattgctaagaagttttctttttttttttttttttaaatcatggatgcatattagatatcgccaaatgctttttctgtattctgaattttaagtcaaccttaaattactggagtaaactccactcggtattgaataattatctttcttatatattgctagatttagcttgctaagattttgttaagaattctgatggatattggtctttgactttcttttctgtttttcttttcttgcaatttagccgcatcccactaatttgggtatattatgttttcattattatacaatttgtataataattgtataataaataatttcatttttatacaatttgaaatatttttggccaggcatggtggctcacgtctgtaatcccagcacaggaaacggaggtgggcgcatcacatgaggtcaggagttcaagaccagcctggccaacatggtgaagcctcatctctactaaaaaaacaaattacaaaaattagccaggcatgatggcgggtgcctgtaatcccagctactcgagaggctgaggtgggagaatcgcttgaacctggtaggcggaggttgcagttagccaagatcgcatccctgcactcctttctgggccacagagcaagactccatctccaaaaaaaaaaaaaaaaaaaaaaaagaagaagaagaagaaatattttctactttgctttgtgattccttctctgactcatgggttgtttcaaagtatgttgttttgttttcagatatttagggattttatagatattttaacatttttactctcttttttttttttttttcgggcagtgtctcactctgttgcccaggctggagtgcagtggcataatcctagctcgctgcaacctgaaattcctgggctcaagcaatcctcctgctttagcctcccaagaatctaaaactacaggcctaccaccaggccggctactgaaaaaaaattttttgtagagatggggtctcattatgttgctcaagctggtcttaaattcccagcctcaagcaatcctcccgcctcagcctcccaaagtgctgagattacagacatgagccaatgagcctggccatttgctcttaaatttaatactcttgtggttacagaacatctctggtaagattttaatctttgaaatttattgagacttgtttgatggcacagatttggtctatctgagggaactttccatgtattcatgcacagaatgcctatttttttgttatttacttgaatggctataaatgtcaattaggtcaacatgcttgacagtatcttacaggtcttctagatcagcactgtccaaaagaaatgtaatgtcagccacatatgtaattttaaattttctagtagccacaatcagtgacgaaaaaagaaacaggtgaaattaattgtaataatacgttttatttaagcccaaatatccaaatagcattttaacatgtaatcaacataaaattacttattttattttatttttttggaaacagaatctcgttctgtcacccaggctggagtgcagtggtgcgatcttggctcactgcaacctccgcctcctgggttcaagcaattctcgtgcctcagcctcccgagtagctggaattaaaggtgcgcaccaccatgcccagctaattttttgtatttttagtagagacagggtttcaccatgttgcccaggctggtctcgaactcctgagctcaggcagtccaccctccttggcctcccaaagtgctaggattacaggtgtgagccaccatgcccagcctgtaatcaacataaaattatgaataaaatattttacattattgttttcattttaactctttgaaaatcagtgtgaacttttcatctcccagcaaacctcactttagactaatcatgtttcaagagcacaatagccgcttgtggctctagtggctatcatatcaacagcagagttctagatcctcaccaatttttttccttttattttattccatcaagtgcttaaagagggatgttaaaatcttcaactatgattgtggatttgcctatttatccctttatttttgtcagttttgcctcatttatttggtacatatgcgatcaagtaggcttcatccctggaatgcaacgtcagttcaacagacacaaatcaataaatgggattcatcatgtaacagaactaaagacaaaaaccacatgattatctcaatagatgcagaaaatgctttcaataaaattacacatccattcatgataaaacaaaactctcaataaactaggtattggggaacatacctcaaaataataagagccatcaatggcaaacccacagccaacatcatactgactgggcaaaagccagaagcattccccttgaaaactgacacaagacaaggataccctctctcactactcctattcaacatggtattggaagttctggccagggtaattaggcaagagaaagaaataaagagcatctaaataaaaagagaggaagtcaaactatccctgtttgtagatgacatgatcctattttacaaagccccgtaatctcagcccaaaagcttcttaagccgattaacaacttcaccaaagtctcaggatacaaaatcaatgtgcaaaaatcactgcttgatcgtggtgaataggctttttgatgtgctgctggatttggtttgccagaattttgctgaggatttttgcatcaatgttcttcaaggatattggcctgaagttttcttattttgttgtatctctgccaggttttgtatcaaaatgatgttagcctcatagaattagttagggaggagtccctcctcctcagttacattcacatatggcacaggagaaccaagatatgctctagtggatcttctgagccccaggcatagttatccatgcctccattagtaaaaagaactcttgtcttcttgaatcttctctaaagggttactagaataagacctcgtctttgcctgctattccaacagcacaagagcccccaaataatcagatggcagccatagtttaggttcagtgagttactgggtcccttggtagatatgttctctactatcatcctccatgcctctgcccctagaagccagatccttcagaccaacccaacttagtgttacagagactggaaacaaaaatatctctagtggctcactgggagtgatgctgagagatgtcccaactatttccaatacttcatttctagaaccatatatactctacctattgaggacctaccataaaatggccgttggttccaagttgtggaaacaaacaacgaccccttgttcgagaagcaggaaaaaggtgcctttaaaagtatgaaaggtgtggtggctcatacctgtaatcccagcactttgggaggccaaggcgggtgggtcacttgaggtcaggagttcaagaccagcctggccaacatggtgaaaccccatctctactaaaaatacaacaattacctgggcatggtggcaagtgtctgtaattccagctactcgggaggctaaggcaggagaattgctggaacccaggaggcagaggttgcagtgagccgagatcacatcactgtactccagcctgaacgacacagctagactctatctcaaaataaataaatgaataaataaatagataaatttttaaaaatataataaataaataaatcttattggaatttgttggcttgaggtccctggaagcattttgggtctctggccagaaaccaaccaattcagcaattgtggtatgtctggtgccccagtgtcaggagaacagagagagtaaaagaacaatggggtttggttccattctcttagagctgcagctgcacaaaattaaaagggaattcccctactccagtggtttggcttttgctgctgccatcacccctgccaaagggttttttatggaccagagcatgagagaatggagaaaaagtagaacaaaaatatgtgggatttttatctgtggcatttttctatttggccccttaattcagaactagaaagttttcctcaatgtttttctgtctctactcagttctcacttctgggtttgagatgcttagagttcatgcaggggaatactagagggaaaaataagggtaaattcatcgccagtttggtggtattctcatatcaaattctgatgtttttccctgataatcctgctgatatttatttgttggagtttttaaacagctgcccatgcatttgtccagattttatagttgtatttagtgtaagagaaaagtagtcatgtgtttgctccatgttatccagaactagaacccttcccttaatatcataacttcaaaatatagaaagcaaagcttaccagaactaaaagggagaatggaaacttttaaaattatagttggaaaccttaataccctcctctcaacaagtgttagacaaacatttagtaaaaataaaagatggagatgatataattagttgaccatcctatttttacttacacagggcactacatccagcaaccacagaatgcacattcatttcaagtgcacacacaagataaaaagcaaattccaggctgagaaaagatagttacgaagtatgtatcagataaggaattcatatccagaatatataaagtaatcctaaaaagcaattgggaggctgaggtgggcggatcacctgaggtcaggagttcgagaccagccagaccaacatggagaaaccccacctctactaaaaatacaaaaatagccaagcatagtcacacatgcctctaatcccagctactcgggaggctgaggcaggagaatcgcttgaacctgggaggcggaggttgcggtgagctgagatcgcgccattgcactccagcctgggcaacaaaagcaaaaactccatctcaaaaaaaaaaaaaaaaagaaaaagaaaaagaaaccactaaaaattggtaagagattttaaaggcacaaagcaaaagaagatatccaaatggccaataactaaaactaagactaataactaaataaataaaactaataactaaaactaagactgacaatagcaactgttggagaagtatgaagtaactggaactcttcatactttgttagtaagagtgtaaactggtaagaccacatgggaaaactttttggtagtttatttgttaaaaatttttattcatttatttttaattaggtttttttttttttttgagacagagttgcactcttgttgcccaggctggagtacaatggcatgatctcggctcactgcaacctccacctcccaggttcaagcgattctcctgcctcagcctcccaagtcactgggattacaggcatgtgctaccacgctcggctaatttttgtattattagtagagacggggtttcaccatgttggccaggctggtctcgaactcctgacctcgtgatccgcctgcctcagcctcccaaattgctgagattacaggcatgagccaccaccacgctggccttttaaaaatttttttgagatggaccttgtcctgtcgcccaggctggagtgcagcggcatgatctcagctcactgcaacctccacctcccaggttcaagcaattctcctgcctcagcctcccgagtagctgggattacaggcgtgcaccaccatgtatgggtaatttttgtatttgtatttttagtagagacgggatttcaccatgttggccaggctggtctcgaactcctgacctcaggtgatctccccaccttggccttcaactaaagtgctgggaatacaggcatgagccactgttcccggcctggtagtttcttatgaaattaaacagacatctaccctatgacccaacaactctattcatgagaatttactcaagagaaataaaagcatgtatctacaaaaagacttgtaacaaaaacgttcatagtggctttatttttaaaaaccaaaaaatgtctgtcaacctaagggataaacaaattgtagtgtgttcatacgatggaatactactcaatcataaaatgaaccaaccactgatccatgcaacagcatgcatctcacaggcattatgttaaacaaaaaaagccaggccaaaacagtataaactgtatgactgtatttatataacaggcaaaactaatctatggtaatacatgttggaatattggttacctttgagtggagggccacattgcctgggaagcggcatgaggcaaccttctgtagttatggaaatgttttttatttcgttacagatattgtattttttagttctggaattgccacttgattgccatctctatttctatgttgagattttactaccttttcattcattagaagtttaatttcctttatttcttgagcatactaacatacttataatatttaaagtccttgcctgccatttctaacatctgggtcatcttggggttggtccctccttgttgatttctctcttgatcatgggtcacattttcctgcttcttatatgtcatatgtaagtaatttgggattgtagcttggacattgtgaaggttatattataaatactttggattatgttaaatttatctgaaagttattgatttgtttgttgtagcaaaaattgatctgggaaggaaggaaggaaggaaggaagggagagaaagagagagtgagaaagaaagaaagaaagagccaaactgaacttctagaatttaaaaattcactgcaggaatatcaaaatacagttggaagccttaagaacagactaaaccaagctgaggaaagaattttagaggtcaaagactggtcctttgaattaatccagtcatataaaaataaagaaaaaagaattttttaaaaatgaaccagacctccaagagataagggattaaaaaagaccaaacctacacttcattggcattcccgagagacagtaagcagcttagaaaatgtatttgaggatatagcctgtgaaaatttccccagtcttgctagagaggtcaacatgcaaattcaagaaatttggagaactcctgtgagatactacacaagatgaccattcccaagacacaaaatcattagactttccaagttcaatgtgaaagaaaaatcttaaagacagctagagataagggtgagatctcttacaaagggaaccccattgggttatcagcagacttttcagcagaaatcttacaagccagaagagatctggggcctgttttcagtatccctaaagaaaataaattccaataaagaatttagatatacaatcatgtcatctgcaaacagggacaatttgacttcctcttttcctaattgaataccctttatttccttctcctgcctgatggccctggccagaacttccaacactatgttgaataggagtggtgagagagggcatccctgtcttgtgcccgttttcaaagggaatacttccagtttttgcccattcagtatgatattggctgtgggattgtcatagatagctcttattattttgagatatgtcccatgaatacctaatttattgagagtttttagtatgaagggttcttgaattttgtcagaggccttttctgcatctattgagataatcatgtggtttttgtctttggttctgtttatatgctggattacatttattgatttgcgtatgttgaaccagccttgcatcccagggatgaagcccacttgatcatggtggataagcttttcgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttaggcaggattccctctttttctattgattggaatagtttcagaaggaatggtaccagctcctctttgtacctctggtagaattcggctgtgaatctatctggtcctgcactttttttggttggtaagctattgattattgcctcaatttcagagcctgttattggtctattcagagattcaacttcttcctggtttagtcttgggaggatgtatgtgtcgaggaatttatccatttcttctagattttctagtttatttgtgtagaggtgtttatagtattctctgatggtagtttgtatttctgtgggatcagtggtgatatcccctttatcattttgtattgcgtctatttgattcttctctcttttcttcgttattagtcttgctagtggtctatcaatttcgtttatcttttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctatacactgctttgaatgtgtcccagagattctggtatgttgtgtctttgttctcgttggtttcaaagaacatctttatttctgccttcatttcattatttaccctgtagtcactcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggagtaggtgtggtgctgaaaagaatgtatattctgttgatttggggtggagagttctgtagatgtctattaggtacgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatcccttcaccaaaccccatcgtctcagcccaaaatctcctcaagctgataagcagcttcagcaaagtctcaggatacaaaatcagtgtacaaaaatcacaagcattcttatacaccaataacagacaaacagagagtcaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagtgcctgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaacaagaaatggggaaacaattccctatttaataaatggtgctgggaaaactggctagccgtatgtagaaagctgaaactggatcccttccttacatcttacacaaaaattaattcaagatggattaaagacttaaatgtttgacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaatctacggaatgggagaaaatttttgcaatctacccatctgataaagggctaatatccaggatctacaatgaactcaaacaaatttgcaagaaaaaaaaaaaaaccccatcaaaaagtgggtgaaggatatgaacagacacttctccaaagaagacatttatgcagccaaaagacacacaaaaaaatgctcatcatcactggccatcagagaaatgcaaatcaaaaccacaatgagataccatctcacaccagtaagaatggcgatcattaaaaagtcaggcaacaacaggtgctggagaggatgtggagaaataggaacacttttacactgttggtgggactgtaaactagttcaaccattgtggaagtcagtgtggcgattcctcagggatctagaactagaaatgccatttgacccagccatcccattacggggtatatacccaaaggattataaatcatgctgctataaagacacatgcacacatatgtttatagcggcactattcacaatagcaaagacttggaaccaacctaaatgtccagcaacgatagactggattaagaaaatggcacatatacaccatggaatactatgcagccataaaaaatgatgagttcatgtcctttgtagggacatggatgaagctggaaaccatcattctcagcaaactatcgcaaggacaaaaaaccaaacactgcatgttctcgctcataggtgggaattgaacaatgagaacacctggacacaggaaggggaacatcacacaccggggactgttgtggggtggggggagtggggggggagggatagcattaggagatatacctaatgctaaatgacgagttaatgggtgcagcacaccaacatggcacatgtatacatatgtaactaacctgcacattgtgcacatgtaccctaaaacttaaagtatagtaataataaaataaaaaaatgaaaataaaaataaaatttaaaaaaagaagtaaaaacctcacagcagcttatgttaatttttcaaacaaaaaatcatttattcacaagttacacaaaatattttttttactgtttacctgacatctaaagtaaaagcagaataaaataaacttctcaccaatagttaaaaaaaaaaagaatattctgccgaactaaacttcatatatgaaggagaaatgaaatctttttcagataagcaaatgctaaagaaatttgttacttctagaccagccttacacgaggtccttaagggagttctaaacatggaaacaaaggaatgatacctgccagcacaaaaacacagttaagcccagaaacatacgtagcctagagatcctctaaagcaactacataattgaggctacaaagcaatcagctaagagcatcatgacaagatcaaacctcacatatcaatattaaccttttgttaattgtctaaaatgccccacttaaaaggcacagagtggcaagttggataagtaaacaaaacccaacagtctactgtcttcaagagactcatctcacatgtaacaacacccataggctcaaaataaaggaatggaaaaaggtctatcacacaaatggaaaactaaaaagagcaggagtctttatatattctgttatatcagatagaacagactttaaaccaacaacagtaagaaaggacaaagaaggaaattacataatgataaaggattcaattccacaagaagacctaactattctaaatatatttgcactcaacattggagcacctagattcattaaaaagtacttctagacctacaaaaagacttagagagccagacaataatagtagggtacttcaacacccccgctgatagcattaaacaaatcaccaaggcagaaaactagcaaagaaattctggacttaaaactacacttgaccaattggacctaacatcaatctagagaatactctgtccaaaatcacagaatacacatttttcttgtttgcacgcagaacatactcttaagaccaaccacatcagccataaagcaagcctcataaaattaaaaaagaatcaaaatctgtccaggtgcggtggcttacacctgtaatcccagcactttgggaggctgaggtgggtggatcacatgaggccaggagtttgagaacagtctggccaacatggcaaaaccccatctctactaaaaatacaaatattagccaggtgtggtggcacatgcctggagcccccgctacttgggaggctgaggcacaagaatcacttgaacccaggaggtggaggttgcagtgagccaagattgcaccactgcactccatccggggttatagagtcttcaaaaaaaaaaaagaatcaaaatcatatgaagcatactctcagaccacagtggaataaaaatgaaatcaataccaagaagatctcaaaagcacaccattacatggaaattaaataactgctcctgaatgacttttgggcagataatgaaattaaggcagaaataaaacaaattctttgaaattaatgaaaacagagatacaacataccaaaatctctaggatgcagcaaaagcagtttaagaggaaaaattgtagtgctaagtgcctacattaagaagttagaaagatctcaaattaataatctaacatcacacctagaggaactagagatacaagaacaaacaaaccccaaagctagcagaagaaatcactaaagccagagcagaatggaatgaaattgagaccaaaaatccataaaaaagatcaacaaaagcttgaaagcttgaaaccttgaaaggaaacgttggttccttgaaaggataaacatgactgatgaacttcaaaagtaaccttggttccttcaaaggataaacatgattgatgaaccactagctagattaacaaagagaaaaaaaagatccaaataagcacaattagaaatgacaaaggtgacattacaactgatcccacagaaatacaaaagatactcagagaccattatgaacaaatctatgcacatcaattagaacatctagaggaaatagataaattcctggaaacacacaacctcccaagattgaattggaaataaaatgaaaccctgaacagaccgataatgagttctgaaattgaattagtaataaaagaaaaaaaaacataacaaccaaaaaattccctggcccagatggattcacaatcaaattctaccagacatacaaatcctcaacaaactaggcattgaaggaacatacctcaaaatactaagagccatcactgatgaactcacagccaacatcatactgaataggcaaaagtgggaagcattccccttgagaactggatcaagacaagtgtgcccactctcaccactcctactcaacatagtaccagaagtcctagccagagcaatcaggcaagataaataaataaaaggcactcaaataggaaaagaagaggccaaactatctctcttcatggatgatataattctgtatctaggaaaccctaaactggaagacagctagaactcataaacaacttcattaaagtttcaagatacaaaatcaatgtacaaaagtcagtagcatttctatacaccaataacgttcaaactgagagccaaatcaggaatacaatcccaactataatagccacaaaaatattttaaaatctaggaatacacttagtaaaggaggtgaaagatctctacaaggagaaacacaaaacactgctgaaagaaatcatagatgatacaaacaaatggaaaaacatccatgcttttggattggaagaatcaatattgttaaagcagtctacagatttaacactattcctatcaaactaccaacatcatttttcacataattagggaaaaaaaaactattgtaacccaaatggaggctgaatagccaaagtaatcctaagccaaaagaacaaagccagaggcatcactttacctgatttcaaactatattacaaggctacagtaatcaaaacaacatggtactggtattaaaacagatacatagaccaatagaacagaacagagaacctagaaataaagccacacatctgcaatcatctgatctttgacaggtgacaaaaataagcaatggggaaaggactccctattcaataattggtgctgggataaatggctagcctatgcagaagaatgaaactggacccctacatttcaccatatacaaaaatgaactcaagatgaactaagaacttaaatgtaagacctcaaactatagaactcctataagaaaacctgggaaatacccttcttgatgatggctttgggaaagaatttatggttaagtcctcaaaagcaattacaacaaaaacaaaactcggcaaatgggacctaattaaactaaagagcttctgcacagcgaaagaaactattaacagagtaaacagacaacagaatgggagaaagtattcacaaactgtgcatctggcaaaggtctaatatccaggatctataaggaagttaagcaaaccaacaaataaaacacaaataaccccattaaaaagtgggcaaaggacatgaacagacacttctcaaaagaagatttacaagcaactaacaaacatatgaaaaaatgctcatcatcactaatcatcagagaaatgcaaatcaaaaccacagtaagataccatctcacactatggctatttaaaacttttaaaaataaatgctggcaaggctgtggagaaaagggaatgcttatacactgttggtgggaatgtaaattagctcagtcactagggaaagcagtttggagatttcacaaagaaccaaaaatagaactaccattcaacccagcagtcccattactggatatacacccaaaggaaaataaatcattctgccaaaaagacacatgcacccatatgttcatcacagcacttttcacaatagcaaaaacatggaatcaatctaggtgcccattaatggtggactggataagtaaaatgtggtgcatcatcaaaaagcttatccaccacgatcaagtcggcttcatacctgggatgcaaggctggttcaacatacgcaaatcaataaacataatccatcatataaacagaaccaacaacaaaagccacatgattatctcaatagatgcaggaaagaccttcgacaaaattcaacagcctttcatgctaaaaactctcaataaactaggtattgatggaacgtatctcaatataataagagctatttttgacaaacccacagacaatatcatactgaatggccaaaaactggaagcattccctttgaaaaccggcacaagacaaggatgccctgtctcactactcctattcaacgtcgtattggaagttctggccagggcaatcaggcaagagaaagaaataaaggtattcatataggaagagaggaagtcaaattgtctctgtttgcagatgacatgattgtatatttagaaaaccccatcatctcagcccaaaatctccttaagctgataagcaatttcagcagtctcgggatacaaaatcaatgtgcaaaaatcacaagcattcctatacacccataacagacaaacagagagccaaatcatgagtgaactcccattcacagttgctactaagagaatcaaatacctaggaatccaacttacaagggatgtgaaggacctcttcaaggagaactacaaacgactgctcaaggaaataagagaggacataaacaaatggaaaaacattccatactcatggataggaagaatcaatattgtgaaaatggccttagtgcccaaaatattttatagattcaatgctatccccatcaagctaccaatgactttcttcacagaattagaaaaaaacttctttacatttcatatggaaccaaaaaagagcccgcatagccaagacaatcctgggcaagaagaacaaagctggaggcatcatgttacctgacttcaaactttactacaagtctacagtaaccaaaacagcatggtactggtaccaaaacagagatatagaccaatggaacagaacggaggcctcagaaataacaccacacatctaccacaatctgatctctgacaaacctgacaaaaacaagaaatagggaaaggattccctgtttaataaatggtgttgggaaaactggctagctatatgcagaaaactgaaactggaccccttccttacaccttatacaaaaatcaactcaagatggatcaaagacttaaatgtaagacctaggaccataaaaaatcctagaagaaaacctaggcaataccattcaggacataggcatgggcaaagccttcatgactaaaacaccaaaagcaatggcaacaaaagccaaaattgacaaataggatctaattaaactaaagagcttctgaacagcaaaagaaactatcatcagagtggacaggcaacctacagaatgggagaaaacttttgcaatctatccatctgacaaagggctaatatccagaatctacaaagagcttaaacaaatttacaagaaaaaagcaaacaaccccatcaaaaaatgtgcaaaggaaatgaacagacacttctcaaaagaagacatttatgcagtcaacagacatatgaaaaaatgctcatcatcactggtcattagagaaatgcaaatcaaaaccacagtgagataccatctcatgccaattagaatggcagtcattaaaaagtcaggaaacaacagatgctggagaggttgtggaaaaataggaatgcttttacactgttggtgggagtataaattagttcaaccattgtggaagacagtgtggcgattcctcagggatctagaactagaaataccatttgacccagcaatcctattactaggcatatatacccaaaggattataaatcattctacgataaagacacatgcacacgtatgtttattgcggcactattcacaatagcaaagacttggaaccaacccaaatgtccatcaatgatagactagattaagaaaatgtggcatatagctgggcacggtggctcacacctgtaatcccagcatattgggaggctgaggtgggcagatcacgaggtcaggagatcaagaccatcctggctaacatggtgaaaccctgtctctactcaaaatacaaaaaattagccgggcgtggtggtgggtgcctgtagtcccagctatgttgggaggctgaggcaggagaatggcatgaacccgggaggcggagcttgcggtgagctgagatcgagccactgtactccagcctgggtgacagaatgagactccgtctcaaaaaaaaaaaaagaaagaaaatgtggcatatatacaccatggaatactatgcagccataaaaaagaatgagttcatgtcctttgtgggaacacgcatgaagctgaaaaccatcattctcagcaaactatcacaagatcagaaaaccaaacaccacatgttttcacttattaagtgggagttgaacaatgagaacacatggacacagggaggggaacatcacacaccggggcctgtagggggtggggggctaggggagggataacattaggaggaatacctaatgtaggtgatgggttgatgggtgcagcaaaccaccgtggcacgtgtatacctatgtaacaaaactgcacattctgcacatgtaacccataacttaaagtataatataaagaaaagaaagaaaatatggtgcatatacaccatggaatactatgcagctataaaaaaagaacaaaatcatgtcctttgctgcaacatggatgcagctggaggccataattctaagagaactgatgcagaaagagaaaaccaaatactgcatgttctcacttataagtaagagctaaatattgggtacacatggacataaagatgggaacaagagacagattataagtggggtgaagtagggaggagcgcaagggttgaaaaactacctattgggtactatgctcactacctagatgatgggttcaattgtactccaaacctcagcatcatgcaatgtacccttgtacaagtctgcacaagtacccactgaatctaaaataaaagttgaaaaaaaaaaaaacattaggttaattaagaagagaatggagaaaggcagagggcaggtcttagcatggtagaaaattttaaacagcaattaagaaataaggtgcttggccaggtgcagtggctcacgcctgtaatcccagcactttgggaggccgaggtgagcagatcacctgaggtcaggcgttcgagaccagcctggccaacatggtgaaaccccatctctactaaaaatacaaaaaaaaaaaaaaaagaaagaaaaagaaaacatctgggcgtggtggtggcacatgcctatagtcctggctacctgggaggctgaggcaggagaatcacttgaacctgggagatggaggttgaagtgaaccgagatcacgccattggactccagcctgggcaacaagagtgaaattctgtctcaaaaaaaaaaaaaaaaacaaaaaagaagaagaagaagaaagaaagaaggtatgtaaagcaaatattgacagaagcaaaaaaagaagaaaaagaaagaggagtcatgggacttgtcccagcagggtggaaagctttagatggttattaagaagtgggatgaataaaatggatattgatggattaaaacaaaggatttaacacagcactaccaaaggttgagcaggcccaagggaacccctgctggtccctcaacattaaagggttccaaataagcctgctctatttactccagtttggagaaatttaaaaagccaaaggcaaagtttatcatgagaaacctgaccagcaatcactgtgacagttgttagcaggttcatcaagatgaagattgacaaaagggtcacagtcccttggctctaccccttctcagtggagacccaaagccttatgcacatcagtaggtaaaatggtcagcggtgggggcagtgtggagaaaagattactgggactcaatacaggagcccccagcactgtggtaccaaaacccattgatgaagccctgaggcaggctgcagttagaatgagggaaccgtaaaaggtaagggtttataggatcatgaaaggtggaatgtttaaacagactttaggtaaagctgtgtgtcctttacctgaatgttttatgggaatggatattacatccggctggggaacacttttttgagatggagtctcgccttgttgcccaggctggagtgcagttgcacgatctcggctcattgcaacgtctgcttcccgggttcaaatgattctcctgcctcagcctccccagtagctgggattacaggtgtgcaccaccacgcccagctaatttttgtatttttagtagagacggggtttcaccatattggccaggctaatctcaaactattgacctcaggtgatccacccaccgcaacctcccaaagtgctgggattacaggcgtgagccacgaagtccggcctaacacttcttaatacctagtattgtaacaccaaaacctgttaattaagtcctaatggaggccgcagttagggatgtagtggttgatggaattaaagtctgtaggcgaattggtgtttttcagcaggcttcgtgagaagtgcttgcgtgcgtctcttacctgattgtattatgggaatggacattgtgtctgcgtggggaatgtttcccctacctagcattgtaaaacagaagcgcgcagcacttcaatcatcagtgtggagagcgttcttagaggtcaccggtgtggaagctgaggcttcctcaccttgcttcccctgcaccacactgcagaggccaacacctatttcttattaggtcacagttctctcagcaggtgaggcattaatggccaagaaaaagaaaggatgagaatacaatcatgaataagtctagcaagggaaatatttttaggtgtttttattattttttattttttattttttatttttttgctctggaaactgttagtccaaactgcaccattttgtaaccccccagccatttcgcagacctcggtcaaagtgaaacattccacaggggttcgggctgtgacaaacagcctgcccaaccgcttgactctcttattatattctgctggaagaaagtgtaaggaacctcacactgcactggaacaggcaccaaactgcctaatcatgggaacatgttatcaacattttcccaggcagcaggccatgccccctgttccagacccctcccacctagcctataattgccccagcctgtaagtggcgatggccattggcattaagctgcaggtcttatgctggacataaagccggcatttgctgtaaagccaccactctctctctttgtgtctttctttaaccctagccttcccttcaaaacccaacaaaaactatttataagacaatttttcttcatcctccagtaagaacctaattttttgtttgtttgttttggtttggttttggagttttttgtttgtttgagacaaggttttactttgttgtccaggctgaagtgaagtggtgcaatcatgactcactgcagcctcgatctccccgggctcaggtgattctcccccttcaacctcctaagtagctgggattgcaggcgtgtgctaccatgcttgggtaatttttgtattttttgtagagatagggttttgccatgttgcccagactgatcttgaactcctgggctcaagcaatcctcctgtgttggcctcccaaagtgctgtgattacaggcgtgagccaccatgcctggcctaagaacctagtttttggacaactatgaaagtgctgttttacataataggatgtagacatgtaataattcataacacctgaagggggcacaggcaaaaaatataaagaaaattgagaatgactggatatcatatctaatggtgccacatttgtgtctaacatctttgacattgttctcagcaaatccctgggaatcagctgttgagctagatggagatgggaagaggataaagactgagatagatggctgggcacagtggctcacgcctgtaatcccagcactttgggaggccaaggaggatggatcacctgaggtcaggagatcgagaacagcctgaccaacatggagaaaccctgtctctactaaaaatacaaaaaaaaaaaaattagccgggcgtggtggtgcatgcctgtaatcccagctacttgggatgctgaggcaggagaatcgcttgaacccgggaggcagaggttgtggtgagccaagtttgcgccattgcactccagcctaggcaacaagagcgaaattccatcaaaaaaaaaaaaagacttggatagttgtattatatctattaattctaacaggttgtggagaagcttggcatgaaaatcatgaggcataatgaagtttgtgtgttatttccagattgttcttaccatgttgttaagtcatagatgaaaacaagcaatgtttgaaggatagtcccaacctccaggtgtacctaatcctgatgaagccgatgctgttagcaccctcccatatccctgggccttttagaattttcagttgatttccaactgtcagtatttgtacctctgtacctgcagccccttttccttggaaatatgtgttgcttatttgcaaggcaaaccggagtagcaaagaattaacaccccccaaagccctacaggcagatccctcaaccaacggctctcaggagttgatgtataaatgccccagctccttgtaccttgggcagaataattctgtggtgtgggttttgcaccattcctagaagttttcttgcaaggttgagctcaggtgcccactgtggtagctggctcggtgacacgttttattggctgtcctactgtccctgtatcatccagccacctcatacgagcgttccaaaataaactacccacactggaaaccttgcctcaagttctgcttctggggaaccaaactaagacaacttgaatgtgaggtctcccatgggacatctcttgcatcctagtcataaagagaacactgggggaatacattcagggaacacgtgagcgtactatttcttgtttttcaaattacctgaaagtgatctcatctagatgtactttattgttgaagtagtgacattgaaggggctagtgattagatgaaattcatgcatgtgagggaaagcccaaaataaatcattcctgagcaaagtgaacatctgaagagcatcctggatggcccacatgcagggaggataataaaaatatttaacacctggtacagcatgggcctcaaccagtcatagaagctgctggcctacctgctaagggcctgccacacaaactgaccattggccctgcccagtgaaacaaggattcctggtgctgcctgggtcaaatattcaggctgggttgagaggtcagtgggcaaagaaggatttacttggctttctccaagagggctcagaggcaggtgtgtatgattttgattccttctcagaaacagaagtgatggactgaaacattcattgaacatctccaaagggagttaaaggcccagcagggccacagtgtcacacgtccactttacactccaacgtgttatcacttgtgtcctctcctgactatggaagtaaaggccacaaacagcacacagtttccttccagagagttgtctcttctccattgtaggtagtgtgagcaagaccaaggtagcaaaatagccaaagggtaggtttgtatgtgacccaagataaatagctccgaacctctcctggcactatgaaagtgacgcagaatgaagacataatcagaaacaggtgtttggagtacatatatgaggatactggtgagggtgctaattcatttgcttactatggatgctgtaaagtatggttaacccattcctgctacccagaccccagagttgcctggtgtctcttcatctccttgaccttcttagtttgttctgttagccttccagtaatttctttttaatgcttaaaatttctataagtggttacttttgcttgcaaccaaagaaccataattgatttgggtcctacatgcttatcttcagccatgttttgtgagggatggaccccgtgaaagaaagcgtgtggcagcaactgctgaaaataagaaaagccagtccctggatcttcacagacaaaagaaaacacaggaggttgctgtgggtttgaaggacttggtgtatctaacttgaatgacagcttcacctcagttggctctcagtttcccatgaagctagaattccatccctatttcttccattgtcccatggattggctggcttacgagtcaggaacttctcataagcaaagcctgagggctctgggcagatactggaaaaaagacaaaggctcgggtaaggcttacttaacttgttagcaattctggtagacagggagtaggtgggcattggaatcacaggctaaaatgaagcctggctggaatacctagggaccatttgccatgatattcacatttactgcaaagtaattatatatatgtctatgtccgtttcctaggaaccatattgtgaactggatggatttcttttatttttctttccttttttcaatgcttattttcattcagaaaattgggaaatgaattttctttcatgattttaatcatttctttgccagtgttgtatacaacacattcacgtaaaactctcaaaggcggccatctgagcactctgccaacctggcccacccacagagctttgcctagaagctttgtcttttatagaacttagctcgagcaatgatatcattgacgaagtcattgtctatgtccgatggggtggcaatcgcttcaattcctgacttaaaagctgagagaccacctgaaatgaaacacagagaattaggctcaaatattaactttcaacagaaataagcaatgagcattgccaagatgttagctttccaggcaaatcttccaaagcaggcagtcccaaatcctcctccctctccctccctttctgaaaggacgtgctatcccaagaatcactgggaaaattccagattgctttctttctctttttccaaagtctttggtttttcttgttgcaaaaatcagatttgcttttttatgtaatccaggcctggcagaactagactcccagtacatcctctgctgaaaatgcttgtaacattctctcatttattcaataattcactcatctattcactcactcatttattcattcaggaaatgttttcaagcacctactatgtgccaggagaggtgccacactgactgcaaggtacccaagacacacttatttctttgggtatgtgtacatatgcatgtgtgtgctattttaccctagaattttatctctagtagttatgtatgtgtttaacataattgtgctctgctctgatatccagagaggaagatgcctggtcctgatccctgccttcaaggaccttgaagtagagactagaaactgttctgattaaggccgttagagtgtggaggacataacattggccaataggaggcaaacctaataggaattgatgtggttgggtgtgaagagagaaggaaccagagagcctaagaaagcaatctggttttcaggctgggatgactggctatattatggtgcctccaagacatgtaaaatgcagaagaaagagcaaatttatagtgggaagttagtgagttaattccatctgggagatgctgaacttgagggggcctgtggtcagccaagcagagatttccacttggatatatagcacctgaagtcccgaaaatactcacagagtaacattgttcagacaatttggaaagttgttgacagtttcttataacaggaaaaaacctatgagaggtaggcaaacagatagatagatagatagatagatagatagatagatagatagatagataaatttttttttgagagatggggtctcactctgtctcccaggctggagtgcagtgatgtaatcaatgctcactgcagccttaacctcccaggcacaagcaatcctcctggcttagcctcctgagtagctgggactgtgtgtcaccatgcccagctttttttttttttttttttttttttgtagagacagggtctcactatgtttcaaggtatcactcaatagctcagtaagcaatgaataagaaccccaacattctgcagaagaggaaatggaggttgaggatggaggacctctcaaagtaactcagtggttcagggaatgcaaatgcagcctctagacagctcctcccagggccactgctgaccccgtggaaatgctcccagggagtctcgggtcacactggccttcagtggtctcattcattgctcatttaaacaaagtactcagaatacagcctacctttgaggtgctgagcaacactccacgtggggaattttttctggattgccttaattctctctgttagaatcccagtagcctgtgaaaggtgctctttgctatcccaggcaccgacagggtggtacgtttgtttatcaagctagaaaattcagataataaagtcagcatctggatgaggtaacacattttttctgccattcctaatttcctctcctggtattcaagtcatagataccggcctttatccccaaagagtcaattctattgttctttctttcatatagatgagagtcagagaaacaaagtaaggtttgggagaaatggacatggtatagttttagctaaacattctaatatacaaaaaaaaaatttaagttgttttgaaacaaataacacccaaagtctacacatttatagtaataaataattatccagctaattcagataaaaatttgtttctaactgggaaggccagaagtctgtatttctacagacaatttaaaatcgagcctggaagcaaatatccagataatttggatccccttcctccagtttacccaaaggaacaagttgtttcaagtagggcacagttataccatgttttgatccacatggatgaaatttactacttcatgaaccccaagaggacacctgtaacaataatgctatttataagattttctcagttttagtgtattacatattatttattgcagaatggtagttatgaaactcctaaaatactttttaaaatatatctaataatgaataagccttgaataaaataaaaagatgtgttacagaaatcccagatcaaattatgctggagtggccgggcacagtggctcaagcttgtaatcccagcactttgggagactgaggtgggtggatcacctgaggtcaggagttcaagaccagcctggccaacaaggtgaaatcccgtctctactaaaaatacaaaaaattagctgggcatggtggcgtgtgcctgtaatcccagctactcaggaggctgagggaggagaatcacttgaacccgggagtggaggttgcagtgagccgagatcacgccattgcactccagcctgggtaacaagaatgaaactccatctcaaaaaaaaaaaaaaaattatgctggagtacctgtagccagatgccagggtattttggggcttggaagcactgcaaatggatttctagttcaggttgagcttctgtgaggagggatgcagtggggctgatagaaagtttctagctaaatacctgcatcaagccaaatttaagtcccctgtggtcccagccgtcttgcaggacagatccgccatggctttccctggagatgatggctgcgatgacagcagggtccacgcaatgtctctgcccgacttctttgatcagagtctggtaaggttttatggccctcaaatccatctcagcaaacatttcagaaccacggatccctacgtcaatagaaaagaaactgtttttccgggcatggtagtgtgtgcctgaagtcagttcctgctacacaggaggctgaaacaggaggattgcttgaacccaggaggagttcgaaaccagcctgggcatcatagtgagagcccatctctaattaaaaaaaaaaaaaaaaagaatttaaagttaaaaaaagaaaagaaactgtttcttctacttcagaagaaaaccatttttaaaaatttgctaagttagccacagcctctgatcactgctaatgacttgggacaaccattctaagacatccttttgatctctgactgcagaaacaaacagatccacaacccccaacaggtgtcgcttctgctctgtttctccttcaaattgctcatgcctgtaatcccagcactttgggaggccgaggtggacagatcacttgaggtcaggagctcaagactagcctggccaacatggtgaaaccccatctctactaaaaatacaaaaattagctggacttggtggcaggcacctgtaaccccagctactcaggagactgaggcaggagaatcgcttgaacctgggaggtggagattgtagtgagccgagatcatgccatcgcactccagcctgggtgacaaagcaagactctgtcatacacacaaaaaaaattctgccacactagtgcactgggaagcctgttgtactaggagttagccaatgcatgttttagcctggctccgccactagttggttctgttctattgggaagtattcccctccttgctgagtctttgggctctgatttgtaaatttgaggggttggggtctgatgtgaccttgtggttgctgccagctccgacactctaaaaccaggataacgtgatgaagacgactttggaacagtattgcttcaaatggtcatgtgtaacatgaagcaaacacagcagcaccacccaaaaaacaaagccagagtctaatatttattcaagcagtagtttcaatacatggaaataaacacagctggacaaagtttggaaagaatgggggtggaaaatgaaaagaagctggttgttagattggtcaggattgtggtttttgctcatttttaattttgatactattgtcataatgatgattataccttttcaaaattaagtgacttcctaagaaagaatctgaaaacgatgaaagggggaagccagtcatttgctctgcttttcacttaccgcagttcatcacactgtttgcatcacaagtggccccagaggtcttcatggtcatgatgtccccatagcagccgtggtacaggcgtggatgtaggtgaggcttcattgagtgactgaaggggtatgagcccctggaagtgcctaggaggcagaagtgtaactcacatgaatcctctgagaagatattacttgggttgctgcaataaacatcactaaaccaaaggcagaaggccacagacagaactccccaactctcttgttgccattatttgttcctcagacagaagttccccatgcccactctgctccgatcttttgttttgttttgtattaacacaggacgtaatctgaaaactctatgcaaaatattatgaaattcatctcttatagatcctaaatacatgtgcagtctttttttttcctttttttaagagacaaggtcttgctctgttgtccaggctggagtgcagtggcatgatcatagctcgctgcaggcaccaacacctgggctcaaactatcctcccaccccagcctcctgagtagctggaaccacaggtgcatatcaccaggactggcttattttctctttttgtagagatggggttttgctatgttgcccaagctagtctcaaactcctgtgctcaagcgatcctctctccttggcctcccaaagtgctgggattacaggcactgtagtcataccatgctctatgtcagaattaaaactgacaggtttttaagcaggaaacttgagagttttttttttttttttaagattcagggggtacatgtgcaggtttgttacgtgggcatattgtgtgatgctgaggattggccttctattgatccttcacccaaatagtgaacacagtacctgatgtgtagttttcaacccttgcctccctaccttcctccctccctccttccttttacagtccccagtgtctattgttttgagaggaattttaaaacatttctgacacaaatgcctctggagatgtgaacatctagattaacaatttgcctttcttaagccaaaattgacaaatggggtctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagaaaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacgtatgtttattgcggcactattcacaatagcaaaaacttggaaccaacccaaatgtccaacaatgatagactggattaagaaaatgtggcacatatacaccatggaatactatgcagccataaaaaatgatgacttcatgtcctttgtagggacatggatgaaattggaaatcatcattctcagtaaactatcaccaaggacaaaaaaccaaacaccacatgttctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaaataaataaataaaattcaaaaaaaaccaatttgcctttgtttagaaagataagaaagaagggcaccataacaatttaaatatattcttattatatatcatttactgtgaagttgagttcctatgtatatttaataaaattagaagtaaaaattgaatttgccaaaataatttaagtcaaatctattcttgtctttttgttctgtcattaaaaagtgaatttctgtccaagtctacctgttacaggagaggcagagcttttgctaaaggagatacaaagttattttctgtaatgttgaaaagtttgttctaacggtttcaaggactgttaacttgtaccttaagagtccaaatatttgttataagacagtacttagggctggatgttgtggcttatgcctagaatcccagcactttgagaggctgaggcaggacgattgcttgagcgtaggagtttgagaccagcctatgcaacatggcaaaactcatttctacaaaaaatacaaaaattagcctggtgtagtggcacatgcctgtagtcccagttgcatgggagactgagacaggaagattgattgaacccgggaggtcgaggctgcagtgagctttgatggtgccactgcactccagcctgggcaacagaacaagaccctgtctcaaatctcaaaaaaaaaaaaaaggattttgttaaaatgtttgatgtaaaaaaaatagaatctggttgggcgtggtggctcacacctgtaatcccagcactttgggaggccaaggcaggcggatcacctgaggtcgggagttcaagaccagtctgaccaacacggagaaacccatctctactaaaaatacaaaattagccaggcatggtggtgcatgcctgtaatcccagctactcgggaggctgaggcagaagaatcgcttgaacccaggaggaggaggatgcagtgagccgagatcgcgccattgcactccagcctgggcaaaaagagcgaaactctgtctcaaaaaaaaaaaaaaaaaaaaaaaagaatctaaccacttctcccacctctgcttctgccatagtcccagccagcatcattgctcatctggactctcctaacagccttctaactgacctccctgattcactcttgcagcccatcctctacttagtagacggagtggccctgtgggaatatgcatgggctgctatcagtcttctctcttaaccttccagtggctttctcctcctttaggggaatagccaagtccatcctgcagcctccaagacctactagatgtggccctctgctcctgttcctacttctctttccctttgttcactctcctccagccacattcttctttgtgcttatccttcaacatgccaggcaggtttctgcctcaaagcctgtatgtttgtggtcccttttgcctagaatgctattcctcctggtatctacatgatcatgccttcaggtctctgtccaaatatcaccttatcagcagaatatatagcgagtttatagacaaaaaaagaaaatagtccttaaacatataaaagacgttaaaccacactcaaaagaagagaaaggccacattaaaacatcattataacagcattttccaactctttttttttttttttttttgagacagagtcttgctctgtcgcccaggctgcagtacagtggtgcgatcatggctcactgcaagctccgcctcctgggttcatgccattctcctgcctcagcctccccagcagctgggactacaggcgcctgccatcacacccggctaattttttgtatttttagtagaggcggggtttcagcatgttagccaggatggtctcgatctgctgaccttgtgatccgcccaccttggcctcccaaagtgctgggattacaggcgtgagccaccacgcctggctgcattttccaactctttagttggcaagagcccaaaggtttggcaataccctctgtgggagaggttgtgaggaaataggctgtcacacacattgctgtggaacacagttttgtgataggctgttcattccagcactgttgataagagcaaaggactgcaaacaacacaaatgtcattaatttagggactggttgagtaagtgatgctacgtccacagtggagcactatgcagctgcaaaaggaaagaataagacctgtatatactcctgtaaaattctctccagggacaaaatagtatttatagaattgtactctttgtgtaagaaaggtaagaaaatacaatcgtatattttgtgtgatttgctcatattttcaaaagaaacaatacaaggatgaatgaaaaactgataaaaattgttagttatggagagagtaagaggaaggtaaagggaacagggataggggatagactaactatcttttttaaagtttttattttggaaccatgtaaatgttatcataaattttaaaattaaatcaaatggggaaaaatggaatcataaaaaagaagaacaaatgaacataactctataacaaattgaaagattaataaacacatagaggagaattatcttaagtgactttaaaatatatccatataagtctataccactacataggaatccatcctgtgaacataaataatcacaagaaaatcttaaattatatttactgtctcattgttggttggtaatactgtcatacttattttgacactattgtatgtaaataagtaataatgctaatgtcattagaactaggatttttagtgtaagatagcagaggtacaaatataaaactgatgtaaaatgcttgcattcttaaatataaatgtgaaatatctgaatgcatagttgttttccttttaaaaatatatattttctagttcctgccactgaaaacacctgaaataaacgacagctccatagcaatggagcacttttacttcccacactgtggtctctaaataccatttcctgctaagtggaaccagcgctcctcagaataatggctgattgcctgcctggggcaggaaatgttcaagatgaaccaggaacatctttttgtgccagagctggtccttatatgttagagacacattaaaaaaaaaaatttttttttccagatggagtctcactctgtcgcccaggctggagtgcagtggccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctcactgcaagctccgcctcccaagttcatgccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctccctcccttcctctcactctttccctctctcttccctttttcctctcactctcttactgttcgttcctctcactagaagataaatttcattaggtcagatactagatgtttttctctgctatatcctcctcagcacctggaacaatgcttggcacaaagtagacatttaataaacatttgctgaatggaagaatggatagttggatggatgaaggaatgagacagaaagggattgtttaaattatctggatcaagtgtccttatattgacaggttcagtatcctttcactgggaggcagtctttgccaggctcactgtgtggcccacagaccacaggcatcaaagttacccaggaagcttattaaaaatgcttatcactgggccgggcgtggtggctcacacctataatcccagcactttgggaggccaaggcggacggatcacgaggtcaggagatcaagaccatcctgggtaacacagtgaaaccctgtctctactaaaaatacaaaaaaattagctgggcatgatggtgggcgcctgtagtcccagctacttgggaggctgaggcagaagaatggtatgaacccaggaggcagagcttgcagtgagctgagatcgcaccactgcactctccagcctgggcgacagagcaagactctgtctcaaaaaaaaaaaaaaaaaaaaaggcttatcactgggcttttcacaccagatctactgcaccaaaatcttgcagtataaggcgaaagaagctgccttttacccagcattcccagttgactcttacacatgtttatgaaccactgctttaagggaactggaatatgaccatggaccctacgctgcctgtgtaggccttataaacacacaagccctttttaaattaagagtcacctttcagctatacacagctaatatggtagctcataattaatctactggctatttaactctgctctcacctggcaatctaaaaagagtaaaaatttaaaactatgttgccctgttttgaccataagtaactggaaattactttcgggtagccttgtttttccaaatttagaattaaacattttagaaacactttcctttcagtcaccattctataattaaagacaacttgaacattgctcataatggcttttcattttgcttaggtcagagttttcacattctcttattcaagatcccttaccaacttaccaacctatctttccagccttccccccagaaaccccctcgtctgtccagaccacactgacccaaagacttttcattcatttctgcctctgcttttttactgaaatctttcttcccatccagcaggctcttcctttttcttattaaatcaccaagcatccttcaattgacatgtcccccccaaaagcctttcacatctgagcattctagttggatgtgagctcttcctcccaaacctttcccagactagtgcttttttcccacctatacacattgaactctcatccactgcttggcattgataattgtctcttcatgtgttttgcttccaaggcactgttccatatacctctcggtaaggtatccagcctgataggtgcattgtcagacaggaagtaagcagatcaataaatattagattatttgaaattcccatagatcctgtttttcacctgcttagcaagcagaacacactgttaattatagaaataatagttgattaatggccaagctggtcagaatgagagcccactcttccattacaggtaatcattgctctttctgattcatgattgtgctggaggtttttgtggacaccctgtgaacaatgctaaatctcagccagtgacttaccaatgagggcaattagtccccaaaacaccacggaggataacatggcggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttacaaagcgacggcctttgtcctgtaacataggcttaacaattggagaatccattagtcagtagatcactgcgcacctggcttcaacagagtagacatcagcgtggctctactgctgtggaggaaacttttaaacaccagcatgaagactcacctggcttttcttaccttcgtcctgtaccaatgatcattagaggagctttatatatggtttaaaaccctctctttaaaccattgacctcattaggcctggttataatagtacttaggacttaggtgacccaattaataagaggatttcaaagggcttattaaccactattaattaattaacctaatgaacccccaagttgctcaggaggcatattttgatagattgtttctagatatctaaaattgtgccaaacagcttctaaatttgcgaataagaaacagataattcactttaaaaggataacaggaaatactagcaatttttattcttggattggttatttacctgaaatattgggtctcctgctttttgttcccattccaatgtcatatgatccccgtaccagtatgtcacatgatctcaaaccactatgtcacatgatcatgataggtgaacttggctccttactccaatcccacttctgagaaaaaggtgcaagtgtggccacctgctctaggagatcaatgcaaaaccagggagtagcaacgtgagtgctcatttgcccatacttgctaaggatatgggaaaaaagattatagccagggatgaaaacttcttcaagaagagagtatctttcttcaggcttatgtccaaaggaagagaggaagcatattgtgcagccccaggaacaggaaatggaagggacgttcttgaaacaggcaaagcacattgcgctgaggggaggaagaagtctggtctgggtccttccacaagcgtgtccagtttctcagactgcacacagtcctcccccacatccactgagtgaagaaaggtggaaggcagctgtacagggaacaggaagacaaaaccacaggcaacttcccagctccctggcaataaaaccacctccactcccaggagaacatgccctccccaagctgaggtctgcacagtccactggcattcacttctgccctgcctgccttcctgcttgtagaacagacgtctctggcatggcctctagccttccatccctggaagagtggcagggctgttctgagccaatggatgattcctacctgactctcaggaaagtgacccatggagggtctgctccaccaccatcaacactgcagtcaggaccactcttgaataagggatattgcaggagtctaactgccctgaggcaggccttagaaacccatagtctatgacccagcgacattgtgcccgtgacccacttcactgcagggtgagtagagccacttacctgaggcttccaggctaagtgcaatgagaaagctcaagaaagggagattaagaagttacgaatgataagttaggtaaaagagagtaggtggaggctggggctctccctacatgcactggaagaagacattgttaataaaacatttaaagcactgttgaatgtgaagaatacttatccttctgctctcagttagtggggctacgagtccttctaggtatgaggtccttaatgtccaggcttctgcaactcaaccaaaattgttttcaaactgatgtggattgttctgttcactcaagctgtgagagaacaattgaacatttatttgacacccaacattagtcaggttcctatggatattatatgactcaatcctccactggccctgtgaggcaggtattatcccttattttagagatgaggaaactgtgactcagagaagctaagtaacttgtcaaagatggcacagttagcatgtgacagagccaggatttgaatctaggcctgtaagattccaaaatccatgctcttccactgtatcgaagtgccagcacgatggacaaatgcctctgcagagcaatcattgcaacaggtccaaatcaatctggatacaaagcattgtccgtggtctggaaaaataacaccactcacagatttttataccactatctgtcaaatgtttgtaggtgctgttgtaatttctaaaatgcaaattaatataagttaactaagtccaaagtggttttttgtcactttatattttctccaccagtaataataatgtagttaatacgcactgaccttgtatggtatgactggtagaataataggaaggggcataacctaagtttgttacattctgaagcctaactcttaactgcagtaccctactgacccagtggatggttaagtgtgggtactattgtataatgaccttagaaatttcttgtcactaagaagaaatgtactgaataattctccatctcttcccagggataccaagaatgactacatgtaagttgtactgttatttccaggaggggcttgaagggaacttggcacctgtcataatctctatcagtccccaaaataaaaacacaatctatatgcaagcaatttctgtgctatacaaataaaactctatggcctggtcccctacccctcaaatcagttgcctgctcctaagactcttcagtgcagcaattctctggcagcttctggggagtcctaacagatttggggttcctggcttcagtggtggagactccaatcatccctaacgactaaatggcctcagcaattggaaaacttcaatgggaaagtttaagcagtactgtcctagttaggaggagaggaatgattatgaaaactgaggtactctgtatagccagggaagtagattctggtaggagttcctggcaagacttctcaattcataccacacaaagacctgcccttgtgccctgagctaccctaggttagcacttttgggagttaaaggaatccagcacctcaggctcccttggtcccctcgccctctgcgtccccacctgcctccctcccaacactagtctgtgctaatagagactgggttgtctccgccatgtcattatttgtgaatcccaggcacagctttcccttctcaggaacaacagccaaggaggatgaccatagccaactcatttaacctccctgagccttaattttcctcatctgtaaaatggagatgataataatgccccatgactttgttttgaagacaaaaataaattttatatgtaaaaacatgttataaactacagtgcttcatagagatgccagttactatcatgatgggtttgcactcaagtcctgatggcttagcttcttgttgatttattcatttgtttgtttatccatgcactcaggaaaaataaacagctgaattataggacaggaagtaggaggtgaagtctctctccagccatgaagaaaacttggcaggacaagcaagagctattcattgtcaggactctgtagcctgcctggtaggagtggaggaaggataagttcagaaacagccacacaagcagctgcagcccaagcatctgtttcacagctctgaaacctataaaatgggggagctgcccaagaatatgtggcaaaggtactttggcgccaatggctggtaagaaggcagaaggggagcccttccataaaatttcactaaaacattcaacttaaccccaggatatatcaatgtcaagctttaactgctgtgtgcttttcttgtcttggttttaatctactatatgataggtaaaatgcagggtatgccctgttgaagaagccacttatatggttgcattattggtcttccaatgtcaaacatttgaccaacatttcaggaaagaagatatacaaatggccaataaagctcatgaaaaattggtaaacatctttacacatcagggaaatgcaaaataaaaccaaaatgagacagtatttcacactctctaaaaaggctaaaaccaaagactagctatatcacatattggtgagaatatgaaacaaaacagaactctcatacattgctggttggagtataaaatggtatgattgctttgtagtactgttcagcagtttctaacaaagtaaataactatatgcctcaggaattttatttctagttatttacccaagagcaatgaaaaaaaaaaaaatgtctcccaaaagacttgtatgagaatcttcacagattgtaagttctgcaaagagaaaagaaaaaaaaagaatttttacagtgctttattcataatagctcaaaactggaaacactccaaaaaattcatcaacagaagaatggactaacagttgtagtataacgatataatggaaaaatacacaagttaaaaaaaaaatccaggaaaaaattccaatgaacctgggctgggtcaggtgcccacctctggatcattcaaccatgtctaggaatatatttgtttgaaaaagggactccctgtggtttggaaaggagaagggagaagtctgaaacaaaattttaaagtaacgttttcattttgaaatagtttaaatttcacaagaagcttcaaaaatagtaccaagagttctcatgtacccttcacccagcttcccccaatggcaatgtcttacataactatagtacatgtcaaatccagaacattaccattagtattatacaatactgtaaacttaggtacagaccttatttggatttccccagtttgtttttacacgctcttttaaaaaaaatatttatttatatttcagaagcgtatagtactgtgaacgtttatcccacaggtagatgcaagtaaccatcaccataatcaggatacagaactgacccatcaccataaaaagactgcctcatgatatcccctaactatgtctttcattgtgccaaaagtaaacttttttttttttttttttttgatggagactcactgttgtcagcctgggctggagggcagtggcatgatctcggatcactgcaacttccaccttccaggttccagcaattctcctgcctcaacctcctgagtagctgagattacaggtgcccaccaccacacctggctaatttttgtattttttagtagagatggggtttcaccatgttggccaggctggtctcaaactcctggcctcaggtgatccatctgcctcagcctgccaaagtgctgggactacaggcatgagccaccgtgcccggccaagtaagctattttttaaaaacagcttgatttgaggtataattcacatatcatagccttcactcatttaaagtgtgcaattcaatggtttttagtatgttgataagagttttgcaaccatcagcataatcaattttagagtattttcattatccatggaagaatctccacaaccattagcagtcattcccagtttctctcccctccctcttctctcctgttcaccctctgaccccaggcagtcacttacctagaagtctggatgattttgtaaaaaactgctctatagttgttcactatacctgtgatggagagaagagctggagcagtatctggagaaggacttgtgtcaaagacagtccttttgtcatggtttaacctgggagtgacttgaatataatcaaatgctgtagaaaatgaggatacaaaaaacaataggattatttggtcaggtaatgatgttgaagacgctagttcaaaagcttaagcatagaaattggcctgaggcaggaatgggactgcctcttccattgtaacagaaagaaaagagaaaaaaatcagatagcaatgcagttcagtgtatagagttgataggagaaaactgagggagttatctaatgatttttaagtcctttgtgaaacaggaggtcaaatcatgtgctgagagtaaaaactacgtggacttagaaaacggagagcatgtggaaaagctacccggtagaattggagagacagctgaaagagagccaaaaagatgagtggggtttacatatggactagttgagattggagtccataaatgttcatttggaggtattgaaatgctggggtctgacacggcaacctaagtacagacaaggagaaaacagagggctggagtggtccagggctgaggtgcagctctgcgggggccatgcaaggaggatacagggacaagtgagatggagtttggcaaaggaatggcttaagtaatggcaagtggattggaaatgaagggaagaaagtaaggggctatcatggggccagtgggaagatttaagcttaaggttttggaggtggagtgtatcggccatccttttctcccagcttacttctcttaccttacctctaactccacccgcagttacaacaaacagtagcatacaagcttcagcctgctttgctcaggccctttcccaagtgcttgctcactccctcgtgcctgcttcctgcagtcttgatttctaggagaactggaatcccctgtggacctctccaactcattctccttagtaacctgaccaaaatcaagggcagaaggatgagggggtggatggtgagaggaataaatcaggcatgcaggggcttgggctatcgcatatccccacagacagtggaggagcaggcaggtgtgggtgattctgggctgtgtgtgcaaagattctggtgaccttttatcaggccagaggccctcacagtgcaaagagaggaagcaggggttaggagcctcagctggaggcttcttaataataagttttcttgtttaacaacagaaggatgttcatactgttaagctctttactttacttaagcaggttattaaatggtattaatgaatgtttccaattttgttttaagtgtgtgtatatgcaggcatggaaattaagctgaattgcatcttcaactataccagatgttacaaaattcttcttcaaagcagctgtaccacatttacccctctaaagcaggatgtaagtgtttccatgctccatatctccaccgaggtttgctataattagacttaaattgggtgagaaaagtcagtttcctgactgaggttgggcatcttttcatatatgctcattggcagtgtcagttttacctgctctgaactgcccgtttgtattctttgatcacttttcactgggttgtttgcctttttcacattttatttatttggctttaaaaattttttatatcacaagatatcatcaactttttctcattttttaaaatagaagtcctcatatactatagtctgggtcctagtctttttttttttttttttttgagatggagtcttgctctgttgcccaggctggagtgcagtggcacgatctcggctcactgcaagctccgcctcccaggttcacgccattctcctgcctcagcctcccaagtagctgggactacaggcgcctgccaccacacccagctaatattttgtatttttagtagagatggggtttcactgtgttagccaggatggtcttgatctcctgacctcatgatctgtccaccttggcatcccaaaagtactgggactacaagcgtgagccaccatgcccagccctagtcctttgataatcatatgccaaaaaaaaaaaaaaaaaaaaggaagaagaagaaaaaaaaaaaagaaagaaattttacaaaaaattacataattaaaagggatataatcagtaccttgcagtaattttcaagtgttctacaaggaacttgtattaattttcagaaagacatgctatattaaaactctttagccatgtctgatcccacagatgattgctgtggagggctaccccttagatggccttcgaccccaggttttatgagaactgcaagggcgtcttctagagttctggccctgtggtgactgggatggtgagtgtcttagtctgctatttttgctgctataacagcataccacagactgggtaatttatgataaacaaaaatgtattgggcccatggttctggaggccaggaaatccaagagcatggtgctggcatctgacaagggtcatccatggtggaatggcagaaggtggaggtgaacacacaagatggagagcaaatggggctgagctgatcctgcagaaataaagcccccctgagagaacagcattattccattcatgagggcgaagcctcatgacctcattatctttttttttttttttttttttgagacagggtctccctctgttgtccacgctggagcgcagtggtgcaattacagctcattgcagcctcaacctctctaggctcaggtgaacctcttacctcgactctcgaatagctgggactacaggtgtgtgccaccactccccactaatttgtatgtgttttttttttagagacaggatcttaccatgttgcccaggctgatctcaaactcctgtgctcaagtgatcctcttgcctcagcctcccaaagtcctgggattacaggcgtgagccactgcaccctggcacctatcatctattaaagtttccatcttccaataccagtacatatgataattaaatttcaacatgagttttgatgaggacgtttgaaccaatttttcacacttctcagggttaaattcaggggtgaagggatatgcaatgaatttcagttccagatgtgtacagcaatagagaggcataggaaattgttggcctccctgaggcctcacccaggacaagcaatggagagaggatggctcaggaatcaccattgtcagcagttactcccaagatttgacccaggctcagtgggttttcctgaggctggaacaggagtgagaatgtctcagccatgttccccagctcctcctggctcctgacaatcctggggccagagaattgactattcaagacaaatgggttaatggcccagcgggtcatgacacacaggtaacaacagagagcaacctgtactgcatttccttgaaaagagtcaattaaagaaggtgctgaccctggcagagtgagtggctcagccaaaacatcattctacagctcattttgttctatcttattcatctcagtctgatttaactaattttgccagattctagtactcatctaaatttttcttaaggggttataactgtgacagaaaaaataagtaaaaatatataagaagaaaatgggagctacaggttttatctttgcctcctctctcttctctgtgtagacataagcacaaacacactaataatattttcactgccaaagtatctctgtattaattactcaccttgaaaattaccaactgtctgtagaactgggctgagccaggattgtaaaataggcaacatctatttaatatctcatattgttgcagtactttggaattttgagtgggctttcaaataagttaaaataatagaaataaccttccaggaaagatcaagcagattttatgtcccccattagacatataagaaaagagactgacttgcccaagacgtcctatctaataaatgatggagctgagactggaaccaaaacattcagattccgagtccagggcatttctttccatcatttattgggtcagatgatgatttctaaagcattttacaccctgaaacttcaggattccatgatttattttgtcatttccaacagtcaggcattcatgctctcacttgccatctggctgcacaaagactgcccttcactgccacctacgcccaccctgattttaacactgcccagcacctatgcacttcccccaaagcacccatccccagtcccagtggaaaatatacttattcggtgttttatgttcagagaccttctccacctgtgctgtccaatagaaacaaaatgtgagccgcacatttaatttaaacttttttgtcagccacattgaaagaagtgagattaattttaatgctacattttgtttagcccaatatactcaaaatattatttcaaaatcaatataaaagttgggatattttataatcttttttgtactaaatgtgtgtattttaggcttacagcacattgcagttctaactagctacatttcaagtactcaatagccactagtggccaccatatttgactgaagagtttttttttctatttttatttatttttaatcttttaccacatctttttaaatttattttttatttcaatagtttttagggaacaggtggtatttggttacatggataagctctttagtggtgatttctaagattttgccatacccatcacctgagcagtgtatattgtacccaatgtgtagtcttttattcctcacccccgtctcacccttctccccaagtccccagagtctattgtatgattcttaaggcgttgcatcctcatagcttaactcccgcttgtaagtgagaacctacaaggtttggttttccactcctgagttacttcacttagaataatggtctccgatgccatccaggttgctgcaaatgccattattttgttcccttttatggctgagtagtattccatggtgtgcatgtgtgtatgtatatatatatataaatctatctatatatatatatgtatatatatacatcacatttgctttatccactcattggttgatgagcatttaggctggttccatatttttgcaattgcagattgtgctgctataaacatggatgtacaagtgtctttttcatataaagacttctttccctctgggtagatacccagtagtgggattgctggatcaaatggtagttctacttttagttctttaaggagtctccatactgttttccatagtggttgtattagtttacattcccaccagcagtgtaaaagtgttcccttttcaccatatccctgccaacatctataatttttaaaatttttttaattatggccattcttgcaggagtaaggtggtatcacattgtggttttgatttgcattcccctgatcattagtgatgttgagcattttttcatatgtttgttggccatttgtatatcttcttatgagaattgtctattcatgtccttaacccactttttgatgggattacttcttttttccttgctgatttgtttgagttccttgtagatcctagatattagtcctttgttggatgcatagtttgtggagattttctcccactctgtgggttgtctgctctgctatttcttttgctgtgcagaagctttttagtttcattaagtctcatctatttatctttgtttttgttgcatttacttttgggttcctggtcatgaactctttgcctaagccaatgcctggaagagtttttccgatgttgtcttgttttggtcctctttagaaggtggtttcataatcagctataaaactccaacaggtgctcttaaatgcaggtttctgataactgtggagattgtgacatcagaatagaagaaaacttttaggactcacggagtactgaaatgttcatgaatatcaagcagaacaggaattaactgcatggactaaactaatagaagtctgaaataatctttttaaattttgcttaaaatgttgctgatcctttgttttgtttttcagagtcaataacacttttaagttatttacagcttttaacagttgagtaaagtatactcctatgaaaaaaatttggagcatattcatttctaactgatttctccagaagttggaaattatttgtgggtatttttaacttatgacaatatgttatttgcataagtgcaataataatctgttttctgtaacaggacacagttggagaaactggtattttaccaaggctttgacagggatggcatgctttcctttaaggaatcaaacttgacttatggagtcactaaaagccccttggaaaaactgacctcatacctttgtctacaccgtccctgtatagggttcctgacctgtggcaagtaaagaatgtcaccttctgacaggcccaggagccccaggtttatcttgggacctcaagagaagaggaatttactcaactcacaggcatttgatggtacaaatccatggctggacttggcttttaaaaagtcttatctgagattccttctatggaacaaagttccatcaaagccaatttataagcctatgtaaatatttttgctgcactgtatacaaataattaggccaagtataagaaagcaaaccaatcttaccatgatttgtctttagtaaaaatgggaaactggagagaaaaattatgtttcaaaaactatagtacacctgttgttagattctagtcttccctaatgtttttcaatttttattattttctacagtttggattgaattctaatttttcttggctacaagtcttcatcttcaaaataatgttttcatttttttctcttctttttttccccatttttcctaatttggagtcactgaaaactaaactgtgctttcctgtgaactgaagccagacaacttaaacttcagaggaaaataacagcaacctatgtacatacatgatgtacatatgtacatcctatgtacaacctatgtgcatacaaccactttcataactgcctactgatgtatggacttcagagttatgtggcctatatcgatttgccaggattgttcttttgcctgttattgtttttctcgcttcctccccttattttctcttcaaaggacatgagacttcacaaccttgtaaaaatgagctttcctaataactcaggacctacccatctaggaataaaccatcccaaccaggagagatcagatgaaacctgagaccacagactcattttcttctaaaatgctttctccaaaagatttttaataagaaaagcagggaaatatgaaaggaaaatttcttgggcccccaaaatcactaagctaaagagaaaagtcaagctgggaactgcttagggcaaacctgcctcccattctattcaaagttacccctctgctcactgagataaatgcatatctgattgcctcctttggagaagctaatcagaaactcaaaagaatgcaaccatttctctcttatctacatatgacctggaagccccctccccattttgagttgtcccacctttgcttcgagttctcccgcctttccagaccaaaccaatgttcatcttacatatgttgattgatgtctcatgtctccttaaaatgtataaaaccaaactgtgctctgaccaccctgggcacatgtcatcaggacctcctgaggctgtatgacgggcacatgtcctcaaccttggccaaataaactttctaaattaactgaaacctgtctcagattttcagggttcacataatcaaccttctgaattctttatctggcaattcagagatttctttttggtttcgatccattgctggagagctaatgtgatcttttggggttgctatagaaacttgttttgtcatattaccagaattacttttctggctccttctcatttgggtagactatttcagtggaaagatctagaactcaagggctgctgttcagattattttgtcccatggggtgatcccttgatgtggtgttctccccttcccctaaggatgggcttcctgagagctgaactgcagtgattgttatttcccttctgggactagccatccatccgggctaccaggctctgggatggtggtagggaatgtctgcaaagagcctgggatatgatctgtcttcaggtctcccagccaaggataccagcacctgcttggaccagagagttttaaatagtgactgtaatgtgagcttttgatgtcctaaggaaaagatgtggcctaacatagtttttttttttttcctgtctatggagggaatattttggactatgtgaaactgtgctataccaggtcatatcagctccaagctcccttgaagcatttgtcttaagtctcagttcaaacctggctctgcccgtaactggttgtttgaccctgagcaactgacttaacacctctgggcctctatttcctcacctaccaaaccagaatactatgacatattttcagtacttttgtgtgagttaaatttaatattctgtatagggacctatcactgtgcctgtcctatatatccacacttcaacaacagcaactcttgattgccctctcctccctctatgctgttcagtcatgctccaccttctatgactagatcagcctggtatgtagccaccacttgaggaggagaaaaggaattgacctcctcagtcacccctggacatccatgcaccagtatacctgtgaccacctgtgctgggttgaatagagtcatcctgaaattcatatccaccagaaaactgaatgaatgtggccttatttggaaacagggtctttgcagatgtaatcaagatgaggtccaaccagattagggtggggcctacatccaacgattagcatccttaaagggaggccaagtgaagacacaggggaatacataacgaaggctgtgtggtgttggaggcagagattggagagatgtgtttaccacccaaggagtgccaaggattgctggcaacaccagaaggtaggaagagctgaggggtgattcttccctagagctttcaggagtatggcctttctggcaccttgatttttaatttctaacctccaaaactgaaagataatacatttccattgttttaacccatccagttttcagcaatgtgtgatgacagtcctaggaaatgaatacagcatcatacttttttctaggtggctttgccaatagattgtcaattcatgttctgtcatattcagttttatgtcccctgttcttagcatagcacttggcctacccgggtgctcttaaatgactgtgggctgaaaatgaagcgagaaaacacatggggaaaaccaagttggataaacatggaagggtgtcagtttaaccctgatacagctcgaagaatggcttacatgggccaggggaaggggcaagtttggaacattctgtgggtgattgtgccagaaagtgatccaagaatctctgattggagagtttgaatgtaagacacagagaaggacatgtgcagtaaaggagcccaaagcagaaagacctctgagaggggacagtaagcagaagccttaaggcaggagaagccatgagtgcacacccacaggagaccagagagtactcagaaagtcacttggctgttagaagtggtcattatcaatacagaatggagacttcccgagtctcaggaaaggccaccaagagctgcccctaggccactaggaggtctcctggagaacattctaggtcctcatgccacctactcaccctctgctgaggtggcttccaatgctttctcactcacttcccttatgaatctttacagctaatcaccatcctctgaggtaacctgagtatttttctcaactgcaggcctaaatgtagtttgatttaatttgactgcttctagatagttttatttttactttatagaaaaggaaactgcgattcgtattagcccattggtgcgtttaagcgctctctctctttctctctctctctctctctctctctctctttctcttcctttgtctctcactatttttccctcttaggttagttagagagtgggcatgtgacacagagaagacagcagcaggaaaggtacattttgatgggacaaggaaggtgttgtgtgagaaatcactgggtgctcacgggttctgccgagacctgcttggtcgtggagaccctaacccagtggcgctagacaaactaaagacacacacacagaaatatagtgtgtggagtgggaaaccagggggctgacagccttcagagctgagagccacgaacagagttttacccatatgcttattgagaacaagccagtaataagcattatttctatagattataggttaactaaaacgggaaacaaagggatgggctctggctagttatctgcagcaggaacatgtccttaaggcacagatcgctcatgctattgtttgtggttcaggaatgtgttaagcggttttccaccctgggtgggccaggtgttcctttccctcattccggtaaaccaacaaccttcagcgtgggcgtcatagccatcacgagcatctcacagagctgcagagattttgtttatggccagttttggggcctgtttatggccagatttgggggcctgttccccacctgtccccctttttgtttttgcaagacgataaaagcaaaggtggctttgtcacggtgagctacttctcacaggagctgggatctgcatctgcagactatacaaagacaagcaacacagactaataacacaatcatcattgaaatcacagagcatccaagtgtttttatccattttaatgggttgatagctgctaatccatctgcagctccttcaagcactccagttcctggcattaaggtcaggtgtgcctgggatactttaaatatttgttcttttaattttggaatatctgacgacaagtttgtagagtgtccttctagatgcttttttattctttcccaaattttgatcttattaagagccattaatagtttccacaaatcctgatgtttagctcctagaatgggccatatcatttgagtttgaggtgccactgtaccaccatgtttccagataataggaactcttgccatacttcttaccatttctaccatctgaccattttgttcagaccagctgaacatagtatggccatggcatgcagactgagaggtgcaattcaaactaaacatcctcttagggaaccaatcagtaatgattccatgggaatcgttgtgcagcctccctgcctgttctgcaatgcaatctttccaaacaagtacgttcatttcttctgaccaggtccaatcctgtttacaaataggtttttgagggtggtattcctcaagtatagaagcagatttgttatggcaaatactgagaccagaaagcatgtgtaagtgtgtcatagagtgattacatccggtcattattgccagtcaagatttgatagcgagggggtaggcaactagtggcctttcccaaacagataggtggatgttcaaatcctaaagaaatattcataacagttccttcctcatgtgggtgagatgggcctctatcatctgtaggaccgagcatccaagagttatcattagtgtatacctccattggggggtccagccaagttacaggctgtagaagtggtggaaaaggtaaatatgcccaataagtataatcgttctctgtgtcagcccttgctaaaggaatactcatggcaatggtgatcaccgctaccatggctatcattaaattactcattgtgactggttgtcctgctttcctcaggttttcttctgccatctgtgacagcttcttgatctgtccccaggtaggtggctgtgttcaacgggtgttggtcgtgacagttggggtcctccttagcatcaacttggacaatgctgccactgataggtctttgggatccccccaaaacctcttcctgtgtatctggctcatagtgatgctttagaggtctcgatggtacccaaataggctgttgattcagtcctggagaaacacaagcataacctctaccccaagttattatttgacctatttcccaactttttgttatcggatctctccactaaaccagttgttctgcttgtctttgcagctggtttctgtaaatgctgttcagccactgttgtaactgctgaacagatgctgttcagatgctgttcatctggtctttaggcacactcaaaaaatttaaactcaataatgctagattcaattgcatgtgtggtgtcctgtagtctctgtttccacccttttgcttttgcaactgctgtttcagggagagattgattctttccactatggcttgtccttgagaattatatgggataccaataatgtggttaatattccatatagagaaaaatgtagctagagtttggctagtatagcctggggcattgtctgttttaatagaagctggaatgcccaacagtgcaaaacactgcaaaaggtgatgtttaacacaggcagaagactctcctgattggcatgtatcccagacaaagtgagaaaaggtgtccacacatacatgtacataagctagtctcccaaacaagggaacatgggtaacatccatttgccaaagagaattaggttccaatcctcaaggattaactcctcctgtaaaagatgagaaatgcaccatttggcaagttgggcatcactggataatagctttagcttctttccaggtaatgctgtatctgcgtttgagaccagaggcattaacatgggttaaattgtgaaagtgtctggcattagatattgcagtagcaactaggtgatcagccatttgattacctgcagtcaaaggtcttggaagaggtgtatgagccctaatgtgagtgatgtaaaaagggtgcattctactcctgactgctgtttgcaattgggtaaataaagtcatcagttgttcatctgtatgaaatcgtaactgagcattttcagttaattgtgtggaatgaaccacatatgaagaatcagaaatcatattaataggcatatgaaaagcaatcaatacctcagttagagctacaagctctgccttttgagctgaagtataggatgtctgtaaaactttacctttagagccagaataagaagttttaccattactagacccatctgtgaagatattttcagcaccttcaattggtttaaatttagttattttagggagaatccaattggttaatttcaaaaacggaaacagttttgtttcaggaaaatgattatcaagaatacccacaaagtcagctaaatgggtttgccaagtaagactatttataaaagcttgctgtatttgcaccttcgtgagagggacaataatttttccaggatcatatccatgtaatttaacaatccgagttctcccatttcttttcatagtagcaatttgatccaaataaggagttagagtctgtgaattagtatatggaagagaaagccactgtagaagatcttcctcttgaacaataactccagtaggtgaatgctgagttgaaaaaattagcaaatctggagtcttttcttgatctattctatttatttgagccttatgcactcgcttctcaattagctgtaactctccctcagcctcctttgttaattgccaagggctagtgagactagaatctcctctaaggttagaaaatagattattcatggcctaggtaggaatgcctagagcaggtcacatcaagttaatgtctcctagtaatttttgaaagtcatttaatgttttcaattgatctctacatatgtttactttctgtgacactattgtagtgtcatttactaaggtctctaagtaggagtaaggagtagtagtctgaattttatcaggagctatagttaaaccagcgtgagaaatcgaattttgcaagtgatcataacattggagtaatatttctcaagtgggggcaacacaaagtatatcatccatataattaataatgcaatactattaaaattttttacaagtaggttcaatttcttaccctacataagtctggcaaatttttggactgtttaacattctttgtggcaacactttccaatgaaaacacttagcaggctgcaggttgtttactgcaggaattgtaaatgcaaaccgttcacagtcttgctcatctaaggggatagtaaagaaatagtcttttaaatctatgactattgaaggccaatttttcggaatcatagcaggagaaggcaatcctggctgtaatgcccccataggttgtataactgaattaatggctctaagatctgtcaacattctccatttacctgattttttcttaataataaagaccagagaattccaggggaaaaatgttggagctatgtgtcctttttctaattgttcagtaactaagtcctctaaagcctccagtttctctttacttagtggccactgttctatctaaattggcttatctgttaaccattttaaaggtataggttctggaagctgaacaatggccgccatcaaaaatgatatcctaaaccttggcagaaactttgtctttccacttgaagcagttctttcaaaccttgcaaattttttcctagtcccataccagggacataccccatttcatgcatcatatattgactttgagggctatgtaattgctttggaattagaacttgtgatccccattattgtaataaatctcttccccataaatttataggtacagaagttacaattggttgaatagtcccaggttgtccatcaggcccttcacaatgcaaaatataactactttgatatacttcaggggcattaccaactccaactatgataattgagcaggttgaattggccacgcggacggccagtgctgtagagaaataattgaaatgtccgctcctgtatctaccaaacctttaaatttctttccctgaatagttatttcacaggtgggatgtctatcagtaatttgattcacccaataagctgctttgccttgtttacttgtgcttccaaatcctcctgtttgtttagtttcactttttctccatttccacatatggcacaatcaggagctgtgctgtacactctcctggctctgctttccagggaacagaagtagatacaacaatttgaacttccccattgtaatctgaatcaatgactcttgtatgtacttgcacttcttttaaatttaaactagatctacctacaagtaatcctaccgtccccactggcaagggtccacagactcctgttggcactttttgtggggatctccaggcagaaggctcacagcttctgtgcagcataaatctactgtggcactactggctgtggcaggggacaggcattgttcaggagtgaaggaatggcctgagccagaaatgccccggtttggaacagggctcaggacgggcccctcatggcgtttcctgaaattgggtttccatcgttatcaaatttagaatgacactgattggcccagtgttttccttttttgcattttggacatattccaggctcggcagttttcttttttccctcaactggctgcatgacttgctgattttttctacgttcttttttagtatgaccatgcttcccacagttaaaacaagctccaggagatggagtatttcctttacccattttcagtcctgccatggcttgtgccaacaaagtagctttatgcagattacctccgataccatcacaggccttgatataatcaactaaatacactttccctctaataggtcacacagcagcctggcactcaggattggcattgtcgaaagctagtaactgcaacactatatcctaagcagccgaatctgcaatcatctttttaagagactcctgtaaccaagctataaaatctgcatacagaaacaacaggtgctggagaggatgtggagaaataggaatgcttttacagtgttggtgggagtgtaaactagttcaaccattgtggaagacagtgtggcgattcctcaaggatctagaactagaaataccatttgacccagcgatcccattactgggtatgtacccaaaggattataaatcatgctactttaaagacacatgcacacatatgtttattgcggcattattcacaatagcaaagacttggaaccaacccaaatgtccatcaatgatagactggattaagaaaatgtggcacgtatacaccatggaatactatgcagccataaaaaaagatgagttcatgtcctttgtagtgatatggatgaagctggaaaccatcattctgagcaaactgtcacaaggacagaaagccaaacaccgcatgttctcactcataggtgggaactgacaatgagaacacttggacacagggtgggaaacatcacacaccggggcctgtcatgggatgtggggatgggggagggattgcattaggagaaatatctaatgtaaatgacgagttaatgggtgcagcaaaccaacatggcacatgtatacatatgtaacaaacctgcatgttgtacacatgtaccctagaacttaaagtataattttaaaaaaatctgcatacagttcttttggttcctgttttacagcactaaaggaagggtattgttctcctcctgaagtgattttttcccaagctctgatgcacactcctctaagctattctatggcatcatcctgcatgaccacttgtgcatctaaaccagcccagccgctgacccccaaaagatggtctgcagttatattaatttgaggttgggcctgggtgttgcaagcagcctgaatggaagcttcatctgcccaccaagttttaaattgtaagaactgagcaggagttagataagcttgagtaagagcatcccagtcagtaggaatcatccaactggagacagcaacattctttaacagtcccattacaaaaggagaacttggtccatactgatttatagcttgtttaaattctttgagtaatttaaaaggaaaaggctcaaatgtagctataatatttccctgttgatctggggggggtgtattctaacagggaactgccaagcctctatattaccctctcatctagcttgctgaattcctgcctaaatacaactgagagtggtagctcaagatgctgctcgaacagtcactggggcaactactttttgcccagtgtcctctggaaaagaaagatctggagggtcaggccaatctttttcttcaaaataatgaaggggtgcagaaaggtagggacaaacctctcccttctttgccgctttagctttagctggcaaacaaacctgctctgttacctcttctgttacttcattatactctccttcctcctcatcatcagtgtgaaaaggttccaaggtggaaccaaccagagcccacacttgtcccattgttaccttgatgcttctgagctccccttcttactcaccatggggattgtttaagagtacttgggtgtcctccagcatagttccatgttctccaaccatcgctctggtgacccttcgacccgggttcgagccacacatatgggtgccacttgctgagaccagctcggttgtggagacccaaacccagcggtgctagaggaattaaagacacatacacacagaaatataaagtgtagagtgggaaatcagggggctaacagacttcagagctgagagccacgaacagagttttacccacatatttattgacagcaagccagtgataagcagtgtttctatagattatagattaactaaaacgggaaacaaagggatgggcttggctagttatctgcagcaggaacatgtccttaaggcacagatcactcattctattgtttgtggttcaggaatgccttaagcagttttctgccctgggtcggccagctgttccttgccctcattctggtaaaccaacaaccttcagcatgggcatcatagccatcatgagcatgtcacagtgctgcagagattttgtttatggccagttttggggcctgtttatggccagatttgggggcccgttcccaacaggttcttggttggagacatcagggcaacacgtcaccaacaggaaaaaaacactgaggggagcttcccattggtgcttaggaatgaacaaaaaattatcaactgtaaactgtttccctcagagaaaacagtgtcacaaaaatcttttttaaatgcttgggtgttttctgtattgtgttttcacttagcttagaaaggacaatgcctgccaggctgtaatcaatgttgttacatcaggctctaaggacagttatgaacagtcttctctcctgagatgtttcaaataacacatcctgatgcaactttatcaaataaggcagctgcagactctccaaggccacataatactgtgttttcctaaggattaggttgcataattccagagatatctgtggtttgaagcaaatgaattatcaacagaagagtcatatgtcaatgagcggaatggaaaaacaaggtagaggcagtctttcatctgaggagaaatgcagggtctcccttcaggatgaacagatggttcacccatcttccccaggaaaatgaaaccacagctgtgggtctgagtgccgatgctggatgaaagttggaagctgtctctggaaagcaggcttccccaaggctggatgagtcaggccagggtgctgctcttctggtaaagtcagaattccactaagcaagtaataagcccattggtgtgaagtgtcaacatgtatgtaacaaagaaaagattttacaatcttctaaagcaattatgtccaacctgggcctcatgcagtccaagacagctttgaatgtgacccaacacaaattagtaaactttcttttctatttttttatttttatttattttatttatttatctatgtatgtatttatttatttatttatttattttgagattgggttttgctcttgttgcccaggctggagtgcaatggtgcagtctcagctcactgcaacctccgcctcctgggttcaagcaattctcctgcctcagcctcccgagtagctgggattacaggcatgtgccaccacgcctggcttaattttgtatttttagtagagacggggtttctccatgttggccaggctggtctcaaactcccgacttcaggttatccatccgcctcggcctcccaaagtgctgggattacaggtgcgagccactgtgtctggcctgtaaactttcttaaaacattatgaggttttttttttttttttagcttatcagctatcattagtgttagcatattttatgtgtggcccaagacaattcttcttccagtgtggccagggaaggcaaaagattggacaccactgttctaaagagaagaaaaagaaatatagagagaggattaaaatcaaaatgatttcagtcttctcaagagtaaccctaaaagcccaaagaccaacagagcaatgctttaaaaactccaaaggaaaattatttccaaactagaattctgttccaggacaaattcactaattcatgtgataatagaaagaaagatattttggatctagaaagtctcaaaaaacttatctcccattcacttttctcagaaagctgctagaggatgtgctccattaaaacaaaagagtaagctcagaaaggatgtaaaaaatgaaaggtgcaacataggacagctacaaaggaatatggggaaggggatcccaggatgtttgcagggctttctgacttacctgagacaggagcaggtcagaagtttccaggaaagagttcttcatgaaaaataattgatagactctctgataagaactaccaattaagaggatatttagggttgaattaatgataagtacagacagaactaaggcagcaagcaatggataattattaactccattattattcaagaaagtaaagtaatcttgggtgattacacaactcagctgtaaacagtgtttgcatagtatctgatatgagaccaaaccattttttgtgatgtaattcacagtctctaggaagaaatctctggcatcctgatagaaaaatcttgtacttaaaaacaaacaaataacaactttaatgtgattaagacttacactgagacaccagtcccctacacacccagctgactgtcagcccagagtttagtgatctttaaccaaatattctttcctttttgtattgttgggaaatttaaaatgtctacaaaacatcaaaaagaaagaaaccagagtaccatggacaaaggctcatcatctgcaaagatattttatatgcagagagaaattccaccctacttaggcagccaagaagtaacaatccttttttctttctttcttttcattctcaaaggaggtgagaagttacattccttttctactgccctatttttagccattacatacatatgttctctattaacagtaacctgtcctcctatgagaagaattaacagagccatttgctgtacattctttcacagtttagcctaaattcacctttatcaaaaggaataataatggcatgggcaacatggtcagacctcatatctaaaaacaatttaaaagttaccaaggcgtggtggcacatacttgtgttcccagctacttaggagactgaggtgggtggatcacttgagcccaggaggtggaggctgcagtgagctgtgattgtgctgctgcactccagcctgggtgacagagcaagaccctgtctcaaaaaaaaaaaaaaaaggaataataaaatttatctctgcgacaagcagatgaagatagagacagaaaggtgctcagaggttaaacttccacagtgaatggaacatagagacattattttcctaggtgtttatttacatttcaaaaagatggctctcagatttctgaaaaaaacaatctgggttgtaaagtgacaaaaggctaactcaggaagatataaaaataaaattttatatacttttcactgggtgggaccatcccgcccagtgcaaactgcaaaatacttagcagtctttgcccagccccttcccaatataccagtaatgtctaaccccaaccccctaccccgggcattgtagcaataacaaaagaaagagaatgaggagaagggagggagggaagaaaactgccctcacatattttcaaatacctcctggaaaaggaaggccaagctagaatgaccaactcatcccaatttgcctgggacttttcaagtttaattttaccagttttggcactaaaagcctcatgtcccagaaaatccactagttccaggcaaaccaggacagttggtcaactgaacaccccatgacatatgcacacatgcacatgtgtgtgccaaccatctaattatgtatgtgtgccacttaggaaaaaattaaaacttaaaataaaaagataggctttaacattgaagacatctgggtttgtattatggtcctgtccctcaccagttttgtgacctagggcaagtttctgttgatgaattacaatcatccctcggtatcctgagggactgggtccaggagctaccccccatacccaaatccacggatgctcaagtccctgatacaagatgatgtagggtttgcatataacctatgcacaacttcatgtatactttaaatcatctctggatgacttataatacctaatacaatgtaaatgatatgttaatagttgtactgtttagggaataatgacaagaaaaaaaagtctgtgctttttcagtacacataagtttttttttctttttaagacaaggtttcactgtgttgcctaggctagagtgttgtggtgcatagctcactgtggcttcaaactcccgggctctagctatcttcctgcctcagcctcccaagatgcaatttttttcccgaatattttccattcacattcaatccaccaatgcagaaaccatggctatggagggccaactatactatcaacaactctggttgccacttctcttgtctgttctagggaattaaaatgatgtaacctgtcagggctggtgtgagagcaatccctaataaatggccttgcctctttcttgcgtgaatttgggcctcagttctccaaaattcacctattgacacaccctcgatattttttatttcttttttctgagacagagtcttgctctgtagcccaggctggagtgcagtggcaccatctcggctcactgcaagctctgcctcccgggttcacgccattctcctgcctcagcctcccgagtagctgggactacaggcgcccaccaccacgcccggctaattttttgtatttttagtagagatggggtttcaccgttttagccaggatagtctcgatctccttacctcctgatccacccgcctcggcctcccaaagtgctgggattacaggcgtaagccaccgcgcccggctgatattttttatttcttctttagcgaaattagcttattgtgttcttaactaattttctgtatctgaattagaaaaggagctgatatggtttggctgtgtccctgcccaagtctcatcttgaattgtagttcccataatccccacattcccattacctccatgctgctgttctatgatagtgagtgagttctcacaagatctgatggtttcataaggggcttttccctctttgcttggcacttctccttcctgccatcatatgaagaggatgtgtttgcttccccttctgccatgattgtaagtttcctgaggcctccccagccatgcggaactgcgagtcaattaaacctcttcctttacaaattaccaagtctcaggcagttctttatagcactgtgataatggactaatacaggagcctttgtgaacaaggacaatgtctttgcatcctggttttatagttcttaatgcagtggctgcagatagaggattcagtaggatttgttagttgctatatcatctttctcaatctgtaaagtgctgatattgtacagataatagaatgggacatgaataacttttatagaatataaatcttcaaattcagtaatttactagtacggtgcacagccaatgtgcttgggggcagctccggctgatgaattacctcccatggcctggctctcttggtgacttaagtgcccccaaactagggaatagtttagctgagttagagacaatttgggcaggaaaattagggagtttgggtgtaggagaaggttcagttgtccaggaaaggaaaggagacaataactttcatgacagagagacaattctagggttaagatgatgccagaaagttagcaagtgactttcctaaagccatttcatacagtatatggggctggctgccatcttaccctttttctcatcaaaatttttcaattaaaatgtgaaacactgacttttatcaaagaagttaatgttagggttgccagataaaatataggaagcccagataattttgaattttaaataaacagttaataatttgttagtgtaaatgtgttctaaatattgtgtgggacttatactaaaaaattatttgtcatttctctggaattcaaatttaacctgggcttcctacattttgtttgctaaatctggcaacgccagtcagtgaaaaataaaattcacttcacagaaaacccacagcatggctaatgtccatgagaatacctttaaagaaacacggcccttgatccacacagacatacactacatattataaatgcaggtcaaaattcttcctttaatgtgattcatgttattttaatgacttttaggtcaaactcagattcccagttacaggtgcccttggctagttttatctgtgtaacatttgaggctgcatatgtgatcatggtcttgggtttcatctgagatgttagaagccatgtctcttgaggtacttggctcgtgcaaggacatcattgcagaagtcacagctcaggtcctggctgcttcggacatagccagcacccccactgtaggcacagagtccacctgaaatgcatgagataggttaatgctgacctagggtactcagcagttaactctgattctctttactaactacctaacaggaggcagctggagtttcggggaatctggtgcaatgtattatatttgtccctattaattctgtgcttgagacaactgactgatagcgttacacgtacctctcaggtactggtcaggggtccaggttggaaacctcctctggatttctttgattctagtagtcagaacttcagttgtctgggaaacctgagactcactaatccaggatgtgggagcttgagagccagggtcctgcagggaaggaggcagagaagaagccacgtaagctgggtgggagggtgatccggcttactgggctcaatggcgcttgttcatttcctgtctcttgttctcctttcacctttgatggaaccaatgccaccgtcagtctcctgtgaggtaggttagatagggtggtcatagcctcccttatggggaacaaatttgccagacaggtggagagaacaaaccactgacagtgcacaaactacatggtcagaatatcctacagtgccagacacggtggcttatgcctgtgatcccagcactttgggaggccaaggtaggtggatcacttaagctcaggagttcgagacgagcctcagcaacatgggaaaacttcatctcaacaaaaaatacaaaaattagctgggcgtggtggtgtgtgcctgtaatcccagctacttgggaggctgaggtgggaggatcacctgagcctaagaggatcaattgagcctgggaggcagaggttgcagtgagccatgattgcaccactgcattccatcctgggtgacagagtgagaccctgtcttaaaaaaaaaaaaaaaatatttgcagtaaggagacaaagaacagaagggaaaattcccaaatccatgcaagcacagaaacccatgattagtgtccttgggctgacctatgctcattgtaagagtgaaaaaaaagcacactcctgggtggagaattaaaatgctgagacacgcgatgtatgtgctagcatgcacaacaatagcgcatgtgcatcccggagaccctgaaacatgcttaacagcaataaccatcccctctgtcttatgaataatcatataagctttccatgaagggattttcccaatgtcacatgaggctgtctcattctccacccagctaccagagtgtagttttgctttgcaataaacttcttcgcctacttttaatttggactcgtgcccaaattcttctgtgcggcaaagtcaagaacttgaactggccctccaacaacacctggagatcagacagtaaagccatttatacctgttagaatagctactgtcaaaaatgcaaaagacaggtgctataatttgaatgcttgtcccttgtgaaattcatgttgaaacttaatccccgatgtggcagtattgagaggtggggcttttaagaggtgattagattaatctatgaatagattaatagattagtgggttaatggttatcacaggagtgaggctggtggctttataagaagaggaagagagactaagccagcacactcagcctctcaccatgtgaggccctgagccaccctgggactctgcaaagagtccccaccagcaagaaggctctaccagatgtgtccccttgaccttggggtccccagcctccagaactgtaagtaataaattttatttttcataaattacccatatttaggtattctgtaataagtaacagaaaacagactaagacaactagggttggtgaggatgtagagaaactgaaatcattgtacattgttgatggcaatgcaaaatggtgcagctaccatggaaaactgtactgtggtttctcaaaaaattaaaattagaactaccatatggtctgggtgcagtggctcacacctgtaatcccagcactatgggaggccaaggcaggtgggctcaccaggcaggagtttgagacctgcctggccaaaatggtgaaaccccatctctactaaaaatacaaaaattagccaggtgtggtggtgggcgcctgtaatcccagctactcgggaggctgggacaggagaattgcttgaacccaggaggtggaggttgcagtgagctgagataatgccattatacttcagcctgggcaacaagagtgagactgtctcaaaaaataaaacaaattaaagtaaaaattaataccatatgatttagtaatcccctttctgggtattcatccaaaagaattggaatcaggatctcaaagagatatctgagctcccacattcattgcaaagctattcccaatagccaagaggtagaaacaacctaaatgtacctgacagatgaatgaataaagaaaatgtggtatacacatatcatggaagattattcaaccttaaaaagaaggaaatcctgcattatatgacaacatagatgaatcttgaggacattatgtaagtgaaataagccagtcacaggacaaatactgcatgatttcacttatatgaggtatctaaaatagttaagttcatagaagcaaagaatagaatgatggttgccaggggctgatggggagagggaaactgggagttgctaattaatgggtataaaattttagtcatgcaagacaagtaagttctagagatctgatgtatgacattgtgcctataattaacaacactgtattgtatgtttacacatctgtagccagcattatccttagcaaactaacacagaaacagaaaaccaaataccacatgttctcacttgtaagtgggagctagatgatgagaacacatggacacatacaggggaacaacacgcactggggcctattggagggtggagtgtgggaggagggagaggatcaggaaaaataactaaagggtacaggcttaatacctgggtgatgaaataatctgtacaacaaacccccatgacacacgtttacctgtggaacaaacctgcacataaacccctgaacttaaaggttggaaaaaaggctttctttttttttaatattaggtttgtgactgtaaatctcccttaaagcatttttaccatatctcatagtttctaatatctagtgtttctctatcatcctgttttagttatttttaagtttcactatgatttgtttctttaacctaagagttacttagtgttgtgtatgtgtgtgtgtgtgcatgtattttaaatttccatatgatcagagatatttttaatttttaaaattatcttctagcataattgtattattgtgatatctgaaatttttgaggatttctttaatagatgatatatgatcaacttttgtaaaatgttcctcatgtgcaggaaacaattgtgtatatcctaatggatacgtaaataattacatccccctcatttttctctcctgctctccctccctccccaattaacaatcaagcctcttaattgtgttcttattacatgtgttaattgttttacttatttttcttctatatctttgctggtttgtttattgtataacctgtaaataatcaagagagatgtgttgaaatttcccattatgatagcaggtttattattatagtaataataatttatgctgcatatattttgaggctattttactggcatctacttgttttaaattgctgtatgtcctggataaattcaatcttttttgttatgtcataattctctccataccaaatattttttcttctaaagtgtattttatttaatatatcatagttatcaacattattttgattattgtattcctgataggtcttctttttaccatacttttacttcaaacttttgcatattcaaatgctttaagtgtttctcacataaaccatgtaaatctggatttgggcttttaatctcgttcatacatctgtgtctttaaaccagtaggtttcctatatttatatttattgccattattaatatcgtgtagttgctactatcatcttaatttgttatttcaatgtgtctctctttttctacattcctttttactcttgtcttaactattattattattaatattgttagaggtagggtcccactctctcgcccagactggagtgcagtggcgtgatttcagctcactgcaacctccgcctcccaggctccagcgattctcctgcctcagcctcctgcgtagctgggattacaggcacctgccactactgcctgactgatttttgtatttttagtaaagacaggatttcaccttgttggccaggctggtttcaaactcctgacctcaaatgatccatccgcctcagcctcccaaagtgctgggattttaaagacgtgagccactgtgcccagcctattttgtaaccgaaactatgtctcaccctaaataaggcaaggactctctgatcctttgtctccccaccactgcttccagcacccatcatattgaccaaacctataccctgggttttacttaaaatgtggtccgggaaccagcaacatcagcaacaactgagaacttatttattagaattgcagaactttgggccccatttcagacctactgaatcagaattctcatgtaaacaagagctccaggtgttcatatgcacaataagcttcgagagtcagtaaactagacttaaaaaacaaaaatctgtggccgggtaaagtggctcacacctgtaatcccagcactttgggaggctgaggcaggcagaccacttgagtccaggagttcgagaccagcctgggcaacatgatgaaaccccatctctacaaaaaatacaaacattagccaggcatggtggtgcatgcttgtagtcccagctacttgggaggctgaggaggatcgtgtgagcccaggaggcagaggttgcagtgagctaagatcataccactatactccagcctgggtgacagagccagaccctgtcttaaaaaaaaaaaaaatctgttaagatgatagatctcatgttaatgttaagtggtgttcttgccaaagaaaaaagatagtcaagttacaaggtttgggctaaggaagggatgagcagacctttcactgctgcttcagcttaagggtgtaactcagttaatgactgagttagtgtaggtagcagtgtgatgccctccttcaatgctgccagtgcaaaccctccaaacagtccagaaagggatttttctgtctgaacttgtaattctttttccagatagtctgaacgtctaaagggacttctaacccttcttatacgcctttgattatcacttccatgtaggtttcatcatatttgggagaaatgtccaaatctagagaattctcttgtttgttgttgttgttgttgttgttgttgttgttttttgagatggagtctcgctctctcgcccaggctggagtgtagtggcatgatctcagctcactgcaacctctaccccccaggttcaagcaatcctctcacctcagcctcccaagtagctggaattacaggcatgcaccaccatggccagctaatttttgaattttagtagagatggggtttcaccatgttggctgggctggtctcgcactcctgacctcatgtaatccaccctcctcgtcctcccaaagtgctgggattataggcatgagccactgcgcctgacccaaatctagggaattcttatttcatcttcaaaggaaatggactcatcctttcctcaaaagccagattttacaaaggagacagaacagcgcagcagaaatgatgccagccctaacatcacaagatattcagtcccagttctgcctcttgcagctgccatgtgactttgtagcagcaactccttccttgtgattctatttcctcacttgtcaaggatggattacgtgtccctcacctcatcttatcagattattggatgggtctccaaatcgaagtaaaataaagtatttgaaagtactttaaaagtatcatacaaaaaagtcaagggaagcaaatttggagagatcattgagaaataaatttttctaaaatcttaaaaaaaagactgcaatactcacaggttcctcaacaacaaccacaaaagcagtgtgagatcaatggaaaaaatcaagcctcattctcacccttgccatcactgattccctggcgcagagttaattcaacagtggattagtgaccattccccagaagtctctatctggcaagtgacaccagacggaattcatgcaaaaataaaactcaatcttcagaactaagaattgtatagaaaaaggtaaaggaaaataaatttaacattttttgagaatccaacagatatcaggtacttttttgcattgtttcatggaatcttcataataatgctgtaagaatggcattttataggtagagaaactaaggcccagtgagattaaatgacttattcaaggccatgtggctacaaagtaactgaggaaagatttaatctgtgatctttctcttggaccacttaggtccagaaatccagaatagggtggcccggatgatattctggaaacacggcattatttactgtgaaaagaaattgtggctcaacatgaaacagaaatgttgctgctcatatctctcaggcagaactgtcactgtcacagctctagagaccttcattcatgctgtgttctgtgaagctttgccatcatccaaaaaacaaagcagtggtgccacatagcagaatggccacatgtgtcaacggatgaagagttacctgcaccatgctagtcctatcgcccatgttgaccagaattttgtcaccgggagacttcctggacaagacaccagcgatcacggcaggatccatgcagtacttttggccaatggtttgcatcatgggttgatatttcaggaggtatggcatgtctatttcagccagcctttcagaagcacgaactcctaaaccaaacgcaaaaggaatgatgcagcttgttgtgacttatgctgcaacaggagctcaaggggagagagaaagaacaatccaaggatctgagtaatggtcgaggactgacaatcccagattttggtcttaaatctttagtagtggccactccctgacctgaggttagggctctcctcctgtgagcttgagtcagcatcccctgagccagggtcccctgtggctgtcagtgcccttcgactgggctctcaggggctgctctggcccacccaggacaattccatggccataggaaccattggtcccattctaagcaccccaataaaatgaaatgtgcctgcctatcagctgcaacctgacatgaaggagaaattctgcaaacccttcaataagtctttagatagtgttcctcaacaagtttgttcacaattgcacagttttccactcctaaacgataccaacaaatcatgcaagtttaaacctttctgaaataataagaatgctgggcaaaaggaaagccaatattaatctacttagctagccttaccttctaggtgcttttatggtttaaaaagcaccctcggccgggcgcagtggctcacacctgtaatcccagcactttgggaggccaaagagggaggatcacctgaggtcaggagttcgagaccagcctgaccaacatggtgaaatcccatctctactaaaaatacaaaattagccaggcatggtggcacatgcctgtaacccagctactctggaggctgaggcaggagaatcgcttaaaccggggaggtggaggttgcagtgacctgagattgcaccattgcactccaacctgggcaacaagacagaaacttatctcaaaaaaaataaataaaaataaaaaataaaaagcacccttgtccacattgtgtcaatcagagctcacaacaacactgtaaataccgtactgctagccgccttgccacggatgcaggggcagctaagtgacttgttcaagaagcagagctttgggaccccatacccggaactctttccaacactcagtagcgtgaggcatgggaaacagtgaaagccgggggataggttgagagggcgaaagctcatagctaccacagtagttcaggccgtgacgtcttccaatcccacaagatgctccaggggtgtccaggctttggatgtttccatagcatccccagttgctgctttcagacaagtctacaagttgagaaaagttcagcctaaggcatggaactagttctcatcattcttctgtccatgaataaaattacattaataaaagtaacaataataaaatccattacatcaccttcactctgcaattgaaactcttgaaatttaaatgagaaatatcccataaatgatcacaaaaacttcctcaataccaaattctcacctgctcccctgcagacatgagtaactactggagctattgaagcagttacactctttgtaaagctctggtgccctttgatgttgtcaggtggtatcttggaacacaaaggagaggatttgttccctgtaaagtagtcctcatcttacttttttttttttttttttttttttgagatggagtctggctctgtcgcctagtctggagtgcagtggcacgatctcgactctctgcaacctctgccttctgggttcaagtgattctcctgcttcagcctcccaagtagctgggattacaggtgcatgccaccacgcccagctaatttttgtatttttagtagagacgaggtttcaccatgttggccaggctggtctcgaactcttgacctcaagtgatccgcccgcctcggcctcccaaagtgctgggatcacaggcgtgagccaccgcgcccagcctcttctttcatcttatatgaactctgagcacttctccgtcaaatactcctaacttgttgctctgatgaaatatttatgtttgctctggagaaacaagtataaaacctggatctctctgggatatcaacccagatccaaagtaaggcactgctcgtaaatgaggatttgaggctggctacactttctctcaggtacacttctagataagagcctaaggctgcagaagggagtgaaggagagaggcatgggaccagtctccacatgggatcacccactttccacttcttccctttatctctttctcctttccatctctctctacctctgtcattctagtcatcactgaaggggaggagtggtttcagacactcgggatttcacaaaggccattgaagaggagaatgttctttctcttcacaccaggaggagagtgcatgagtatttagatctacaattcacacaaggtgggtacacaagtatttataatatatctacaattcacaccagaatggggacacatgagtcagtactaagatacctacagtaggcaggaaattgctccttttgagaatcatctcaccattataaggctgtaagaatgtctcattagattactctttaattaattaattaattaattaatttatctatagacagggtctcactgtcacccaggctggagtgtagtggcatgatcatggctcaccacagcctcaacctcccaggttcaagctatcctgccacctcagcctctcaagtagctgggaccacaggcacaagccaacacacctgtgtaattttttgaagagatggggttttgccttgttgcccaggctggtctcaaactcctgagctcaagcaatttgcccgcctcgacctcccaaagttctgggattacaggcatgagccaccgcatacacctggtttactctgtttaatctatttgatcctttgactaaagtagattagattatcaaaccttaatgatttgcagatctttggagatatatctattgcctataatcatatgtgtcctgtgtgtttacataaatgcattttcaggttctactttcttagaactttatggggttgataaatactcgtcttttggagtaaatacttctactttacaaacttgtgataagtaacctaagaaaaatgtggaaatgaaaagactagatcttttatgaatatactaaaaattaaaccagctgacaggttcttttttattttttaatcagtgcacttttatctttatgactggtgacaaatacccttagtactgcagttggttttatcactccttggttcctgccttgtggacctctccctagccacactctatgatcctcaaaattctttgtattcccaatgcttagcaccttgtaggcatttttaaatatttgttgaatgaatgggtcaataactaaatgaatgactatgagacctcatctaagaaatctattaaatttagagtcaggaaaatttagcttctcctgaggaactttgcttcctccttttatttattaaaaaacaagtaggctgggcgcagtggatcaccctgtaatcccagcactttgggaggccagatcacgaggtcaagagtttgagaccaatctggccaacatggtgaaaccctgtctctactaaaaatacaaaaattagccgggtgtagtgacaggcgcctgtaatcccagctacttgggaggctgaggcaggagaatcgcttgaaaccggaaggcagatattccagtgagctgagattgcaccactgcactccagcctgggtgaaagagcaaaattccatctcaaaaaaaacaaaaacaaaagcaaaccaacaaaaacaagtactttccctttttcctccagctgcaaagctgaagttcaatcacagcaactaaatcagcctcagtgattagcttagtcatgtgtactcggttgccttgattctggttttctatttgaattagtcttattcattagtcttattctggcaaccacctcaattcttctatggaaataaatgctttaggaataaattcaatttggcattttttatagtggacaatgagcagctattgatggtgtatatttaaagtctggcttcaagcagtgctgttttaagcccaccttgcattccagagaaccccaatcttttgtgggacatttggggagaggctgattgttggtggctgttcctaactccaggatttgttggacagtttagggaaaaaataatcttttttgttgcattttcaagtattagaagtgccattgtgttcctgtgcttatccttcccatctccaaagtcatttgtaaaaatcagccacactcacccatcagggcaaggaggcccagcagcagccacaatgcagacatgatgacgatctggctctacggctcctgaaacacttttaaaacaaaaattagcttgagaatacaaaaatatcagtcatcatcataaccacatgtaatatttccacagaagcaggggtgaaaagaacaaatttccccatatctgacctaagaaaatgaattatttgaatcatagtgaaaaaaaagcaaaagtaggacaagtaagtgctccattcatcctttcaattaatctaaaaatgagaagactcttactcagcccacaggaactcaacatacagtcaagttactaactactttatttcaagaaggcaagacactttgaatctcaaccaccaagaaacatactgacctggctccagaccctgaaaagcaaatttctgatgcccatacctcatcccaagagcctttttattatctccattatcaaaaggagaattttgtattggtgacttcttggaatttaggtcccttcttcttcaggtttgaggaaagaccacgctttcctcagtgccctggaatgtacactggttggaagacgtttcccactgctctaaccccagcctggaatcacagaccccctttatcaccttgagccatgttccccattccccctctgtaaaaccccaatgcggcaacaaacctggaccagagcccagggagaatggagctacctccaccagcaaatccccaagaagctggctcatgggcaggggtcccaggattgaactcatgaggtgctcacaagactggagaatgaacacgtggccaacatggagcacccgctcatgtgctctctctctctcttatcccaaccattcccctaatcaccttccatgagtacaaacagccctggttctcctactggctaccaaaccaatacacaaataccaccaaggatagtttgctgttaacctcagggaatggtagagtttctggacctttgcctccaaagcgcctcccaccaagccctgccactccagggtgtatgtcatcattgccccagtcagcagagcctggcagcctagcattttgaattattactgtcattacatgtaggaatgtgcatataaacaaggcacttggtactttcataatgcttctctcatctcttttgttttgaggttaaccttatgggttgtttctttcaaacacccaggaagagatcacatctcaagatggagaggctttaaggaagtcatttgaagccaggtgtggtggcatacacctgtagtcctagctacttgggaggctgaggcaggaggactgcttgagcccagagggtcaagggtgcagtgagctatgatcacaccactgcactccatcctgggaaacagagcaagagcctgtctcaaaaaagaaaaaggaagttattcgatttctgtcttcttaaactgagggggcatatgcccttcagttgcagtcatgctttttgttattctctctacaacattgagatggtctgtccgattttgcttagttgagcacaaaatgtcatggtcagtcccaacaccaaaaagattcagggacctggaatcttagctgggtctgcaggaacgctcagatttaatcacccaacaggagtcatttattcagcatcctgagcctccagcagtaaacaagagaggacaaccaatcccaggagaaaagaatggacaaagagctgcttgggtataggaaaagctcatggtctcatgaaagtgcatcactggctttatggaaggacccttcaggaaaaagcactgctcacattcaaatgctccacccagggtatttcactctttttgctgcttttccaggaaagaaaaaatacttcctcttggaaacccaagtggaaggactcagcttttattgtaacaggagagctaccgtattttccatgcttggaactaaatatctgtgttgagaagtcactttaatgaaagagtctatgtaaatacatgtgccacttaatgggaacacagaattactttctagttgctcctgggaccaggtcatcaaggtaaagtttttcaatttcatcagggaagagcaagaagtgacaatggaatttttcttttttttcttagagccagagttttactctgtcacccaggctggagtgcaatggcacgatcacggctcactgcagccttgacctcctgggctcaagtgatactcccaccttagcctcccaagtagctggggctagaggtgtatgccaccatgcccagataattttttagtttttatgtagaaatgggtctcactatgttgcccaggctggtcttgaactccaggcttcaagtgatccttccacctcagcttcctgagtaggtagggttacaggctcaagccaccacacctagcttggaattcttaaatggatgaacaatgtcattttgtccataaatacagcatattgaagcaacccaaactctatggcccaactttacaagtgacgaaaagtactctgtgtttagaagagattgttgagacatcactcgggtgtgctcaaagagtgtctgtcagttccctatgactcatttgttaattcccctgtggctccctgcttaaaaccattatgaagatgtcagaccaaggcagcacagtggtcatgatgtcaagcacaatgtttatggtagcatccctcttctcccttcccagagagcaaaatagtaacaaacagcaagggggtgtcaacaagctggggcaacaggcctgccaggcacactggaaactgacaaccagagcatccctcaggagctacctcatgttcctggtggctttgatggggacatcttcctctactcaccctctctccactgagtactttggaattcccaaag

SEQ ID NO: 2 - DNA, 81761 bp, Homo sapiens
ggtgtgtttaacctaatcaatcagaatcttggtgccttgataaatatgtttctcacggttcaatgttcccatgggtttgtggcatcatattcaacctcagaaatatagatctgggcatggtggctcacacctgtactcccagcactttgggaggccaaggcaggcagatcacttgaggtcaggagttcaagatcagactgggcaacatggtgaaaccctgtctctactaaaaatacaaaaattagctgaatgtgatgacaggtgcctgtagtcccagctatttgggaggcagaggcatgagaattgcttgaacctgggaggcagaggttgcagtgagccgagatagtgccactgtactccagcctaggtgacagagcaagactctgtctaaaaaaaaaagaaattcagacaagagggtcaataatttctcagggagaattcaacccttctaaaagagtagaccctaaattccaggttcctgttgggatgttaaagtatttattttacactgtacctcattaagttctccctctttagtctgcagtcatgctcactgaactttttttttttgaaagttaaattctgtttgtcttgctcagtcagtctcctgctttgaagagttcttacttttggttacagttgtccccaaactgtcagtttgtcacttatactcacatctcatttattgctttctcacaccctctggttcagaaatttggggggccactggcagggggtgttgcttttattaagtcattttctatatttacaatgttaatttggtaaaatctgtctgaatgtagagccttgacttagcacaattgcaagaaactgccttctcaagatgagagtatagaatagaacttggaaagggcccttgcccaaaacatctccctatcactctgccaaggggtgacattccacaatcagaagtatagttatttaaataagttttttgagatctattgtacagcatggtggcaatagctaataataatgtaatatatatttcaaaattgctaagagagcagattttaaatgttcatagtatgaaagagtgataagtatataaggtgatggatatgttaattagcctgatttaatcattccataatatacatatgtcatcattccataatatacaatatacatatgtcacattgtaccacataagtagatacatttactatttgtcaattaaaaataaaataagttaaggctttgagtctttaaaatcccctaggaaggggcaactcttcagaaaagagcgaggtctgagccactaactatccgagatgctcaggccaacatttcagtctgatggggttggggaaggaagtgggagtgtggggtccttgcaaagcagcagcctagaggagcacagaggagatccaccagggaggaagccccatttgggtgtatgagggctagaggtgcagggcagatgggacctagaagggcacattctgctgacttaaggcagagtatgagttaggatcattttcgtgctataagataagcagtccctgaatctcttctcatggtttatagccagaattcactggctaactgagccagccttcaccactctgctgtcacagcccgaatccatttcctgtacctccccaatcatttcagagaattgcagtcagccacaagataatagctgcacacagcaatggcatttatacctacaataaactataagataagacttcctttacaagtccatactaggcttgttcctgacttgattttagggagaaactattgagtagttcaacataagtaagacgttagctgacatttttgttggtgtcctttatcagatagagaggtttttttctctttctggattgctaagaagttttctttttttttttttttttaaatcatggatgcatattagatatcgccaaatgctttttctgtattctgaattttaagtcaaccttaaattactggagtaaactccactcggtattgaataattatctttcttatatattgctagatttagcttgctaagattttgttaagaattctgatggatattggtctttgactttcttttctgtttttcttttcttgcaatttagccgcatcccactaatttgggtatattatgttttcattattatacaatttgtataataattgtataataaataatttcatttttatacaatttgaaatatttttggccaggcatggtggctcacgtctgtaatcccagcacaggaaacggaggtgggcgcatcacatgaggtcaggagttcaagaccagcctggccaacatggtgaagcctcatctctactaaaaaaacaaattacaaaaattagccaggcatgatggcgggtgcctgtaatcccagctactcgagaggctgaggtgggagaatcgcttgaacctggtaggcggaggttgcagttagccaagatcgcatccctgcactcctttctgggccacagagcaagactccatctccaaaaaaaaaaaaaaaaaaaaaaaagaagaagaagaagaaatattttctactttgctttgtgattccttctctgactcatgggttgtttcaaagtatgttgttttgttttcagatatttagggattttatagatattttaacatttttactctcttttttttttttttttcgggcagtgtctcactctgttgcccaggctggagtgcagtggcataatcctagctcgctgcaacctgaaattcctgggctcaagcaatcctcctgctttagcctcccaagaatctaaaactacaggcctaccaccaggccggctactgaaaaaaaattttttgtagagatggggtctcattatgttgctcaagctggtcttaaattcccagcctcaagcaatcctcccgcctcagcctcccaaagtgctgagattacagacatgagccaatgagcctggccatttgctcttaaatttaatactcttgtggttacagaacatctctggtaagattttaatctttgaaatttattgagacttgtttgatggcacagatttggtctatctgagggaactttccatgtattcatgcacagaatgcctatttttttgttatttacttgaatggctataaatgtcaattaggtcaacatgcttgacagtatcttacaggtcttctagatcagcactgtccaaaagaaatgtaatgtcagccacatatgtaattttaaattttctagtagccacaatcagtgacgaaaaaagaaacaggtgaaattaattgtaataatacgttttatttaagcccaaatatccaaatagcattttaacatgtaatcaacataaaattacttattttattttatttttttggaaacagaatctcgttctgtcacccaggctggagtgcagtggtgcgatcttggctcactgcaacctccgcctcctgggttcaagcaattctcgtgcctcagcctcccgagtagctggaattaaaggtgcgcaccaccatgcccagctaattttttgtatttttagtagagacagggtttcaccatgttgcccaggctggtctcgaactcctgagctcaggcagtccaccctccttggcctcccaaagtgctaggattacaggtgtgagccaccatgcccagcctgtaatcaacataaaattatgaataaaatattttacattattgttttcattttaactctttgaaaatcagtgtgaacttttcatctcccagcaaacctcactttagactaatcatgtttcaagagcacaatagccgcttgtggctctagtggctatcatatcaacagcagagttctagatcctcaccaatttttttccttttattttattccatcaagtgcttaaagagggatgttaaaatcttcaactatgattgtggatttgcctatttatccctttatttttgtcagttttgcctcatttatttggtacatatgcgatcaagtaggcttcatccctggaatgcaacgtcagttcaacagacacaaatcaataaatgggattcatcatgtaacagaactaaagacaaaaaccacatgattatctcaatagatgcagaaaatgctttcaataaaattacacatccattcatgataaaacaaaactctcaataaactaggtattggggaacatacctcaaaataataagagccatcaatggcaaacccacagccaacatcatactgactgggcaaaagccagaagcattccccttgaaaactgacacaagacaaggataccctctctcactactcctattcaacatggtattggaagttctggccagggtaattaggcaagagaaagaaataaagagcatctaaataaaaagagaggaagtcaaactatccctgtttgtagatgacatgatcctattttacaaagccccgtaatctcagcccaaaagcttcttaagccgattaacaacttcaccaaagtctcaggatacaaaatcaatgtgcaaaaatcactgcttgatcgtggtgaataggctttttgatgtgctgctggatttggtttgccagaattttgctgaggatttttgcatcaatgttcttcaaggatattggcctgaagttttcttattttgttgtatctctgccaggttttgtatcaaaatgatgttagcctcatagaattagttagggaggagtccctcctcctcagttacattcacatatggcacaggagaaccaagatatgctctagtggatcttctgagccccaggcatagttatccatgcctccattagtaaaaagaactcttgtcttcttgaatcttctctaaagggttactagaataagacctcgtctttgcctgctattccaacagcacaagagcccccaaataatcagatggcagccatagtttaggttcagtgagttactgggtcccttggtagatatgttctctactatcatcctccatgcctctgcccctagaagccagatccttcagaccaacccaacttagtgttacagagactggaaacaaaaatatctctagtggctcactgggagtgatgctgagagatgtcccaactatttccaatacttcatttctagaaccatatatactctacctattgaggacctaccataaaatggccgttggttccaagttgtggaaacaaacaacgaccccttgttcgagaagcaggaaaaaggtgcctttaaaagtatgaaaggtgtggtggctcatacctgtaatcccagcactttgggaggccaaggcgggtgggtcacttgaggtcaggagttcaagaccagcctggccaacatggtgaaaccccatctctactaaaaatacaacaattacctgggcatggtggcaagtgtctgtaattccagctactcgggaggctaaggcaggagaattgctggaacccaggaggcagaggttgcagtgagccgagatcacatcactgtactccagcctgaacgacacagctagactctatctcaaaataaataaatgaataaataaatagataaatttttaaaaatataataaataaataaatcttattggaatttgttggcttgaggtccctggaagcattttgggtctctggccagaaaccaaccaattcagcaattgtggtatgtctggtgccccagtgtcaggagaacagagagagtaaaagaacaatggggtttggttccattctcttagagctgcagctgcacaaaattaaaagggaattcccctactccagtggtttggcttttgctgctgccatcacccctgccaaagggttttttatggaccagagcatgagagaatggagaaaaagtagaacaaaaatatgtgggatttttatctgtggcatttttctatttggccccttaattcagaactagaaagttttcctcaatgtttttctgtctctactcagttctcacttctgggtttgagatgcttagagttcatgcaggggaatactagagggaaaaataagggtaaattcatcgccagtttggtggtattctcatatcaaattctgatgtttttccctgataatcctgctgatatttatttgttggagtttttaaacagctgcccatgcatttgtccagattttatagttgtatttagtgtaagagaaaagtagtcatgtgtttgctccatgttatccagaactagaacccttcccttaatatcataacttcaaaatatagaaagcaaagcttaccagaactaaaagggagaatggaaacttttaaaattatagttggaaaccttaataccctcctctcaacaagtgttagacaaacatttagtaaaaataaaagatggagatgatataattagttgaccatcctatttttacttacacagggcactacatccagcaaccacagaatgcacattcatttcaagtgcacacacaagataaaaagcaaattccaggctgagaaaagatagttacgaagtatgtatcagataaggaattcatatccagaatatataaagtaatcctaaaaagcaattgggaggctgaggtgggcggatcacctgaggtcaggagttcgagaccagccagaccaacatggagaaaccccacctctactaaaaatacaaaaatagccaagcatagtcacacatgcctctaatcccagctactcgggaggctgaggcaggagaatcgcttgaacctgggaggcggaggttgcggtgagctgagatcgcgccattgcactccagcctgggcaacaaaagcaaaaactccatctcaaaaaaaaaaaaaaaaagaaaaagaaaaagaaaccactaaaaattggtaagagattttaaaggcacaaagcaaaagaagatatccaaatggccaataactaaaactaagactaataactaaataaataaaactaataactaaaactaagactgacaatagcaactgttggagaagtatgaagtaactggaactcttcatactttgttagtaagagtgtaaactggtaagaccacatgggaaaactttttggtagtttatttgttaaaaatttttattcatttatttttaattaggtttttttttttttttgagacagagttgcactcttgttgcccaggctggagtacaatggcatgatctcggctcactgcaacctccacctcccaggttcaagcgattctcctgcctcagcctcccaagtcactgggattacaggcatgtgctaccacgctcggctaatttttgtattattagtagagacggggtttcaccatgttggccaggctggtctcgaactcctgacctcgtgatccgcctgcctcagcctcccaaattgctgagattacaggcatgagccaccaccacgctggccttttaaaaatttttttgagatggaccttgtcctgtcgcccaggctggagtgcagcggcatgatctcagctcactgcaacctccacctcccaggttcaagcaattctcctgcctcagcctcccgagtagctgggattacaggcgtgcaccaccatgtatgggtaatttttgtatttgtatttttagtagagacgggatttcaccatgttggccaggctggtctcgaactcctgacctcaggtgatctccccaccttggccttcaactaaagtgctgggaatacaggcatgagccactgttcccggcctggtagtttcttatgaaattaaacagacatctaccctatgacccaacaactctattcatgagaatttactcaagagaaataaaagcatgtatctacaaaaagacttgtaacaaaaacgttcatagtggctttatttttaaaaaccaaaaaatgtctgtcaacctaagggataaacaaattgtagtgtgttcatacgatggaatactactcaatcataaaatgaaccaaccactgatccatgcaacagcatgcatctcacaggcattatgttaaacaaaaaaagccaggccaaaacagtataaactgtatgactgtatttatataacaggcaaaactaatctatggtaatacatgttggaatattggttacctttgagtggagggccacattgcctgggaagcggcatgaggcaaccttctgtagttatggaaatgttttttatttcgttacagatattgtattttttagttctggaattgccacttgattgccatctctatttctatgttgagattttactaccttttcattcattagaagtttaatttcctttatttcttgagcatactaacatacttataatatttaaagtccttgcctgccatttctaacatctgggtcatcttggggttggtccctccttgttgatttctctcttgatcatgggtcacattttcctgcttcttatatgtcatatgtaagtaatttgggattgtagcttggacattgtgaaggttatattataaatactttggattatgttaaatttatctgaaagttattgatttgtttgttgtagcaaaaattgatctgggaaggaaggaaggaaggaaggaagggagagaaagagagagtgagaaagaaagaaagaaagagccaaactgaacttctagaatttaaaaattcactgcaggaatatcaaaatacagttggaagccttaagaacagactaaaccaagctgaggaaagaattttagaggtcaaagactggtcctttgaattaatccagtcatataaaaataaagaaaaaagaattttttaaaaatgaaccagacctccaagagataagggattaaaaaagaccaaacctacacttcattggcattcccgagagacagtaagcagcttagaaaatgtatttgaggatatagcctgtgaaaatttccccagtcttgctagagaggtcaacatgcaaattcaagaaatttggagaactcctgtgagatactacacaagatgaccattcccaagacacaaaatcattagactttccaagttcaatgtgaaagaaaaatcttaaagacagctagagataagggtgagatctcttacaaagggaaccccattgggttatcagcagacttttcagcagaaatcttacaagccagaagagatctggggcctgttttcagtatccctaaagaaaataaattccaataaagaatttagatatacaatcatgtcatctgcaaacagggacaatttgacttcctcttttcctaattgaataccctttatttccttctcctgcctgatggccctggccagaacttccaacactatgttgaataggagtggtgagagagggcatccctgtcttgtgcccgttttcaaagggaatacttccagtttttgcccattcagtatgatattggctgtgggattgtcatagatagctcttattattttgagatatgtcccatgaatacctaatttattgagagtttttagtatgaagggttcttgaattttgtcagaggccttttctgcatctattgagataatcatgtggtttttgtctttggttctgtttatatgctggattacatttattgatttgcgtatgttgaaccagccttgcatcccagggatgaagcccacttgatcatggtggataagcttttcgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttaggcaggattccctctttttctattgattggaatagtttcagaaggaatggtaccagctcctctttgtacctctggtagaattcggctgtgaatctatctggtcctgcactttttttggttggtaagctattgattattgcctcaatttcagagcctgttattggtctattcagagattcaacttcttcctggtttagtcttgggaggatgtatgtgtcgaggaatttatccatttcttctagattttctagtttatttgtgtagaggtgtttatagtattctctgatggtagtttgtatttctgtgggatcagtggtgatatcccctttatcattttgtattgcgtctatttgattcttctctcttttcttcgttattagtcttgctagtggtctatcaatttcgtttatcttttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctatacactgctttgaatgtgtcccagagattctggtatgttgtgtctttgttctcgttggtttcaaagaacatctttatttctgccttcatttcattatttaccctgtagtcactcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggagtaggtgtggtgctgaaaagaatgtatattctgttgatttggggtggagagttctgtagatgtctattaggtacgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatcccttcaccaaaccccatcgtctcagcccaaaatctcctcaagctgataagcagcttcagcaaagtctcaggatacaaaatcagtgtacaaaaatcacaagcattcttatacaccaataacagacaaacagagagtcaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagtgcctgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaacaagaaatggggaaacaattccctatttaataaatggtgctgggaaaactggctagccgtatgtagaaagctgaaactggatcccttccttacatcttacacaaaaattaattcaagatggattaaagacttaaatgtttgacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaatctacggaatgggagaaaatttttgcaatctacccatctgataaagggctaatatccaggatctacaatgaactcaaacaaatttgcaagaaaaaaaaaaaaaccccatcaaaaagtgggtgaaggatatgaacagacacttctccaaagaagacatttatgcagccaaaagacacacaaaaaaatgctcatcatcactggccatcagagaaatgcaaatcaaaaccacaatgagataccatctcacaccagtaagaatggcgatcattaaaaagtcaggcaacaacaggtgctggagaggatgtggagaaataggaacacttttacactgttggtgggactgtaaactagttcaaccattgtggaagtcagtgtggcgattcctcagggatctagaactagaaatgccatttgacccagccatcccattacggggtatatacccaaaggattataaatcatgctgctataaagacacatgcacacatatgtttatagcggcactattcacaatagcaaagacttggaaccaacctaaatgtccagcaacgatagactggattaagaaaatggcacatatacaccatggaatactatgcagccataaaaaatgatgagttcatgtcctttgtagggacatggatgaagctggaaaccatcattctcagcaaactatcgcaaggacaaaaaaccaaacactgcatgttctcgctcataggtgggaattgaacaatgagaacacctggacacaggaaggggaacatcacacaccggggactgttgtggggtggggggagtggggggggagggatagcattaggagatatacctaatgctaaatgacgagttaatgggtgcagcacaccaacatggcacatgtatacatatgtaactaacctgcacattgtgcacatgtaccctaaaacttaaagtatagtaataataaaataaaaaaatgaaaataaaaataaaatttaaaaaaagaagtaaaaacctcacagcagcttatgttaatttttcaaacaaaaaatcatttattcacaagttacacaaaatattttttttactgtttacctgacatctaaagtaaaagcagaataaaataaacttctcaccaatagttaaaaaaaaaaagaatattctgccgaactaaacttcatatatgaaggagaaatgaaatctttttcagataagcaaatgctaaagaaatttgttacttctagaccagccttacacgaggtccttaagggagttctaaacatggaaacaaaggaatgatacctgccagcacaaaaacacagttaagcccagaaacatacgtagcctagagatcctctaaagcaactacataattgaggctacaaagcaatcagctaagagcatcatgacaagatcaaacctcacatatcaatattaaccttttgttaattgtctaaaatgccccacttaaaaggcacagagtggcaagttggataagtaaacaaaacccaacagtctactgtcttcaagagactcatctcacatgtaacaacacccataggctcaaaataaaggaatggaaaaaggtctatcacacaaatggaaaactaaaaagagcaggagtctttatatattctgttatatcagatagaacagactttaaaccaacaacagtaagaaaggacaaagaaggaaattacataatgataaaggattcaattccacaagaagacctaactattctaaatatatttgcactcaacattggagcacctagattcattaaaaagtacttctagacctacaaaaagacttagagagccagacaataatagtagggtacttcaacacccccgctgatagcattaaacaaatcaccaaggcagaaaactagcaaagaaattctggacttaaaactacacttgaccaattggacctaacatcaatctagagaatactctgtccaaaatcacagaatacacatttttcttgtttgcacgcagaacatactcttaagaccaaccacatcagccataaagcaagcctcataaaattaaaaaagaatcaaaatctgtccaggtgcggtggcttacacctgtaatcccagcactttgggaggctgaggtgggtggatcacatgaggccaggagtttgagaacagtctggccaacatggcaaaaccccatctctactaaaaatacaaatattagccaggtgtggtggcacatgcctggagcccccgctacttgggaggctgaggcacaagaatcacttgaacccaggaggtggaggttgcagtgagccaagattgcaccactgcactccatccggggttatagagtcttcaaaaaaaaaaaagaatcaaaatcatatgaagcatactctcagaccacagtggaataaaaatgaaatcaataccaagaagatctcaaaagcacaccattacatggaaattaaataactgctcctgaatgacttttgggcagataatgaaattaaggcagaaataaaacaaattctttgaaattaatgaaaacagagatacaacataccaaaatctctaggatgcagcaaaagcagtttaagaggaaaaattgtagtgctaagtgcctacattaagaagttagaaagatctcaaattaataatctaacatcacacctagaggaactagagatacaagaacaaacaaaccccaaagctagcagaagaaatcactaaagccagagcagaatggaatgaaattgagaccaaaaatccataaaaaagatcaacaaaagcttgaaagcttgaaaccttgaaaggaaacgttggttccttgaaaggataaacatgactgatgaacttcaaaagtaaccttggttccttcaaaggataaacatgattgatgaaccactagctagattaacaaagagaaaaaaaagatccaaataagcacaattagaaatgacaaaggtgacattacaactgatcccacagaaatacaaaagatactcagagaccattatgaacaaatctatgcacatcaattagaacatctagaggaaatagataaattcctggaaacacacaacctcccaagattgaattggaaataaaatgaaaccctgaacagaccgataatgagttctgaaattgaattagtaataaaagaaaaaaaaacataacaaccaaaaaattccctggcccagatggattcacaatcaaattctaccagacatacaaatcctcaacaaactaggcattgaaggaacatacctcaaaatactaagagccatcactgatgaactcacagccaacatcatactgaataggcaaaagtgggaagcattccccttgagaactggatcaagacaagtgtgcccactctcaccactcctactcaacatagtaccagaagtcctagccagagcaatcaggcaagataaataaataaaaggcactcaaataggaaaagaagaggccaaactatctctcttcatggatgatataattctgtatctaggaaaccctaaactggaagacagctagaactcataaacaacttcattaaagtttcaagatacaaaatcaatgtacaaaagtcagtagcatttctatacaccaataacgttcaaactgagagccaaatcaggaatacaatcccaactataatagccacaaaaatattttaaaatctaggaatacacttagtaaaggaggtgaaagatctctacaaggagaaacacaaaacactgctgaaagaaatcatagatgatacaaacaaatggaaaaacatccatgcttttggattggaagaatcaatattgttaaagcagtctacagatttaacactattcctatcaaactaccaacatcatttttcacataattagggaaaaaaaaactattgtaacccaaatggaggctgaatagccaaagtaatcctaagccaaaagaacaaagccagaggcatcactttacctgatttcaaactatattacaaggctacagtaatcaaaacaacatggtactggtattaaaacagatacatagaccaatagaacagaacagagaacctagaaataaagccacacatctgcaatcatctgatctttgacaggtgacaaaaataagcaatggggaaaggactccctattcaataattggtgctgggataaatggctagcctatgcagaagaatgaaactggacccctacatttcaccatatacaaaaatgaactcaagatgaactaagaacttaaatgtaagacctcaaactatagaactcctataagaaaacctgggaaatacccttcttgatgatggctttgggaaagaatttatggttaagtcctcaaaagcaattacaacaaaaacaaaactcggcaaatgggacctaattaaactaaagagcttctgcacagcgaaagaaactattaacagagtaaacagacaacagaatgggagaaagtattcacaaactgtgcatctggcaaaggtctaatatccaggatctataaggaagttaagcaaaccaacaaataaaacacaaataaccccattaaaaagtgggcaaaggacatgaacagacacttctcaaaagaagatttacaagcaactaacaaacatatgaaaaaatgctcatcatcactaatcatcagagaaatgcaaatcaaaaccacagtaagataccatctcacactatggctatttaaaacttttaaaaataaatgctggcaaggctgtggagaaaagggaatgcttatacactgttggtgggaatgtaaattagctcagtcactagggaaagcagtttggagatttcacaaagaaccaaaaatagaactaccattcaacccagcagtcccattactggatatacacccaaaggaaaataaatcattctgccaaaaagacacatgcacccatatgttcatcacagcacttttcacaatagcaaaaacatggaatcaatctaggtgcccattaatggtggactggataagtaaaatgtggtgcatcatcaaaaagcttatccaccacgatcaagtcggcttcatacctgggatgcaaggctggttcaacatacgcaaatcaataaacataatccatcatataaacagaaccaacaacaaaagccacatgattatctcaatagatgcaggaaagaccttcgacaaaattcaacagcctttcatgctaaaaactctcaataaactaggtattgatggaacgtatctcaatataataagagctatttttgacaaacccacagacaatatcatactgaatggccaaaaactggaagcattccctttgaaaaccggcacaagacaaggatgccctgtctcactactcctattcaacgtcgtattggaagttctggccagggcaatcaggcaagagaaagaaataaaggtattcatataggaagagaggaagtcaaattgtctctgtttgcagatgacatgattgtatatttagaaaaccccatcatctcagcccaaaatctccttaagctgataagcaatttcagcagtctcgggatacaaaatcaatgtgcaaaaatcacaagcattcctatacacccataacagacaaacagagagccaaatcatgagtgaactcccattcacagttgctactaagagaatcaaatacctaggaatccaacttacaagggatgtgaaggacctcttcaaggagaactacaaacgactgctcaaggaaataagagaggacataaacaaatggaaaaacattccatactcatggataggaagaatcaatattgtgaaaatggccttagtgcccaaaatattttatagattcaatgctatccccatcaagctaccaatgactttcttcacagaattagaaaaaaacttctttacatttcatatggaaccaaaaaagagcccgcatagccaagacaatcctgggcaagaagaacaaagctggaggcatcatgttacctgacttcaaactttactacaagtctacagtaaccaaaacagcatggtactggtaccaaaacagagatatagaccaatggaacagaacggaggcctcagaaataacaccacacatctaccacaatctgatctctgacaaacctgacaaaaacaagaaatagggaaaggattccctgtttaataaatggtgttgggaaaactggctagctatatgcagaaaactgaaactggaccccttccttacaccttatacaaaaatcaactcaagatggatcaaagacttaaatgtaagacctaggaccataaaaaatcctagaagaaaacctaggcaataccattcaggacataggcatgggcaaagccttcatgactaaaacaccaaaagcaatggcaacaaaagccaaaattgacaaataggatctaattaaactaaagagcttctgaacagcaaaagaaactatcatcagagtggacaggcaacctacagaatgggagaaaacttttgcaatctatccatctgacaaagggctaatatccagaatctacaaagagcttaaacaaatttacaagaaaaaagcaaacaaccccatcaaaaaatgtgcaaaggaaatgaacagacacttctcaaaagaagacatttatgcagtcaacagacatatgaaaaaatgctcatcatcactggtcattagagaaatgcaaatcaaaaccacagtgagataccatctcatgccaattagaatggcagtcattaaaaagtcaggaaacaacagatgctggagaggttgtggaaaaataggaatgcttttacactgttggtgggagtataaattagttcaaccattgtggaagacagtgtggcgattcctcagggatctagaactagaaataccatttgacccagcaatcctattactaggcatatatacccaaaggattataaatcattctacgataaagacacatgcacacgtatgtttattgcggcactattcacaatagcaaagacttggaaccaacccaaatgtccatcaatgatagactagattaagaaaatgtggcatatagctgggcacggtggctcacacctgtaatcccagcatattgggaggctgaggtgggcagatcacgaggtcaggagatcaagaccatcctggctaacatggtgaaaccctgtctctactcaaaatacaaaaaattagccgggcgtggtggtgggtgcctgtagtcccagctatgttgggaggctgaggcaggagaatggcatgaacccgggaggcggagcttgcggtgagctgagatcgagccactgtactccagcctgggtgacagaatgagactccgtctcaaaaaaaaaaaaagaaagaaaatgtggcatatatacaccatggaatactatgcagccataaaaaagaatgagttcatgtcctttgtgggaacacgcatgaagctgaaaaccatcattctcagcaaactatcacaagatcagaaaaccaaacaccacatgttttcacttattaagtgggagttgaacaatgagaacacatggacacagggaggggaacatcacacaccggggcctgtagggggtggggggctaggggagggataacattaggaggaatacctaatgtaggtgatgggttgatgggtgcagcaaaccaccgtggcacgtgtatacctatgtaacaaaactgcacattctgcacatgtaacccataacttaaagtataatataaagaaaagaaagaaaatatggtgcatatacaccatggaatactatgcagctataaaaaaagaacaaaatcatgtcctttgctgcaacatggatgcagctggaggccataattctaagagaactgatgcagaaagagaaaaccaaatactgcatgttctcacttataagtaagagctaaatattgggtacacatggacataaagatgggaacaagagacagattataagtggggtgaagtagggaggagcgcaagggttgaaaaactacctattgggtactatgctcactacctagatgatgggttcaattgtactccaaacctcagcatcatgcaatgtacccttgtacaagtctgcacaagtacccactgaatctaaaataaaagttgaaaaaaaaaaaaacattaggttaattaagaagagaatggagaaaggcagagggcaggtcttagcatggtagaaaattttaaacagcaattaagaaataaggtgcttggccaggtgcagtggctcacgcctgtaatcccagcactttgggaggccgaggtgagcagatcacctgaggtcaggcgttcgagaccagcctggccaacatggtgaaaccccatctctactaaaaatacaaaaaaaaaaaaaaaagaaagaaaaagaaaacatctgggcgtggtggtggcacatgcctatagtcctggctacctgggaggctgaggcaggagaatcacttgaacctgggagatggaggttgaagtgaaccgagatcacgccattggactccagcctgggcaacaagagtgaaattctgtctcaaaaaaaaaaaaaaaaacaaaaaagaagaagaagaagaaagaaagaaggtatgtaaagcaaatattgacagaagcaaaaaaagaagaaaaagaaagaggagtcatgggacttgtcccagcagggtggaaagctttagatggttattaagaagtgggatgaataaaatggatattgatggattaaaacaaaggatttaacacagcactaccaaaggttgagcaggcccaagggaacccctgctggtccctcaacattaaagggttccaaataagcctgctctatttactccagtttggagaaatttaaaaagccaaaggcaaagtttatcatgagaaacctgaccagcaatcactgtgacagttgttagcaggttcatcaagatgaagattgacaaaagggtcacagtcccttggctctaccccttctcagtggagacccaaagccttatgcacatcagtaggtaaaatggtcagcggtgggggcagtgtggagaaaagattactgggactcaatacaggagcccccagcactgtggtaccaaaacccattgatgaagccctgaggcaggctgcagttagaatgagggaaccgtaaaaggtaagggtttataggatcatgaaaggtggaatgtttaaacagactttaggtaaagctgtgtgtcctttacctgaatgttttatgggaatggatattacatccggctggggaacacttttttgagatggagtctcgccttgttgcccaggctggagtgcagttgcacgatctcggctcattgcaacgtctgcttcccgggttcaaatgattctcctgcctcagcctccccagtagctgggattacaggtgtgcaccaccacgcccagctaatttttgtatttttagtagagacggggtttcaccatattggccaggctaatctcaaactattgacctcaggtgatccacccaccgcaacctcccaaagtgctgggattacaggcgtgagccacgaagtccggcctaacacttcttaatacctagtattgtaacaccaaaacctgttaattaagtcctaatggaggccgcagttagggatgtagtggttgatggaattaaagtctgtaggcgaattggtgtttttcagcaggcttcgtgagaagtgcttgcgtgcgtctcttacctgattgtattatgggaatggacattgtgtctgcgtggggaatgtttcccctacctagcattgtaaaacagaagcgcgcagcacttcaatcatcagtgtggagagcgttcttagaggtcaccggtgtggaagctgaggcttcctcaccttgcttcccctgcaccacactgcagaggccaacacctatttcttattaggtcacagttctctcagcaggtgaggcattaatggccaagaaaaagaaaggatgagaatacaatcatgaataagtctagcaagggaaatatttttaggtgtttttattattttttattttttattttttatttttttgctctggaaactgttagtccaaactgcaccattttgtaaccccccagccatttcgcagacctcggtcaaagtgaaacattccacaggggttcgggctgtgacaaacagcctgcccaaccgcttgactctcttattatattctgctggaagaaagtgtaaggaacctcacactgcactggaacaggcaccaaactgcctaatcatgggaacatgttatcaacattttcccaggcagcaggccatgccccctgttccagacccctcccacctagcctataattgccccagcctgtaagtggcgatggccattggcattaagctgcaggtcttatgctggacataaagccggcatttgctgtaaagccaccactctctctctttgtgtctttctttaaccctagccttcccttcaaaacccaacaaaaactatttataagacaatttttcttcatcctccagtaagaacctaattttttgtttgtttgttttggtttggttttggagttttttgtttgtttgagacaaggttttactttgttgtccaggctgaagtgaagtggtgcaatcatgactcactgcagcctcgatctccccgggctcaggtgattctcccccttcaacctcctaagtagctgggattgcaggcgtgtgctaccatgcttgggtaatttttgtattttttgtagagatagggttttgccatgttgcccagactgatcttgaactcctgggctcaagcaatcctcctgtgttggcctcccaaagtgctgtgattacaggcgtgagccaccatgcctggcctaagaacctagtttttggacaactatgaaagtgctgttttacataataggatgtagacatgtaataattcataacacctgaagggggcacaggcaaaaaatataaagaaaattgagaatgactggatatcatatctaatggtgccacatttgtgtctaacatctttgacattgttctcagcaaatccctgggaatcagctgttgagctagatggagatgggaagaggataaagactgagatagatggctgggcacagtggctcacgcctgtaatcccagcactttgggaggccaaggaggatggatcacctgaggtcaggagatcgagaacagcctgaccaacatggagaaaccctgtctctactaaaaatacaaaaaaaaaaaaattagccgggcgtggtggtgcatgcctgtaatcccagctacttgggatgctgaggcaggagaatcgcttgaacccgggaggcagaggttgtggtgagccaagtttgcgccattgcactccagcctaggcaacaagagcgaaattccatcaaaaaaaaaaaaagacttggatagttgtattatatctattaattctaacaggttgtggagaagcttggcatgaaaatcatgaggcataatgaagtttgtgtgttatttccagattgttcttaccatgttgttaagtcatagatgaaaacaagcaatgtttgaaggatagtcccaacctccaggtgtacctaatcctgatgaagccgatgctgttagcaccctcccatatccctgggccttttagaattttcagttgatttccaactgtcagtatttgtacctctgtacctgcagccccttttccttggaaatatgtgttgcttatttgcaaggcaaaccggagtagcaaagaattaacaccccccaaagccctacaggcagatccctcaaccaacggctctcaggagttgatgtataaatgccccagctccttgtaccttgggcagaataattctgtggtgtgggttttgcaccattcctagaagttttcttgcaaggttgagctcaggtgcccactgtggtagctggctcggtgacacgttttattggctgtcctactgtccctgtatcatccagccacctcatacgagcgttccaaaataaactacccacactggaaaccttgcctcaagttctgcttctggggaaccaaactaagacaacttgaatgtgaggtctcccatgggacatctcttgcatcctagtcataaagagaacactgggggaatacattcagggaacacgtgagcgtactatttcttgtttttcaaattacctgaaagtgatctcatctagatgtactttattgttgaagtagtgacattgaaggggctagtgattagatgaaattcatgcatgtgagggaaagcccaaaataaatcattcctgagcaaagtgaacatctgaagagcatcctggatggcccacatgcagggaggataataaaaatatttaacacctggtacagcatgggcctcaaccagtcatagaagctgctggcctacctgctaagggcctgccacacaaactgaccattggccctgcccagtgaaacaaggattcctggtgctgcctgggtcaaatattcaggctgggttgagaggtcagtgggcaaagaaggatttacttggctttctccaagagggctcagaggcaggtgtgtatgattttgattccttctcagaaacagaagtgatggactgaaacattcattgaacatctccaaagggagttaaaggcccagcagggccacagtgtcacacgtccactttacactccaacgtgttatcacttgtgtcctctcctgactatggaagtaaaggccacaaacagcacacagtttccttccagagagttgtctcttctccattgtaggtagtgtgagcaagaccaaggtagcaaaatagccaaagggtaggtttgtatgtgacccaagataaatagctccgaacctctcctggcactatgaaagtgacgcagaatgaagacataatcagaaacaggtgtttggagtacatatatgaggatactggtgagggtgctaattcatttgcttactatggatgctgtaaagtatggttaacccattcctgctacccagaccccagagttgcctggtgtctcttcatctccttgaccttcttagtttgttctgttagccttccagtaatttctttttaatgcttaaaatttctataagtggttacttttgcttgcaaccaaagaaccataattgatttgggtcctacatgcttatcttcagccatgttttgtgagggatggaccccgtgaaagaaagcgtgtggcagcaactgctgaaaataagaaaagccagtccctggatcttcacagacaaaagaaaacacaggaggttgctgtgggtttgaaggacttggtgtatctaacttgaatgacagcttcacctcagttggctctcagtttcccatgaagctagaattccatccctatttcttccattgtcccatggattggctggcttacgagtcaggaacttctcataagcaaagcctgagggctctgggcagatactggaaaaaagacaaaggctcgggtaaggcttacttaacttgttagcaattctggtagacagggagtaggtgggcattggaatcacaggctaaaatgaagcctggctggaatacctagggaccatttgccatgatattcacatttactgcaaagtaattatatatatgtctatgtccgtttcctaggaaccatattgtgaactggatggatttcttttatttttctttccttttttcaatgcttattttcattcagaaaattgggaaatgaattttctttcatgattttaatcatttctttgccagtgttgtatacaacacattcacgtaaaactctcaaaggcggccatctgagcactctgccaacctggcccacccacagagctttgcctagaagctttgtcttttatagaacttagctcgagcaatgatatcattgacgaagtcattgtctatgtccgatggggtggcaatcgcttcaattcctgacttaaaagctgagagaccacctgaaatgaaacacagagaattaggctcaaatattaactttcaacagaaataagcaatgagcattgccaagatgttagctttccaggcaaatcttccaaagcaggcagtcccaaatcctcctccctctccctccctttctgaaaggacgtgctatcccaagaatcactgggaaaattccagattgctttctttctctttttccaaagtctttggtttttcttgttgcaaaaatcagatttgcttttttatgtaatccaggcctggcagaactagactcccagtacatcctctgctgaaaatgcttgtaacattctctcatttattcaataattcactcatctattcactcactcatttattcattcaggaaatgttttcaagcacctactatgtgccaggagaggtgccacactgactgcaaggtacccaagacacacttatttctttgggtatgtgtacatatgcatgtgtgtgctattttaccctagaattttatctctagtagttatgtatgtgtttaacataattgtgctctgctctgatatccagagaggaagatgcctggtcctgatccctgccttcaaggaccttgaagtagagactagaaactgttctgattaaggccgttagagtgtggaggacataacattggccaataggaggcaaacctaataggaattgatgtggttgggtgtgaagagagaaggaaccagagagcctaagaaagcaatctggttttcaggctgggatgactggctatattatggtgcctccaagacatgtaaaatgcagaagaaagagcaaatttatagtgggaagttagtgagttaattccatctgggagatgctgaacttgagggggcctgtggtcagccaagcagagatttccacttggatatatagcacctgaagtcccgaaaatactcacagagtaacattgttcagacaatttggaaagttgttgacagtttcttataacaggaaaaaacctatgagaggtaggcaaacagatagatagatagatagatagatagatagatagatagatagatagataaatttttttttgagagatggggtctcactctgtctcccaggctggagtgcagtgatgtaatcaatgctcactgcagccttaacctcccaggcacaagcaatcctcctggcttagcctcctgagtagctgggactgtgtgtcaccatgcccagctttttttttttttttttttttttttgtagagacagggtctcactatgtttcaaggtatcactcaatagctcagtaagcaatgaataagaaccccaacattctgcagaagaggaaatggaggttgaggatggaggacctctcaaagtaactcagtggttcagggaatgcaaatgcagcctctagacagctcctcccagggccactgctgaccccgtggaaatgctcccagggagtctcgggtcacactggccttcagtggtctcattcattgctcatttaaacaaagtactcagaatacagcctacctttgaggtgctgagcaacactccacgtggggaattttttctggattgccttaattctctctgttagaatcccagtagcctgtgaaaggtgctctttgctatcccaggcaccgacagggtggtacgtttgtttatcaagctagaaaattcagataataaagtcagcatctggatgaggtaacacattttttctgccattcctaatttcctctcctggtattcaagtcatagataccggcctttatccccaaagagtcaattctattgttctttctttcatatagatgagagtcagagaaacaaagtaaggtttgggagaaatggacatggtatagttttagctaaacattctaatatacaaaaaaaaaatttaagttgttttgaaacaaataacacccaaagtctacacatttatagtaataaataattatccagctaattcagataaaaatttgtttctaactgggaaggccagaagtctgtatttctacagacaatttaaaatcgagcctggaagcaaatatccagataatttggatccccttcctccagtttacccaaaggaacaagttgtttcaagtagggcacagttataccatgttttgatccacatggatgaaatttactacttcatgaaccccaagaggacacctgtaacaataatgctatttataagattttctcagttttagtgtattacatattatttattgcagaatggtagttatgaaactcctaaaatactttttaaaatatatctaataatgaataagccttgaataaaataaaaagatgtgttacagaaatcccagatcaaattatgctggagtggccgggcacagtggctcaagcttgtaatcccagcactttgggagactgaggtgggtggatcacctgaggtcaggagttcaagaccagcctggccaacaaggtgaaatcccgtctctactaaaaatacaaaaaattagctgggcatggtggcgtgtgcctgtaatcccagctactcaggaggctgagggaggagaatcacttgaacccgggagtggaggttgcagtgagccgagatcacgccattgcactccagcctgggtaacaagaatgaaactccatctcaaaaaaaaaaaaaaaattatgctggagtacctgtagccagatgccagggtattttggggcttggaagcactgcaaatggatttctagttcaggttgagcttctgtgaggagggatgcagtggggctgatagaaagtttctagctaaatacctgcatcaagccaaatttaagtcccctgtggtcccagccgtcttgcaggacagatccgccatggctttccctggagatgatggctgcgatgacagcagggtccacgcaatgtctctgcccgacttctttgatcagagtctggtaaggttttatggccctcaaatccatctcagcaaacatttcagaaccacggatccctacgtcaatagaaaagaaactgtttttccgggcatggtagtgtgtgcctgaagtcagttcctgctacacaggaggctgaaacaggaggattgcttgaacccaggaggagttcgaaaccagcctgggcatcatagtgagagcccatctctaattaaaaaaaaaaaaaaaaagaatttaaagttaaaaaaagaaaagaaactgtttcttctacttcagaagaaaaccatttttaaaaatttgctaagttagccacagcctctgatcactgctaatgacttgggacaaccattctaagacatccttttgatctctgactgcagaaacaaacagatccacaacccccaacaggtgtcgcttctgctctgtttctccttcaaattgctcatgcctgtaatcccagcactttgggaggccgaggtggacagatcacttgaggtcaggagctcaagactagcctggccaacatggtgaaaccccatctctactaaaaatacaaaaattagctggacttggtggcaggcacctgtaaccccagctactcaggagactgaggcaggagaatcgcttgaacctgggaggtggagattgtagtgagccgagatcatgccatcgcactccagcctgggtgacaaagcaagactctgtcatacacacaaaaaaaattctgccacactagtgcactgggaagcctgttgtactaggagttagccaatgcatgttttagcctggctccgccactagttggttctgttctattgggaagtattcccctccttgctgagtctttgggctctgatttgtaaatttgaggggttggggtctgatgtgaccttgtggttgctgccagctccgacactctaaaaccaggataacgtgatgaagacgactttggaacagtattgcttcaaatggtcatgtgtaacatgaagcaaacacagcagcaccacccaaaaaacaaagccagagtctaatatttattcaagcagtagtttcaatacatggaaataaacacagctggacaaagtttggaaagaatgggggtggaaaatgaaaagaagctggttgttagattggtcaggattgtggtttttgctcatttttaattttgatactattgtcataatgatgattataccttttcaaaattaagtgacttcctaagaaagaatctgaaaacgatgaaagggggaagccagtcatttgctctgcttttcacttaccgcagttcatcacactgtttgcatcacaagtggccccagaggtcttcatggtcatgatgtccccatagcagccgtggtacaggcgtggatgtaggtgaggcttcattgagtgactgaaggggtatgagcccctggaagtgcctaggaggcagaagtgtaactcacatgaatcctctgagaagatattacttgggttgctgcaataaacatcactaaaccaaaggcagaaggccacagacagaactccccaactctcttgttgccattatttgttcctcagacagaagttccccatgcccactctgctccgatcttttgttttgttttgtattaacacaggacgtaatctgaaaactctatgcaaaatattatgaaattcatctcttatagatcctaaatacatgtgcagtctttttttttcctttttttaagagacaaggtcttgctctgttgtccaggctggagtgcagtggcatgatcatagctcgctgcaggcaccaacacctgggctcaaactatcctcccaccccagcctcctgagtagctggaaccacaggtgcatatcaccaggactggcttattttctctttttgtagagatggggttttgctatgttgcccaagctagtctcaaactcctgtgctcaagcgatcctctctccttggcctcccaaagtgctgggattacaggcactgtagtcataccatgctctatgtcagaattaaaactgacaggtttttaagcaggaaacttgagagttttttttttttttttaagattcagggggtacatgtgcaggtttgttacgtgggcatattgtgtgatgctgaggattggccttctattgatccttcacccaaatagtgaacacagtacctgatgtgtagttttcaacccttgcctccctaccttcctccctccctccttccttttacagtccccagtgtctattgttttgagaggaattttaaaacatttctgacacaaatgcctctggagatgtgaacatctagattaacaatttgcctttcttaagccaaaattgacaaatggggtctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagaaaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacgtatgtttattgcggcactattcacaatagcaaaaacttggaaccaacccaaatgtccaacaatgatagactggattaagaaaatgtggcacatatacaccatggaatactatgcagccataaaaaatgatgacttcatgtcctttgtagggacatggatgaaattggaaatcatcattctcagtaaactatcaccaaggacaaaaaaccaaacaccacatgttctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaaataaataaataaaattcaaaaaaaaccaatttgcctttgtttagaaagataagaaagaagggcaccataacaatttaaatatattcttattatatatcatttactgtgaagttgagttcctatgtatatttaataaaattagaagtaaaaattgaatttgccaaaataatttaagtcaaatctattcttgtctttttgttctgtcattaaaaagtgaatttctgtccaagtctacctgttacaggagaggcagagcttttgctaaaggagatacaaagttattttctgtaatgttgaaaagtttgttctaacggtttcaaggactgttaacttgtaccttaagagtccaaatatttgttataagacagtacttagggctggatgttgtggcttatgcctagaatcccagcactttgagaggctgaggcaggacgattgcttgagcgtaggagtttgagaccagcctatgcaacatggcaaaactcatttctacaaaaaatacaaaaattagcctggtgtagtggcacatgcctgtagtcccagttgcatgggagactgagacaggaagattgattgaacccgggaggtcgaggctgcagtgagctttgatggtgccactgcactccagcctgggcaacagaacaagaccctgtctcaaatctcaaaaaaaaaaaaaaggattttgttaaaatgtttgatgtaaaaaaaatagaatctggttgggcgtggtggctcacacctgtaatcccagcactttgggaggccaaggcaggcggatcacctgaggtcgggagttcaagaccagtctgaccaacacggagaaacccatctctactaaaaatacaaaattagccaggcatggtggtgcatgcctgtaatcccagctactcgggaggctgaggcagaagaatcgcttgaacccaggaggaggaggatgcagtgagccgagatcgcgccattgcactccagcctgggcaaaaagagcgaaactctgtctcaaaaaaaaaaaaaaaaaaaaaaaagaatctaaccacttctcccacctctgcttctgccatagtcccagccagcatcattgctcatctggactctcctaacagccttctaactgacctccctgattcactcttgcagcccatcctctacttagtagacggagtggccctgtgggaatatgcatgggctgctatcagtcttctctcttaaccttccagtggctttctcctcctttaggggaatagccaagtccatcctgcagcctccaagacctactagatgtggccctctgctcctgttcctacttctctttccctttgttcactctcctccagccacattcttctttgtgcttatccttcaacatgccaggcaggtttctgcctcaaagcctgtatgtttgtggtcccttttgcctagaatgctattcctcctggtatctacatgatcatgccttcaggtctctgtccaaatatcaccttatcagcagaatatatagcgagtttatagacaaaaaaagaaaatagtccttaaacatataaaagacgttaaaccacactcaaaagaagagaaaggccacattaaaacatcattataacagcattttccaactctttttttttttttttttttgagacagagtcttgctctgtcgcccaggctgcagtacagtggtgcgatcatggctcactgcaagctccgcctcctgggttcatgccattctcctgcctcagcctccccagcagctgggactacaggcgcctgccatcacacccggctaattttttgtatttttagtagaggcggggtttcagcatgttagccaggatggtctcgatctgctgaccttgtgatccgcccaccttggcctcccaaagtgctgggattacaggcgtgagccaccacgcctggctgcattttccaactctttagttggcaagagcccaaaggtttggcaataccctctgtgggagaggttgtgaggaaataggctgtcacacacattgctgtggaacacagttttgtgataggctgttcattccagcactgttgataagagcaaaggactgcaaacaacacaaatgtcattaatttagggactggttgagtaagtgatgctacgtccacagtggagcactatgcagctgcaaaaggaaagaataagacctgtatatactcctgtaaaattctctccagggacaaaatagtatttatagaattgtactctttgtgtaagaaaggtaagaaaatacaatcgtatattttgtgtgatttgctcatattttcaaaagaaacaatacaaggatgaatgaaaaactgataaaaattgttagttatggagagagtaagaggaaggtaaagggaacagggataggggatagactaactatcttttttaaagtttttattttggaaccatgtaaatgttatcataaattttaaaattaaatcaaatggggaaaaatggaatcataaaaaagaagaacaaatgaacataactctataacaaattgaaagattaataaacacatagaggagaattatcttaagtgactttaaaatatatccatataagtctataccactacataggaatccatcctgtgaacataaataatcacaagaaaatcttaaattatatttactgtctcattgttggttggtaatactgtcatacttattttgacactattgtatgtaaataagtaataatgctaatgtcattagaactaggatttttagtgtaagatagcagaggtacaaatataaaactgatgtaaaatgcttgcattcttaaatataaatgtgaaatatctgaatgcatagttgttttccttttaaaaatatatattttctagttcctgccactgaaaacacctgaaataaacgacagctccatagcaatggagcacttttacttcccacactgtggtctctaaataccatttcctgctaagtggaaccagcgctcctcagaataatggctgattgcctgcctggggcaggaaatgttcaagatgaaccaggaacatctttttgtgccagagctggtccttatatgttagagacacattaaaaaaaaaaatttttttttccagatggagtctcactctgtcgcccaggctggagtgcagtggccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctcactgcaagctccgcctcccaagttcatgccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctccctcccttcctctcactctttccctctctcttccctttttcctctcactctcttactgttcgttcctctcactagaagataaatttcattaggtcagatactagatgtttttctctgctatatcctcctcagcacctggaacaatgcttggcacaaagtagacatttaataaacatttgctgaatggaagaatggatagttggatggatgaaggaatgagacagaaagggattgtttaaattatctggatcaagtgtccttatattgacaggttcagtatcctttcactgggaggcagtctttgccaggctcactgtgtggcccacagaccacaggcatcaaagttacccaggaagcttattaaaaatgcttatcactgggccgggcgtggtggctcacacctataatcccagcactttgggaggccaaggcggacggatcacgaggtcaggagatcaagaccatcctgggtaacacagtgaaaccctgtctctactaaaaatacaaaaaaattagctgggcatgatggtgggcgcctgtagtcccagctacttgggaggctgaggcagaagaatggtatgaacccaggaggcagagcttgcagtgagctgagatcgcaccactgcactctccagcctgggcgacagagcaagactctgtctcaaaaaaaaaaaaaaaaaaaaaggcttatcactgggcttttcacaccagatctactgcaccaaaatcttgcagtataaggcgaaagaagctgccttttacccagcattcccagttgactcttacacatgtttatgaaccactgctttaagggaactggaatatgaccatggaccctacgctgcctgtgtaggccttataaacacacaagccctttttaaattaagagtcacctttcagctatacacagctaatatggtagctcataattaatctactggctatttaactctgctctcacctggcaatctaaaaagagtaaaaatttaaaactatgttgccctgttttgaccataagtaactggaaattactttcgggtagccttgtttttccaaatttagaattaaacattttagaaacactttcctttcagtcaccattctataattaaagacaacttgaacattgctcataatggcttttcattttgcttaggtcagagttttcacattctcttattcaagatcccttaccaacttaccaacctatctttccagccttccccccagaaaccccctcgtctgtccagaccacactgacccaaagacttttcattcatttctgcctctgcttttttactgaaatctttcttcccatccagcaggctcttcctttttcttattaaatcaccaagcatccttcaattgacatgtcccccccaaaagcctttcacatctgagcattctagttggatgtgagctcttcctcccaaacctttcccagactagtgcttttttcccacctatacacattgaactctcatccactgcttggcattgataattgtctcttcatgtgttttgcttccaaggcactgttccatatacctctcggtaaggtatccagcctgataggtgcattgtcagacaggaagtaagcagatcaataaatattagattatttgaaattcccatagatcctgtttttcacctgcttagcaagcagaacacactgttaattatagaaataatagttgattaatggccaagctggtcagaatgagagcccactcttccattacaggtaatcattgctctttctgattcatgattgtgctggaggtttttgtggacaccctgtgaacaatgctaaatctcagccagtgacttaccaatgagggcaattagtccccaaaacaccacggaggataacatggcggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttacaaagcgacggcctttgtcctgtaacataggcttaacaattggagaatccattagtcagtagatcactgcgcacctggcttcaacagagtagacatcagcgtggctctactgctgtggaggaaacttttaaacaccagcatgaagactcacctggcttttcttaccttcgtcctgtaccaatgatcattagaggagctttatatatggtttaaaaccctctctttaaaccattgacctcattaggcctggttataatagtacttaggacttaggtgacccaattaataagaggatttcaaagggcttattaaccactattaattaattaacctaatgaacccccaagttgctcaggaggcatattttgatagattgtttctagatatctaaaattgtgccaaacagcttctaaatttgcgaataagaaacagataattcactttaaaaggataacaggaaatactagcaatttttattcttggattggttatttacctgaaatattgggtctcctgctttttgttcccattccaatgtcatatgatccccgtaccagtatgtcacatgatctcaaaccactatgtcacatgatcatgataggtgaacttggctccttactccaatcccacttctgagaaaaaggtgcaagtgtggccacctgctctaggagatcaatgcaaaaccagggagtagcaacgtgagtgctcatttgcccatacttgctaaggatatgggaaaaaagattatagccagggatgaaaacttcttcaagaagagagtatctttcttcaggcttatgtccaaaggaagagaggaagcatattgtgcagccccaggaacaggaaatggaagggacgttcttgaaacaggcaaagcacattgcgctgaggggaggaagaagtctggtctgggtccttccacaagcgtgtccagtttctcagactgcacacagtcctcccccacatccactgagtgaagaaaggtggaaggcagctgtacagggaacaggaagacaaaaccacaggcaacttcccagctccctggcaataaaaccacctccactcccaggagaacatgccctccccaagctgaggtctgcacagtccactggcattcacttctgccctgcctgccttcctgcttgtagaacagacgtctctggcatggcctctagccttccatccctggaagagtggcagggctgttctgagccaatggatgattcctacctgactctcaggaaagtgacccatggagggtctgctccaccaccatcaacactgcagtcaggaccactcttgaataagggatattgcaggagtctaactgccctgaggcaggccttagaaacccatagtctatgacccagcgacattgtgcccgtgacccacttcactgcagggtgagtagagccacttacctgaggcttccaggctaagtgcaatgagaaagctcaagaaagggagattaagaagttacgaatgataagttaggtaaaagagagtaggtggaggctggggctctccctacatgcactggaagaagacattgttaataaaacatttaaagcactgttgaatgtgaagaatacttatccttctgctctcagttagtggggctacgagtccttctaggtatgaggtccttaatgtccaggcttctgcaactcaaccaaaattgttttcaaactgatgtggattgttctgttcactcaagctgtgagagaacaattgaacatttatttgacacccaacattagtcaggttcctatggatattatatgactcaatcctccactggccctgtgaggcaggtattatcccttattttagagatgaggaaactgtgactcagagaagctaagtaacttgtcaaagatggcacagttagcatgtgacagagccaggatttgaatctaggcctgtaagattccaaaatccatgctcttccactgtatcgaagtgccagcacgatggacaaatgcctctgcagagcaatcattgcaacaggtccaaatcaatctggatacaaagcattgtccgtggtctggaaaaataacaccactcacagatttttataccactatctgtcaaatgtttgtaggtgctgttgtaatttctaaaatgcaaattaatataagttaactaagtccaaagtggttttttgtcactttatattttctccaccagtaataataatgtagttaatacgcactgaccttgtatggtatgactggtagaataataggaaggggcataacctaagtttgttacattctgaagcctaactcttaactgcagtaccctactgacccagtggatggttaagtgtgggtactattgtataatgaccttagaaatttcttgtcactaagaagaaatgtactgaataattctccatctcttcccagggataccaagaatgactacatgtaagttgtactgttatttccaggaggggcttgaagggaacttggcacctgtcataatctctatcagtccccaaaataaaaacacaatctatatgcaagcaatttctgtgctatacaaataaaactctatggcctggtcccctacccctcaaatcagttgcctgctcctaagactcttcagtgcagcaattctctggcagcttctggggagtcctaacagatttggggttcctggcttcagtggtggagactccaatcatccctaacgactaaatggcctcagcaattggaaaacttcaatgggaaagtttaagcagtactgtcctagttaggaggagaggaatgattatgaaaactgaggtactctgtatagccagggaagtagattctggtaggagttcctggcaagacttctcaattcataccacacaaagacctgcccttgtgccctgagctaccctaggttagcacttttgggagttaaaggaatccagcacctcaggctcccttggtcccctcgccctctgcgtccccacctgcctccctcccaacactagtctgtgctaatagagactgggttgtctccgccatgtcattatttgtgaatcccaggcacagctttcccttctcaggaacaacagccaaggaggatgaccatagccaactcatttaacctccctgagccttaattttcctcatctgtaaaatggagatgataataatgccccatgactttgttttgaagacaaaaataaattttatatgtaaaaacatgttataaactacagtgcttcatagagatgccagttactatcatgatgggtttgcactcaagtcctgatggcttagcttcttgttgatttattcatttgtttgtttatccatgcactcaggaaaaataaacagctgaattataggacaggaagtaggaggtgaagtctctctccagccatgaagaaaacttggcaggacaagcaagagctattcattgtcaggactctgtagcctgcctggtaggagtggaggaaggataagttcagaaacagccacacaagcagctgcagcccaagcatctgtttcacagctctgaaacctataaaatgggggagctgcccaagaatatgtggcaaaggtactttggcgccaatggctggtaagaaggcagaaggggagcccttccataaaatttcactaaaacattcaacttaaccccaggatatatcaatgtcaagctttaactgctgtgtgcttttcttgtcttggttttaatctactatatgataggtaaaatgcagggtatgccctgttgaagaagccacttatatggttgcattattggtcttccaatgtcaaacatttgaccaacatttcaggaaagaagatatacaaatggccaataaagctcatgaaaaattggtaaacatctttacacatcagggaaatgcaaaataaaaccaaaatgagacagtatttcacactctctaaaaaggctaaaaccaaagactagctatatcacatattggtgagaatatgaaacaaaacagaactctcatacattgctggttggagtataaaatggtatgattgctttgtagtactgttcagcagtttctaacaaagtaaataactatatgcctcaggaattttatttctagttatttacccaagagcaatgaaaaaaaaaaaaatgtctcccaaaagacttgtatgagaatcttcacagattgtaagttctgcaaagagaaaagaaaaaaaaagaatttttacagtgctttattcataatagctcaaaactggaaacactccaaaaaattcatcaacagaagaatggactaacagttgtagtataacgatataatggaaaaatacacaagttaaaaaaaaaatccaggaaaaaattccaatgaacctgggctgggtcaggtgcccacctctggatcattcaaccatgtctaggaatatatttgtttgaaaaagggactccctgtggtttggaaaggagaagggagaagtctgaaacaaaattttaaagtaacgttttcattttgaaatagtttaaatttcacaagaagcttcaaaaatagtaccaagagttctcatgtacccttcacccagcttcccccaatggcaatgtcttacataactatagtacatgtcaaatccagaacattaccattagtattatacaatactgtaaacttaggtacagaccttatttggatttccccagtttgtttttacacgctcttttaaaaaaaatatttatttatatttcagaagcgtatagtactgtgaacgtttatcccacaggtagatgcaagtaaccatcaccataatcaggatacagaactgacccatcaccataaaaagactgcctcatgatatcccctaactatgtctttcattgtgccaaaagtaaacttttttttttttttttttttgatggagactcactgttgtcagcctgggctggagggcagtggcatgatctcggatcactgcaacttccaccttccaggttccagcaattctcctgcctcaacctcctgagtagctgagattacaggtgcccaccaccacacctggctaatttttgtattttttagtagagatggggtttcaccatgttggccaggctggtctcaaactcctggcctcaggtgatccatctgcctcagcctgccaaagtgctgggactacaggcatgagccaccgtgcccggccaagtaagctattttttaaaaacagcttgatttgaggtataattcacatatcatagccttcactcatttaaagtgtgcaattcaatggtttttagtatgttgataagagttttgcaaccatcagcataatcaattttagagtattttcattatccatggaagaatctccacaaccattagcagtcattcccagtttctctcccctccctcttctctcctgttcaccctctgaccccaggcagtcacttacctagaagtctggatgattttgtaaaaaactgctctatagttgttcactatacctgtgatggagagaagagctggagcagtatctggagaaggacttgtgtcaaagacagtccttttgtcatggtttaacctgggagtgacttgaatataatcaaatgctgtagaaaatgaggatacaaaaaacaataggattatttggtcaggtaatgatgttgaagacgctagttcaaaagcttaagcatagaaattggcctgaggcaggaatgggactgcctcttccattgtaacagaaagaaaagagaaaaaaatcagatagcaatgcagttcagtgtatagagttgataggagaaaactgagggagttatctaatgatttttaagtcctttgtgaaacaggaggtcaaatcatgtgctgagagtaaaaactacgtggacttagaaaacggagagcatgtggaaaagctacccggtagaattggagagacagctgaaagagagccaaaaagatgagtggggtttacatatggactagttgagattggagtccataaatgttcatttggaggtattgaaatgctggggtctgacacggcaacctaagtacagacaaggagaaaacagagggctggagtggtccagggctgaggtgcagctctgcgggggccatgcaaggaggatacagggacaagtgagatggagtttggcaaaggaatggcttaagtaatggcaagtggattggaaatgaagggaagaaagtaaggggctatcatggggccagtgggaagatttaagcttaaggttttggaggtggagtgtatcggccatccttttctcccagcttacttctcttaccttacctctaactccacccgcagttacaacaaacagtagcatacaagcttcagcctgctttgctcaggccctttcccaagtgcttgctcactccctcgtgcctgcttcctgcagtcttgatttctaggagaactggaatcccctgtggacctctccaactcattctccttagtaacctgaccaaaatcaagggcagaaggatgagggggtggatggtgagaggaataaatcaggcatgcaggggcttgggctatcgcatatccccacagacagtggaggagcaggcaggtgtgggtgattctgggctgtgtgtgcaaagattctggtgaccttttatcaggccagaggccctcacagtgcaaagagaggaagcaggggttaggagcctcagctggaggcttcttaataataagttttcttgtttaacaacagaaggatgttcatactgttaagctctttactttacttaagcaggttattaaatggtattaatgaatgtttccaattttgttttaagtgtgtgtatatgcaggcatggaaattaagctgaattgcatcttcaactataccagatgttacaaaattcttcttcaaagcagctgtaccacatttacccctctaaagcaggatgtaagtgtttccatgctccatatctccaccgaggtttgctataattagacttaaattgggtgagaaaagtcagtttcctgactgaggttgggcatcttttcatatatgctcattggcagtgtcagttttacctgctctgaactgcccgtttgtattctttgatcacttttcactgggttgtttgcctttttcacattttatttatttggctttaaaaattttttatatcacaagatatcatcaactttttctcattttttaaaatagaagtcctcatatactatagtctgggtcctagtctttttttttttttttttttgagatggagtcttgctctgttgcccaggctggagtgcagtggcacgatctcggctcactgcaagctccgcctcccaggttcacgccattctcctgcctcagcctcccaagtagctgggactacaggcgcctgccaccacacccagctaatattttgtatttttagtagagatggggtttcactgtgttagccaggatggtcttgatctcctgacctcatgatctgtccaccttggcatcccaaaagtactgggactacaagcgtgagccaccatgcccagccctagtcctttgataatcatatgccaaaaaaaaaaaaaaaaaaaaggaagaagaagaaaaaaaaaaaagaaagaaattttacaaaaaattacataattaaaagggatataatcagtaccttgcagtaattttcaagtgttctacaaggaacttgtattaattttcagaaagacatgctatattaaaactctttagccatgtctgatcccacagatgattgctgtggagggctaccccttagatggccttcgaccccaggttttatgagaactgcaagggcgtcttctagagttctggccctgtggtgactgggatggtgagtgtcttagtctgctatttttgctgctataacagcataccacagactgggtaatttatgataaacaaaaatgtattgggcccatggttctggaggccaggaaatccaagagcatggtgctggcatctgacaagggtcatccatggtggaatggcagaaggtggaggtgaacacacaagatggagagcaaatggggctgagctgatcctgcagaaataaagcccccctgagagaacagcattattccattcatgagggcgaagcctcatgacctcattatctttttttttttttttttttttgagacagggtctccctctgttgtccacgctggagcgcagtggtgcaattacagctcattgcagcctcaacctctctaggctcaggtgaacctcttacctcgactctcgaatagctgggactacaggtgtgtgccaccactccccactaatttgtatgtgttttttttttagagacaggatcttaccatgttgcccaggctgatctcaaactcctgtgctcaagtgatcctcttgcctcagcctcccaaagtcctgggattacaggcgtgagccactgcaccctggcacctatcatctattaaagtttccatcttccaataccagtacatatgataattaaatttcaacatgagttttgatgaggacgtttgaaccaatttttcacacttctcagggttaaattcaggggtgaagggatatgcaatgaatttcagttccagatgtgtacagcaatagagaggcataggaaattgttggcctccctgaggcctcacccaggacaagcaatggagagaggatggctcaggaatcaccattgtcagcagttactcccaagatttgacccaggctcagtgggttttcctgaggctggaacaggagtgagaatgtctcagccatgttccccagctcctcctggctcctgacaatcctggggccagagaattgactattcaagacaaatgggttaatggcccagcgggtcatgacacacaggtaacaacagagagcaacctgtactgcatttccttgaaaagagtcaattaaagaaggtgctgaccctggcagagtgagtggctcagccaaaacatcattctacagctcattttgttctatcttattcatctcagtctgatttaactaattttgccagattctagtactcatctaaatttttcttaaggggttataactgtgacagaaaaaataagtaaaaatatataagaagaaaatgggagctacaggttttatctttgcctcctctctcttctctgtgtagacataagcacaaacacactaataatattttcactgccaaagtatctctgtattaattactcaccttgaaaattaccaactgtctgtagaactgggctgagccaggattgtaaaataggcaacatctatttaatatctcatattgttgcagtactttggaattttgagtgggctttcaaataagttaaaataatagaaataaccttccaggaaagatcaagcagattttatgtcccccattagacatataagaaaagagactgacttgcccaagacgtcctatctaataaatgatggagctgagactggaaccaaaacattcagattccgagtccagggcatttctttccatcatttattgggtcagatgatgatttctaaagcattttacaccctgaaacttcaggattccatgatttattttgtcatttccaacagtcaggcattcatgctctcacttgccatctggctgcacaaagactgcccttcactgccacctacgcccaccctgattttaacactgcccagcacctatgcacttcccccaaagcacccatccccagtcccagtggaaaatatacttattcggtgttttatgttcagagaccttctccacctgtgctgtccaatagaaacaaaatgtgagccgcacatttaatttaaacttttttgtcagccacattgaaagaagtgagattaattttaatgctacattttgtttagcccaatatactcaaaatattatttcaaaatcaatataaaagttgggatattttataatcttttttgtactaaatgtgtgtattttaggcttacagcacattgcagttctaactagctacatttcaagtactcaatagccactagtggccaccatatttgactgaagagtttttttttctatttttatttatttttaatcttttaccacatctttttaaatttattttttatttcaatagtttttagggaacaggtggtatttggttacatggataagctctttagtggtgatttctaagattttgccatacccatcacctgagcagtgtatattgtacccaatgtgtagtcttttattcctcacccccgtctcacccttctccccaagtccccagagtctattgtatgattcttaaggcgttgcatcctcatagcttaactcccgcttgtaagtgagaacctacaaggtttggttttccactcctgagttacttcacttagaataatggtctccgatgccatccaggttgctgcaaatgccattattttgttcccttttatggctgagtagtattccatggtgtgcatgtgtgtatgtatatatatatataaatctatctatatatatatatgtatatatatacatcacatttgctttatccactcattggttgatgagcatttaggctggttccatatttttgcaattgcagattgtgctgctataaacatggatgtacaagtgtctttttcatataaagacttctttccctctgggtagatacccagtagtgggattgctggatcaaatggtagttctacttttagttctttaaggagtctccatactgttttccatagtggttgtattagtttacattcccaccagcagtgtaaaagtgttcccttttcaccatatccctgccaacatctataatttttaaaatttttttaattatggccattcttgcaggagtaaggtggtatcacattgtggttttgatttgcattcccctgatcattagtgatgttgagcattttttcatatgtttgttggccatttgtatatcttcttatgagaattgtctattcatgtccttaacccactttttgatgggattacttcttttttccttgctgatttgtttgagttccttgtagatcctagatattagtcctttgttggatgcatagtttgtggagattttctcccactctgtgggttgtctgctctgctatttcttttgctgtgcagaagctttttagtttcattaagtctcatctatttatctttgtttttgttgcatttacttttgggttcctggtcatgaactctttgcctaagccaatgcctggaagagtttttccgatgttgtcttgttttggtcctctttagaaggtggtttcataatcagctataaaactccaacaggtgctcttaaatgcaggtttctgataactgtggagattgtgacatcagaatagaagaaaacttttaggactcacggagtactgaaatgttcatgaatatcaagcagaacaggaattaactgcatggactaaactaatagaagtctgaaataatctttttaaattttgcttaaaatgttgctgatcctttgttttgtttttcagagtcaataacacttttaagttatttacagcttttaacagttgagtaaagtatactcctatgaaaaaaatttggagcatattcatttctaactgatttctccagaagttggaaattatttgtgggtatttttaacttatgacaatatgttatttgcataagtgcaataataatctgttttctgtaacaggacacagttggagaaactggtattttaccaaggctttgacagggatggcatgctttcctttaaggaatcaaacttgacttatggagtcactaaaagccccttggaaaaactgacctcatacctttgtctacaccgtccctgtatagggttcctgacctgtggcaagtaaagaatgtcaccttctgacaggcccaggagccccaggtttatcttgggacctcaagagaagaggaatttactcaactcacaggcatttgatggtacaaatccatggctggacttggcttttaaaaagtcttatctgagattccttctatggaacaaagttccatcaaagccaatttataagcctatgtaaatatttttgctgcactgtatacaaataattaggccaagtataagaaagcaaaccaatcttaccatgatttgtctttagtaaaaatgggaaactggagagaaaaattatgtttcaaaaactatagtacacctgttgttagattctagtcttccctaatgtttttcaatttttattattttctacagtttggattgaattctaatttttcttggctacaagtcttcatcttcaaaataatgttttcatttttttctcttctttttttccccatttttcctaatttggagtcactgaaaactaaactgtgctttcctgtgaactgaagccagacaacttaaacttcagaggaaaataacagcaacctatgtacatacatgatgtacatatgtacatcctatgtacaacctatgtgcatacaaccactttcataactgcctactgatgtatggacttcagagttatgtggcctatatcgatttgccaggattgttcttttgcctgttattgtttttctcgcttcctccccttattttctcttcaaaggacatgagacttcacaaccttgtaaaaatgagctttcctaataactcaggacctacccatctaggaataaaccatcccaaccaggagagatcagatgaaacctgagaccacagactcattttcttctaaaatgctttctccaaaagatttttaataagaaaagcagggaaatatgaaaggaaaatttcttgggcccccaaaatcactaagctaaagagaaaagtcaagctgggaactgcttagggcaaacctgcctcccattctattcaaagttacccctctgctcactgagataaatgcatatctgattgcctcctttggagaagctaatcagaaactcaaaagaatgcaaccatttctctcttatctacatatgacctggaagccccctccccattttgagttgtcccacctttgcttcgagttctcccgcctttccagaccaaaccaatgttcatcttacatatgttgattgatgtctcatgtctccttaaaatgtataaaaccaaactgtgctctgaccaccctgggcacatgtcatcaggacctcctgaggctgtatgacgggcacatgtcctcaaccttggccaaataaactttctaaattaactgaaacctgtctcagattttcagggttcacataatcaaccttctgaattctttatctggcaattcagagatttctttttggtttcgatccattgctggagagctaatgtgatcttttggggttgctatagaaacttgttttgtcatattaccagaattacttttctggctccttctcatttgggtagactatttcagtggaaagatctagaactcaagggctgctgttcagattattttgtcccatggggtgatcccttgatgtggtgttctccccttcccctaaggatgggcttcctgagagctgaactgcagtgattgttatttcccttctgggactagccatccatccgggctaccaggctctgggatggtggtagggaatgtctgcaaagagcctgggatatgatctgtcttcaggtctcccagccaaggataccagcacctgcttggaccagagagttttaaatagtgactgtaatgtgagcttttgatgtcctaaggaaaagatgtggcctaacatagtttttttttttttcctgtctatggagggaatattttggactatgtgaaactgtgctataccaggtcatatcagctccaagctcccttgaagcatttgtcttaagtctcagttcaaacctggctctgcccgtaactggttgtttgaccctgagcaactgacttaacacctctgggcctctatttcctcacctaccaaaccagaatactatgacatattttcagtacttttgtgtgagttaaatttaatattctgtatagggacctatcactgtgcctgtcctatatatccacacttcaacaacagcaactcttgattgccctctcctccctctatgctgttcagtcatgctccaccttctatgactagatcagcctggtatgtagccaccacttgaggaggagaaaaggaattgacctcctcagtcacccctggacatccatgcaccagtatacctgtgaccacctgtgctgggttgaatagagtcatcctgaaattcatatccaccagaaaactgaatgaatgtggccttatttggaaacagggtctttgcagatgtaatcaagatgaggtccaaccagattagggtggggcctacatccaacgattagcatccttaaagggaggccaagtgaagacacaggggaatacataacgaaggctgtgtggtgttggaggcagagattggagagatgtgtttaccacccaaggagtgccaaggattgctggcaacaccagaaggtaggaagagctgaggggtgattcttccctagagctttcaggagtatggcctttctggcaccttgatttttaatttctaacctccaaaactgaaagataatacatttccattgttttaacccatccagttttcagcaatgtgtgatgacagtcctaggaaatgaatacagcatcatacttttttctaggtggctttgccaatagattgtcaattcatgttctgtcatattcagttttatgtcccctgttcttagcatagcacttggcctacccgggtgctcttaaatgactgtgggctgaaaatgaagcgagaaaacacatggggaaaaccaagttggataaacatggaagggtgtcagtttaaccctgatacagctcgaagaatggcttacatgggccaggggaaggggcaagtttggaacattctgtgggtgattgtgccagaaagtgatccaagaatctctgattggagagtttgaatgtaagacacagagaaggacatgtgcagtaaaggagcccaaagcagaaagacctctgagaggggacagtaagcagaagccttaaggcaggagaagccatgagtgcacacccacaggagaccagagagtactcagaaagtcacttggctgttagaagtggtcattatcaatacagaatggagacttcccgagtctcaggaaaggccaccaagagctgcccctaggccactaggaggtctcctggagaacattctaggtcctcatgccacctactcaccctctgctgaggtggcttccaatgctttctcactcacttcccttatgaatctttacagctaatcaccatcctctgaggtaacctgagtatttttctcaactgcaggcctaaatgtagtttgatttaatttgactgcttctagatagttttatttttactttatagaaaaggaaactgcgattcgtattagcccattggtgcgtttaagcgctctctctctttctctctctctctctctctctctctctctttctcttcctttgtctctcactatttttccctcttaggttagttagagagtgggcatgtgacacagagaagacagcagcaggaaaggtacattttgatgggacaaggaaggtgttgtgtgagaaatcactgggtgctcacgggttctgccgagacctgcttggtcgtggagaccctaacccagtggcgctagacaaactaaagacacacacacagaaatatagtgtgtggagtgggaaaccagggggctgacagccttcagagctgagagccacgaacagagttttacccatatgcttattgagaacaagccagtaataagcattatttctatagattataggttaactaaaacgggaaacaaagggatgggctctggctagttatctgcagcaggaacatgtccttaaggcacagatcgctcatgctattgtttgtggttcaggaatgtgttaagcggttttccaccctgggtgggccaggtgttcctttccctcattccggtaaaccaacaaccttcagcgtgggcgtcatagccatcacgagcatctcacagagctgcagagattttgtttatggccagttttggggcctgtttatggccagatttgggggcctgttccccacctgtccccctttttgtttttgcaagacgataaaagcaaaggtggctttgtcacggtgagctacttctcacaggagctgggatctgcatctgcagactatacaaagacaagcaacacagactaataacacaatcatcattgaaatcacagagcatccaagtgtttttatccattttaatgggttgatagctgctaatccatctgcagctccttcaagcactccagttcctggcattaaggtcaggtgtgcctgggatactttaaatatttgttcttttaattttggaatatctgacgacaagtttgtagagtgtccttctagatgcttttttattctttcccaaattttgatcttattaagagccattaatagtttccacaaatcctgatgtttagctcctagaatgggccatatcatttgagtttgaggtgccactgtaccaccatgtttccagataataggaactcttgccatacttcttaccatttctaccatctgaccattttgttcagaccagctgaacatagtatggccatggcatgcagactgagaggtgcaattcaaactaaacatcctcttagggaaccaatcagtaatgattccatgggaatcgttgtgcagcctccctgcctgttctgcaatgcaatctttccaaacaagtacgttcatttcttctgaccaggtccaatcctgtttacaaataggtttttgagggtggtattcctcaagtatagaagcagatttgttatggcaaatactgagaccagaaagcatgtgtaagtgtgtcatagagtgattacatccggtcattattgccagtcaagatttgatagcgagggggtaggcaactagtggcctttcccaaacagataggtggatgttcaaatcctaaagaaatattcataacagttccttcctcatgtgggtgagatgggcctctatcatctgtaggaccgagcatccaagagttatcattagtgtatacctccattggggggtccagccaagttacaggctgtagaagtggtggaaaaggtaaatatgcccaataagtataatcgttctctgtgtcagcccttgctaaaggaatactcatggcaatggtgatcaccgctaccatggctatcattaaattactcattgtgactggttgtcctgctttcctcaggttttcttctgccatctgtgacagcttcttgatctgtccccaggtaggtggctgtgttcaacgggtgttggtcgtgacagttggggtcctccttagcatcaacttggacaatgctgccactgataggtctttgggatccccccaaaacctcttcctgtgtatctggctcatagtgatgctttagaggtctcgatggtacccaaataggctgttgattcagtcctggagaaacacaagcataacctctaccccaagttattatttgacctatttcccaactttttgttatcggatctctccactaaaccagttgttctgcttgtctttgcagctggtttctgtaaatgctgttcagccactgttgtaactgctgaacagatgctgttcagatgctgttcatctggtctttaggcacactcaaaaaatttaaactcaataatgctagattcaattgcatgtgtggtgtcctgtagtctctgtttccacccttttgcttttgcaactgctgtttcagggagagattgattctttccactatggcttgtccttgagaattatatgggataccaataatgtggttaatattccatatagagaaaaatgtagctagagtttggctagtatagcctggggcattgtctgttttaatagaagctggaatgcccaacagtgcaaaacactgcaaaaggtgatgtttaacacaggcagaagactctcctgattggcatgtatcccagacaaagtgagaaaaggtgtccacacatacatgtacataagctagtctcccaaacaagggaacatgggtaacatccatttgccaaagagaattaggttccaatcctcaaggattaactcctcctgtaaaagatgagaaatgcaccatttggcaagttgggcatcactggataatagctttagcttctttccaggtaatgctgtatctgcgtttgagaccagaggcattaacatgggttaaattgtgaaagtgtctggcattagatattgcagtagcaactaggtgatcagccatttgattacctgcagtcaaaggtcttggaagaggtgtatgagccctaatgtgagtgatgtaaaaagggtgcattctactcctgactgctgtttgcaattgggtaaataaagtcatcagttgttcatctgtatgaaatcgtaactgagcattttcagttaattgtgtggaatgaaccacatatgaagaatcagaaatcatattaataggcatatgaaaagcaatcaatacctcagttagagctacaagctctgccttttgagctgaagtataggatgtctgtaaaactttacctttagagccagaataagaagttttaccattactagacccatctgtgaagatattttcagcaccttcaattggtttaaatttagttattttagggagaatccaattggttaatttcaaaaacggaaacagttttgtttcaggaaaatgattatcaagaatacccacaaagtcagctaaatgggtttgccaagtaagactatttataaaagcttgctgtatttgcaccttcgtgagagggacaataatttttccaggatcatatccatgtaatttaacaatccgagttctcccatttcttttcatagtagcaatttgatccaaataaggagttagagtctgtgaattagtatatggaagagaaagccactgtagaagatcttcctcttgaacaataactccagtaggtgaatgctgagttgaaaaaattagcaaatctggagtcttttcttgatctattctatttatttgagccttatgcactcgcttctcaattagctgtaactctccctcagcctcctttgttaattgccaagggctagtgagactagaatctcctctaaggttagaaaatagattattcatggcctaggtaggaatgcctagagcaggtcacatcaagttaatgtctcctagtaatttttgaaagtcatttaatgttttcaattgatctctacatatgtttactttctgtgacactattgtagtgtcatttactaaggtctctaagtaggagtaaggagtagtagtctgaattttatcaggagctatagttaaaccagcgtgagaaatcgaattttgcaagtgatcataacattggagtaatatttctcaagtgggggcaacacaaagtatatcatccatataattaataatgcaatactattaaaattttttacaagtaggttcaatttcttaccctacataagtctggcaaatttttggactgtttaacattctttgtggcaacactttccaatgaaaacacttagcaggctgcaggttgtttactgcaggaattgtaaatgcaaaccgttcacagtcttgctcatctaaggggatagtaaagaaatagtcttttaaatctatgactattgaaggccaatttttcggaatcatagcaggagaaggcaatcctggctgtaatgcccccataggttgtataactgaattaatggctctaagatctgtcaacattctccatttacctgattttttcttaataataaagaccagagaattccaggggaaaaatgttggagctatgtgtcctttttctaattgttcagtaactaagtcctctaaagcctccagtttctctttacttagtggccactgttctatctaaattggcttatctgttaaccattttaaaggtataggttctggaagctgaacaatggccgccatcaaaaatgatatcctaaaccttggcagaaactttgtctttccacttgaagcagttctttcaaaccttgcaaattttttcctagtcccataccagggacataccccatttcatgcatcatatattgactttgagggctatgtaattgctttggaattagaacttgtgatccccattattgtaataaatctcttccccataaatttataggtacagaagttacaattggttgaatagtcccaggttgtccatcaggcccttcacaatgcaaaatataactactttgatatacttcaggggcattaccaactccaactatgataattgagcaggttgaattggccacgcggacggccagtgctgtagagaaataattgaaatgtccgctcctgtatctaccaaacctttaaatttctttccctgaatagttatttcacaggtgggatgtctatcagtaatttgattcacccaataagctgctttgccttgtttacttgtgcttccaaatcctcctgtttgtttagtttcactttttctccatttccacatatggcacaatcaggagctgtgctgtacactctcctggctctgctttccagggaacagaagtagatacaacaatttgaacttccccattgtaatctgaatcaatgactcttgtatgtacttgcacttcttttaaatttaaactagatctacctacaagtaatcctaccgtccccactggcaagggtccacagactcctgttggcactttttgtggggatctccaggcagaaggctcacagcttctgtgcagcataaatctactgtggcactactggctgtggcaggggacaggcattgttcaggagtgaaggaatggcctgagccagaaatgccccggtttggaacagggctcaggacgggcccctcatggcgtttcctgaaattgggtttccatcgttatcaaatttagaatgacactgattggcccagtgttttccttttttgcattttggacatattccaggctcggcagttttcttttttccctcaactggctgcatgacttgctgattttttctacgttcttttttagtatgaccatgcttcccacagttaaaacaagctccaggagatggagtatttcctttacccattttcagtcctgccatggcttgtgccaacaaagtagctttatgcagattacctccgataccatcacaggccttgatataatcaactaaatacactttccctctaataggtcacacagcagcctggcactcaggattggcattgtcgaaagctagtaactgcaacactatatcctaagcagccgaatctgcaatcatctttttaagagactcctgtaaccaagctataaaatctgcatacagaaacaacaggtgctggagaggatgtggagaaataggaatgcttttacagtgttggtgggagtgtaaactagttcaaccattgtggaagacagtgtggcgattcctcaaggatctagaactagaaataccatttgacccagcgatcccattactgggtatgtacccaaaggattataaatcatgctactttaaagacacatgcacacatatgtttattgcggcattattcacaatagcaaagacttggaaccaacccaaatgtccatcaatgatagactggattaagaaaatgtggcacgtatacaccatggaatactatgcagccataaaaaaagatgagttcatgtcctttgtagtgatatggatgaagctggaaaccatcattctgagcaaactgtcacaaggacagaaagccaaacaccgcatgttctcactcataggtgggaactgacaatgagaacacttggacacagggtgggaaacatcacacaccggggcctgtcatgggatgtggggatgggggagggattgcattaggagaaatatctaatgtaaatgacgagttaatgggtgcagcaaaccaacatggcacatgtatacatatgtaacaaacctgcatgttgtacacatgtaccctagaacttaaagtataattttaaaaaaatctgcatacagttcttttggttcctgttttacagcactaaaggaagggtattgttctcctcctgaagtgattttttcccaagctctgatgcacactcctctaagctattctatggcatcatcctgcatgaccacttgtgcatctaaaccagcccagccgctgacccccaaaagatggtctgcagttatattaatttgaggttgggcctgggtgttgcaagcagcctgaatggaagcttcatctgcccaccaagttttaaattgtaagaactgagcaggagttagataagcttgagtaagagcatcccagtcagtaggaatcatccaactggagacagcaacattctttaacagtcccattacaaaaggagaacttggtccatactgatttatagcttgtttaaattctttgagtaatttaaaaggaaaaggctcaaatgtagctataatatttccctgttgatctggggggggtgtattctaacagggaactgccaagcctctatattaccctctcatctagcttgctgaattcctgcctaaatacaactgagagtggtagctcaagatgctgctcgaacagtcactggggcaactactttttgcccagtgtcctctggaaaagaaagatctggagggtcaggccaatctttttcttcaaaataatgaaggggtgcagaaaggtagggacaaacctctcccttctttgccgctttagctttagctggcaaacaaacctgctctgttacctcttctgttacttcattatactctccttcctcctcatcatcagtgtgaaaaggttccaaggtggaaccaaccagagcccacacttgtcccattgttaccttgatgcttctgagctccccttcttactcaccatggggattgtttaagagtacttgggtgtcctccagcatagttccatgttctccaaccatcgctctggtgacccttcgacccgggttcgagccacacatatgggtgccacttgctgagaccagctcggttgtggagacccaaacccagcggtgctagaggaattaaagacacatacacacagaaatataaagtgtagagtgggaaatcagggggctaacagacttcagagctgagagccacgaacagagttttacccacatatttattgacagcaagccagtgataagcagtgtttctatagattatagattaactaaaacgggaaacaaagggatgggcttggctagttatctgcagcaggaacatgtccttaaggcacagatcactcattctattgtttgtggttcaggaatgccttaagcagttttctgccctgggtcggccagctgttccttgccctcattctggtaaaccaacaaccttcagcatgggcatcatagccatcatgagcatgtcacagtgctgcagagattttgtttatggccagttttggggcctgtttatggccagatttgggggcccgttcccaacaggttcttggttggagacatcagggcaacacgtcaccaacaggaaaaaaacactgaggggagcttcccattggtgcttaggaatgaacaaaaaattatcaactgtaaactgtttccctcagagaaaacagtgtcacaaaaatcttttttaaatgcttgggtgttttctgtattgtgttttcacttagcttagaaaggacaatgcctgccaggctgtaatcaatgttgttacatcaggctctaaggacagttatgaacagtcttctctcctgagatgtttcaaataacacatcctgatgcaactttatcaaataaggcagctgcagactctccaaggccacataatactgtgttttcctaaggattaggttgcataattccagagatatctgtggtttgaagcaaatgaattatcaacagaagagtcatatgtcaatgagcggaatggaaaaacaaggtagaggcagtctttcatctgaggagaaatgcagggtctcccttcaggatgaacagatggttcacccatcttccccaggaaaatgaaaccacagctgtgggtctgagtgccgatgctggatgaaagttggaagctgtctctggaaagcaggcttccccaaggctggatgagtcaggccagggtgctgctcttctggtaaagtcagaattccactaagcaagtaataagcccattggtgtgaagtgtcaacatgtatgtaacaaagaaaagattttacaatcttctaaagcaattatgtccaacctgggcctcatgcagtccaagacagctttgaatgtgacccaacacaaattagtaaactttcttttctatttttttatttttatttattttatttatttatctatgtatgtatttatttatttatttatttattttgagattgggttttgctcttgttgcccaggctggagtgcaatggtgcagtctcagctcactgcaacctccgcctcctgggttcaagcaattctcctgcctcagcctcccgagtagctgggattacaggcatgtgccaccacgcctggcttaattttgtatttttagtagagacggggtttctccatgttggccaggctggtctcaaactcccgacttcaggttatccatccgcctcggcctcccaaagtgctgggattacaggtgcgagccactgtgtctggcctgtaaactttcttaaaacattatgaggttttttttttttttttagcttatcagctatcattagtgttagcatattttatgtgtggcccaagacaattcttcttccagtgtggccagggaaggcaaaagattggacaccactgttctaaagagaagaaaaagaaatatagagagaggattaaaatcaaaatgatttcagtcttctcaagagtaaccctaaaagcccaaagaccaacagagcaatgctttaaaaactccaaaggaaaattatttccaaactagaattctgttccaggacaaattcactaattcatgtgataatagaaagaaagatattttggatctagaaagtctcaaaaaacttatctcccattcacttttctcagaaagctgctagaggatgtgctccattaaaacaaaagagtaagctcagaaaggatgtaaaaaatgaaaggtgcaacataggacagctacaaaggaatatggggaaggggatcccaggatgtttgcagggctttctgacttacctgagacaggagcaggtcagaagtttccaggaaagagttcttcatgaaaaataattgatagactctctgataagaactaccaattaagaggatatttagggttgaattaatgataagtacagacagaactaaggcagcaagcaatggataattattaactccattattattcaagaaagtaaagtaatcttgggtgattacacaactcagctgtaaacagtgtttgcatagtatctgatatgagaccaaaccattttttgtgatgtaattcacagtctctaggaagaaatctctggcatcctgatagaaaaatcttgtacttaaaaacaaacaaataacaactttaatgtgattaagacttacactgagacaccagtcccctacacacccagctgactgtcagcccagagtttagtgatctttaaccaaatattctttcctttttgtattgttgggaaatttaaaatgtctacaaaacatcaaaaagaaagaaaccagagtaccatggacaaaggctcatcatctgcaaagatattttatatgcagagagaaattccaccctacttaggcagccaagaagtaacaatccttttttctttctttcttttcattctcaaaggaggtgagaagttacattccttttctactgccctatttttagccattacatacatatgttctctattaacagtaacctgtcctcctatgagaagaattaacagagccatttgctgtacattctttcacagtttagcctaaattcacctttatcaaaaggaataataatggcatgggcaacatggtcagacctcatatctaaaaacaatttaaaagttaccaaggcgtggtggcacatacttgtgttcccagctacttaggagactgaggtgggtggatcacttgagcccaggaggtggaggctgcagtgagctgtgattgtgctgctgcactccagcctgggtgacagagcaagaccctgtctcaaaaaaaaaaaaaaaaggaataataaaatttatctctgcgacaagcagatgaagatagagacagaaaggtgctcagaggttaaacttccacagtgaatggaacatagagacattattttcctaggtgtttatttacatttcaaaaagatggctctcagatttctgaaaaaaacaatctgggttgtaaagtgacaaaaggctaactcaggaagatataaaaataaaattttatatacttttcactgggtgggaccatcccgcccagtgcaaactgcaaaatacttagcagtctttgcccagccccttcccaatataccagtaatgtctaaccccaaccccctaccccgggcattgtagcaataacaaaagaaagagaatgaggagaagggagggagggaagaaaactgccctcacatattttcaaatacctcctggaaaaggaaggccaagctagaatgaccaactcatcccaatttgcctgggacttttcaagtttaattttaccagttttggcactaaaagcctcatgtcccagaaaatccactagttccaggcaaaccaggacagttggtcaactgaacaccccatgacatatgcacacatgcacatgtgtgtgccaaccatctaattatgtatgtgtgccacttaggaaaaaattaaaacttaaaataaaaagataggctttaacattgaagacatctgggtttgtattatggtcctgtccctcaccagttttgtgacctagggcaagtttctgttgatgaattacaatcatccctcggtatcctgagggactgggtccaggagctaccccccatacccaaatccacggatgctcaagtccctgatacaagatgatgtagggtttgcatataacctatgcacaacttcatgtatactttaaatcatctctggatgacttataatacctaatacaatgtaaatgatatgttaatagttgtactgtttagggaataatgacaagaaaaaaaagtctgtgctttttcagtacacataagtttttttttctttttaagacaaggtttcactgtgttgcctaggctagagtgttgtggtgcatagctcactgtggcttcaaactcccgggctctagctatcttcctgcctcagcctcccaagatgcaatttttttcccgaatattttccattcacattcaatccaccaatgcagaaaccatggctatggagggccaactatactatcaacaactctggttgccacttctcttgtctgttctagggaattaaaatgatgtaacctgtcagggctggtgtgagagcaatccctaataaatggccttgcctctttcttgcgtgaatttgggcctcagttctccaaaattcacctattgacacaccctcgatattttttatttcttttttctgagacagagtcttgctctgtagcccaggctggagtgcagtggcaccatctcggctcactgcaagctctgcctcccgggttcacgccattctcctgcctcagcctcccgagtagctgggactacaggcgcccaccaccacgcccggctaattttttgtatttttagtagagatggggtttcaccgttttagccaggatagtctcgatctccttacctcctgatccacccgcctcggcctcccaaagtgctgggattacaggcgtaagccaccgcgcccggctgatattttttatttcttctttagcgaaattagcttattgtgttcttaactaattttctgtatctgaattagaaaaggagctgatatggtttggctgtgtccctgcccaagtctcatcttgaattgtagttcccataatccccacattcccattacctccatgctgctgttctatgatagtgagtgagttctcacaagatctgatggtttcataaggggcttttccctctttgcttggcacttctccttcctgccatcatatgaagaggatgtgtttgcttccccttctgccatgattgtaagtttcctgaggcctccccagccatgcggaactgcgagtcaattaaacctcttcctttacaaattaccaagtctcaggcagttctttatagcactgtgataatggactaatacaggagcctttgtgaacaaggacaatgtctttgcatcctggttttatagttcttaatgcagtggctgcagatagaggattcagtaggatttgttagttgctatatcatctttctcaatctgtaaagtgctgatattgtacagataatagaatgggacatgaataacttttatagaatataaatcttcaaattcagtaatttactagtacggtgcacagccaatgtgcttgggggcagctccggctgatgaattacctcccatggcctggctctcttggtgacttaagtgcccccaaactagggaatagtttagctgagttagagacaatttgggcaggaaaattagggagtttgggtgtaggagaaggttcagttgtccaggaaaggaaaggagacaataactttcatgacagagagacaattctagggttaagatgatgccagaaagttagcaagtgactttcctaaagccatttcatacagtatatggggctggctgccatcttaccctttttctcatcaaaatttttcaattaaaatgtgaaacactgacttttatcaaagaagttaatgttagggttgccagataaaatataggaagcccagataattttgaattttaaataaacagttaataatttgttagtgtaaatgtgttctaaatattgtgtgggacttatactaaaaaattatttgtcatttctctggaattcaaatttaacctgggcttcctacattttgtttgctaaatctggcaacgccagtcagtgaaaaataaaattcacttcacagaaaacccacagcatggctaatgtccatgagaatacctttaaagaaacacggcccttgatccacacagacatacactacatattataaatgcaggtcaaaattcttcctttaatgtgattcatgttattttaatgacttttaggtcaaactcagattcccagttacaggtgcccttggctagttttatctgtgtaacatttgaggctgcatatgtgatcatggtcttgggtttcatctgagatgttagaagccatgtctcttgaggtacttggctcgtgcaaggacatcattgcagaagtcacagctcaggtcctggctgcttcggacatagccagcacccccactgtaggcacagagtccacctgaaatgcatgagataggttaatgctgacctagggtactcagcagttaactctgattctctttactaactacctaacaggaggcagctggagtttcggggaatctggtgcaatgtattatatttgtccctattaattctgtgcttgagacaactgactgatagcgttacacgtacctctcaggtactggtcaggggtccaggttggaaacctcctctggatttctttgattctagtagtcagaacttcagttgtctgggaaacctgagactcactaatccaggatgtgggagcttgagagccagggtcctgcagggaaggaggcagagaagaagccacgtaagctgggtgggagggtgatccggcttactgggctcaatggcgcttgttcatttcctgtctcttgttctcctttcacctttgatggaaccaatgccaccgtcagtctcctgtgaggtaggttagatagggtggtcatagcctcccttatggggaacaaatttgccagacaggtggagagaacaaaccactgacagtgcacaaactacatggtcagaatatcctacagtgccagacacggtggcttatgcctgtgatcccagcactttgggaggccaaggtaggtggatcacttaagctcaggagttcgagacgagcctcagcaacatgggaaaacttcatctcaacaaaaaatacaaaaattagctgggcgtggtggtgtgtgcctgtaatcccagctacttgggaggctgaggtgggaggatcacctgagcctaagaggatcaattgagcctgggaggcagaggttgcagtgagccatgattgcaccactgcattccatcctgggtgacagagtgagaccctgtcttaaaaaaaaaaaaaaaatatttgcagtaaggagacaaagaacagaagggaaaattcccaaatccatgcaagcacagaaacccatgattagtgtccttgggctgacctatgctcattgtaagagtgaaaaaaaagcacactcctgggtggagaattaaaatgctgagacacgcgatgtatgtgctagcatgcacaacaatagcgcatgtgcatcccggagaccctgaaacatgcttaacagcaataaccatcccctctgtcttatgaataatcatataagctttccatgaagggattttcccaatgtcacatgaggctgtctcattctccacccagctaccagagtgtagttttgctttgcaataaacttcttcgcctacttttaatttggactcgtgcccaaattcttctgtgcggcaaagtcaagaacttgaactggccctccaacaacacctggagatcagacagtaaagccatttatacctgttagaatagctactgtcaaaaatgcaaaagacaggtgctataatttgaatgcttgtcccttgtgaaattcatgttgaaacttaatccccgatgtggcagtattgagaggtggggcttttaagaggtgattagattaatctatgaatagattaatagattagtgggttaatggttatcacaggagtgaggctggtggctttataagaagaggaagagagactaagccagcacactcagcctctcaccatgtgaggccctgagccaccctgggactctgcaaagagtccccaccagcaagaaggctctaccagatgtgtccccttgaccttggggtccccagcctccagaactgtaagtaataaattttatttttcataaattacccatatttaggtattctgtaataagtaacagaaaacagactaagacaactagggttggtgaggatgtagagaaactgaaatcattgtacattgttgatggcaatgcaaaatggtgcagctaccatggaaaactgtactgtggtttctcaaaaaattaaaattagaactaccatatggtctgggtgcagtggctcacacctgtaatcccagcactatgggaggccaaggcaggtgggctcaccaggcaggagtttgagacctgcctggccaaaatggtgaaaccccatctctactaaaaatacaaaaattagccaggtgtggtggtgggcgcctgtaatcccagctactcgggaggctgggacaggagaattgcttgaacccaggaggtggaggttgcagtgagctgagataatgccattatacttcagcctgggcaacaagagtgagactgtctcaaaaaataaaacaaattaaagtaaaaattaataccatatgatttagtaatcccctttctgggtattcatccaaaagaattggaatcaggatctcaaagagatatctgagctcccacattcattgcaaagctattcccaatagccaagaggtagaaacaacctaaatgtacctgacagatgaatgaataaagaaaatgtggtatacacatatcatggaagattattcaaccttaaaaagaaggaaatcctgcattatatgacaacatagatgaatcttgaggacattatgtaagtgaaataagccagtcacaggacaaatactgcatgatttcacttatatgaggtatctaaaatagttaagttcatagaagcaaagaatagaatgatggttgccaggggctgatggggagagggaaactgggagttgctaattaatgggtataaaattttagtcatgcaagacaagtaagttctagagatctgatgtatgacattgtgcctataattaacaacactgtattgtatgtttacacatctgtagccagcattatccttagcaaactaacacagaaacagaaaaccaaataccacatgttctcacttgtaagtgggagctagatgatgagaacacatggacacatacaggggaacaacacgcactggggcctattggagggtggagtgtgggaggagggagaggatcaggaaaaataactaaagggtacaggcttaatacctgggtgatgaaataatctgtacaacaaacccccatgacacacgtttacctgtggaacaaacctgcacataaacccctgaacttaaaggttggaaaaaaggctttctttttttttaatattaggtttgtgactgtaaatctcccttaaagcatttttaccatatctcatagtttctaatatctagtgtttctctatcatcctgttttagttatttttaagtttcactatgatttgtttctttaacctaagagttacttagtgttgtgtatgtgtgtgtgtgtgcatgtattttaaatttccatatgatcagagatatttttaatttttaaaattatcttctagcataattgtattattgtgatatctgaaatttttgaggatttctttaatagatgatatatgatcaacttttgtaaaatgttcctcatgtgcaggaaacaattgtgtatatcctaatggatacgtaaataattacatccccctcatttttctctcctgctctccctccctccccaattaacaatcaagcctcttaattgtgttcttattacatgtgttaattgttttacttatttttcttctatatctttgctggtttgtttattgtataacctgtaaataatcaagagagatgtgttgaaatttcccattatgatagcaggtttattattatagtaataataatttatgctgcatatattttgaggctattttactggcatctacttgttttaaattgctgtatgtcctggataaattcaatcttttttgttatgtcataattctctccataccaaatattttttcttctaaagtgtattttatttaatatatcatagttatcaacattattttgattattgtattcctgataggtcttctttttaccatacttttacttcaaacttttgcatattcaaatgctttaagtgtttctcacataaaccatgtaaatctggatttgggcttttaatctcgttcatacatctgtgtctttaaaccagtaggtttcctatatttatatttattgccattattaatatcgtgtagttgctactatcatcttaatttgttatttcaatgtgtctctctttttctacattcctttttactcttgtcttaactattattattattaatattgttagaggtagggtcccactctctcgcccagactggagtgcagtggcgtgatttcagctcactgcaacctccgcctcccaggctccagcgattctcctgcctcagcctcctgcgtagctgggattacaggcacctgccactactgcctgactgatttttgtatttttagtaaagacaggatttcaccttgttggccaggctggtttcaaactcctgacctcaaatgatccatccgcctcagcctcccaaagtgctgggattttaaagacgtgagccactgtgcccagcctattttgtaaccgaaactatgtctcaccctaaataaggcaaggactctctgatcctttgtctccccaccactgcttccagcacccatcatattgaccaaacctataccctgggttttacttaaaatgtggtccgggaaccagcaacatcagcaacaactgagaacttatttattagaattgcagaactttgggccccatttcagacctactgaatcagaattctcatgtaaacaagagctccaggtgttcatatgcacaataagcttcgagagtcagtaaactagacttaaaaaacaaaaatctgtggccgggtaaagtggctcacacctgtaatcccagcactttgggaggctgaggcaggcagaccacttgagtccaggagttcgagaccagcctgggcaacatgatgaaaccccatctctacaaaaaatacaaacattagccaggcatggtggtgcatgcttgtagtcccagctacttgggaggctgaggaggatcgtgtgagcccaggaggcagaggttgcagtgagctaagatcataccactatactccagcctgggtgacagagccagaccctgtcttaaaaaaaaaaaaaatctgttaagatgatagatctcatgttaatgttaagtggtgttcttgccaaagaaaaaagatagtcaagttacaaggtttgggctaaggaagggatgagcagacctttcactgctgcttcagcttaagggtgtaactcagttaatgactgagttagtgtaggtagcagtgtgatgccctccttcaatgctgccagtgcaaaccctccaaacagtccagaaagggatttttctgtctgaacttgtaattctttttccagatagtctgaacgtctaaagggacttctaacccttcttatacgcctttgattatcacttccatgtaggtttcatcatatttgggagaaatgtccaaatctagagaattctcttgtttgttgttgttgttgttgttgttgttgttgttttttgagatggagtctcgctctctcgcccaggctggagtgtagtggcatgatctcagctcactgcaacctctaccccccaggttcaagcaatcctctcacctcagcctcccaagtagctggaattacaggcatgcaccaccatggccagctaatttttgaattttagtagagatggggtttcaccatgttggctgggctggtctcgcactcctgacctcatgtaatccaccctcctcgtcctcccaaagtgctgggattataggcatgagccactgcgcctgacccaaatctagggaattcttatttcatcttcaaaggaaatggactcatcctttcctcaaaagccagattttacaaaggagacagaacagcgcagcagaaatgatgccagccctaacatcacaagatattcagtcccagttctgcctcttgcagctgccatgtgactttgtagcagcaactccttccttgtgattctatttcctcacttgtcaaggatggattacgtgtccctcacctcatcttatcagattattggatgggtctccaaatcgaagtaaaataaagtatttgaaagtactttaaaagtatcatacaaaaaagtcaagggaagcaaatttggagagatcattgagaaataaatttttctaaaatcttaaaaaaaagactgcaatactcacaggttcctcaacaacaaccacaaaagcagtgtgagatcaatggaaaaaatcaagcctcattctcacccttgccatcactgattccctggcgcagagttaattcaacagtggattagtgaccattccccagaagtctctatctggcaagtgacaccagacggaattcatgcaaaaataaaactcaatcttcagaactaagaattgtatagaaaaaggtaaaggaaaataaatttaacattttttgagaatccaacagatatcaggtacttttttgcattgtttcatggaatcttcataataatgctgtaagaatggcattttataggtagagaaactaaggcccagtgagattaaatgacttattcaaggccatgtggctacaaagtaactgaggaaagatttaatctgtgatctttctcttggaccacttaggtccagaaatccagaatagggtggcccggatgatattctggaaacacggcattatttactgtgaaaagaaattgtggctcaacatgaaacagaaatgttgctgctcatatctctcaggcagaactgtcactgtcacagctctagagaccttcattcatgctgtgttctgtgaagctttgccatcatccaaaaaacaaagcagtggtgccacatagcagaatggccacatgtgtcaacggatgaagagttacctgcaccatgctagtcctatcgcccatgttgaccagaattttgtcaccgggagacttcctggacaagacaccagcgatcacggcaggatccatgcagtacttttggccaatggtttgcatcatgggttgatatttcaggaggtatggcatgtctatttcagccagcctttcagaagcacgaactcctaaaccaaacgcaaaaggaatgatgcagcttgttgtgacttatgctgcaacaggagctcaaggggagagagaaagaacaatccaaggatctgagtaatggtcgaggactgacaatcccagattttggtcttaaatctttagtagtggccactccctgacctgaggttagggctctcctcctgtgagcttgagtcagcatcccctgagccagggtcccctgtggctgtcagtgcccttcgactgggctctcaggggctgctctggcccacccaggacaattccatggccataggaaccattggtcccattctaagcaccccaataaaatgaaatgtgcctgcctatcagctgcaacctgacatgaaggagaaattctgcaaacccttcaataagtctttagatagtgttcctcaacaagtttgttcacaattgcacagttttccactcctaaacgataccaacaaatcatgcaagtttaaacctttctgaaataataagaatgctgggcaaaaggaaagccaatattaatctacttagctagccttaccttctaggtgcttttatggtttaaaaagcaccctcggccgggcgcagtggctcacacctgtaatcccagcactttgggaggccaaagagggaggatcacctgaggtcaggagttcgagaccagcctgaccaacatggtgaaatcccatctctactaaaaatacaaaattagccaggcatggtggcacatgcctgtaacccagctactctggaggctgaggcaggagaatcgcttaaaccggggaggtggaggttgcagtgacctgagattgcaccattgcactccaacctgggcaacaagacagaaacttatctcaaaaaaaataaataaaaataaaaaataaaaagcacccttgtccacattgtgtcaatcagagctcacaacaacactgtaaataccgtactgctagccgccttgccacggatgcaggggcagctaagtgacttgttcaagaagcagagctttgggaccccatacccggaactctttccaacactcagtagcgtgaggcatgggaaacagtgaaagccgggggataggttgagagggcgaaagctcatagctaccacagtagttcaggccgtgacgtcttccaatcccacaagatgctccaggggtgtccaggctttggatgtttccatagcatccccagttgctgctttcagacaagtctacaagttgagaaaagttcagcctaaggcatggaactagttctcatcattcttctgtccatgaataaaattacattaataaaagtaacaataataaaatccattacatcaccttcactctgcaattgaaactcttgaaatttaaatgagaaatatcccataaatgatcacaaaaacttcctcaataccaaattctcacctgctcccctgcagacatgagtaactactggagctattgaagcagttacactctttgtaaagctctggtgccctttgatgttgtcaggtggtatcttggaacacaaaggagaggatttgttccctgtaaagtagtcctcatcttacttttttttttttttttttttttttgagatggagtctggctctgtcgcctagtctggagtgcagtggcacgatctcgactctctgcaacctctgccttctgggttcaagtgattctcctgcttcagcctcccaagtagctgggattacaggtgcatgccaccacgcccagctaatttttgtatttttagtagagacgaggtttcaccatgttggccaggctggtctcgaactcttgacctcaagtgatccgcccgcctcggcctcccaaagtgctgggatcacaggcgtgagccaccgcgcccagcctcttctttcatcttatatgaactctgagcacttctccgtcaaatactcctaacttgttgctctgatgaaatatttatgtttgctctggagaaacaagtataaaacctggatctctctgggatatcaacccagatccaaagtaaggcactgctcgtaaatgaggatttgaggctggctacactttctctcaggtacacttctagataagagcctaaggctgcagaagggagtgaaggagagaggcatgggaccagtctccacatgggatcacccactttccacttcttccctttatctctttctcctttccatctctctctacctctgtcattctagtcatcactgaaggggaggagtggtttcagacactcgggatttcacaaaggccattgaagaggagaatgttctttctcttcacaccaggaggagagtgcatgagtatttagatctacaattcacacaaggtgggtacacaagtatttataatatatctacaattcacaccagaatggggacacatgagtcagtactaagatacctacagtaggcaggaaattgctccttttgagaatcatctcaccattataaggctgtaagaatgtctcattagattactctttaattaattaattaattaattaatttatctatagacagggtctcactgtcacccaggctggagtgtagtggcatgatcatggctcaccacagcctcaacctcccaggttcaagctatcctgccacctcagcctctcaagtagctgggaccacaggcacaagccaacacacctgtgtaattttttgaagagatggggttttgccttgttgcccaggctggtctcaaactcctgagctcaagcaatttgcccgcctcgacctcccaaagttctgggattacaggcatgagccaccgcatacacctggtttactctgtttaatctatttgatcctttgactaaagtagattagattatcaaaccttaatgatttgcagatctttggagatatatctattgcctataatcatatgtgtcctgtgtgtttacataaatgcattttcaggttctactttcttagaactttatggggttgataaatactcgtcttttggagtaaatacttctactttacaaacttgtgataagtaacctaagaaaaatgtggaaatgaaaagactagatcttttatgaatatactaaaaattaaaccagctgacaggttcttttttattttttaatcagtgcacttttatctttatgactggtgacaaatacccttagtactgcagttggttttatcactccttggttcctgccttgtggacctctccctagccacactctatgatcctcaaaattctttgtattcccaatgcttagcaccttgtaggcatttttaaatatttgttgaatgaatgggtcaataactaaatgaatgactatgagacctcatctaagaaatctattaaatttagagtcaggaaaatttagcttctcctgaggaactttgcttcctccttttatttattaaaaaacaagtaggctgggcgcagtggatcaccctgtaatcccagcactttgggaggccagatcacgaggtcaagagtttgagaccaatctggccaacatggtgaaaccctgtctctactaaaaatacaaaaattagccgggtgtagtgacaggcgcctgtaatcccagctacttgggaggctgaggcaggagaatcgcttgaaaccggaaggcagatattccagtgagctgagattgcaccactgcactccagcctgggtgaaagagcaaaattccatctcaaaaaaaacaaaaacaaaagcaaaccaacaaaaacaagtactttccctttttcctccagctgcaaagctgaagttcaatcacagcaactaaatcagcctcagtgattagcttagtcatgtgtactcggttgccttgattctggttttctatttgaattagtcttattcattagtcttattctggcaaccacctcaattcttctatggaaataaatgctttaggaataaattcaatttggcattttttatagtggacaatgagcagctattgatggtgtatatttaaagtctggcttcaagcagtgctgttttaagcccaccttgcattccagagaaccccaatcttttgtgggacatttggggagaggctgattgttggtggctgttcctaactccaggatttgttggacagtttagggaaaaaataatcttttttgttgcattttcaagtattagaagtgccattgtgttcctgtgcttatccttcccatctccaaagtcatttgtaaaaatcagccacactcacccatcagggcaaggaggcccagcagcagccacaatgcagacatgatgacgatctggctctacggctcctgaaacacttttaaaacaaaaattagcttgagaatacaaaaatatcagtcatcatcataaccacatgtaatatttccacagaagcaggggtgaaaagaacaaatttccccatatctgacctaagaaaatgaattatttgaatcatagtgaaaaaaaagcaaaagtaggacaagtaagtgctccattcatcctttcaattaatctaaaaatgagaagactcttactcagcccacaggaactcaacatacagtcaagttactaactactttatttcaagaaggcaagacactttgaatctcaaccaccaagaaacatactgacctggctccagaccctgaaaagcaaatttctgatgcccatacctcatcccaagagcctttttattatctccattatcaaaaggagaattttgtattggtgacttcttggaatttaggtcccttcttcttcaggtttgaggaaagaccacgctttcctcagtgccctggaatgtacactggttggaagacgtttcccactgctctaaccccagcctggaatcacagaccccctttatcaccttgagccatgttccccattccccctctgtaaaaccccaatgcggcaacaaacctggaccagagcccagggagaatggagctacctccaccagcaaatccccaagaagctggctcatgggcaggggtcccaggattgaactcatgaggtgctcacaagactggagaatgaacacgtggccaacatggagcacccgctcatgtgctctctctctctcttatcccaaccattcccctaatcaccttccatgagtacaaacagccctggttctcctactggctaccaaaccaatacacaaataccaccaaggatagtttgctgttaacctcagggaatggtagagtttctggacctttgcctccaaagcgcctcccaccaagccctgccactccagggtgtatgtcatcattgccccagtcagcagagcctggcagcctagcattttgaattattactgtcattacatgtaggaatgtgcatataaacaaggcacttggtactttcataatgcttctctcatctcttttgttttgaggttaaccttatgggttgtttctttcaaacacccaggaagagatcacatctcaagatggagaggctttaaggaagtcatttgaagccaggtgtggtggcatacacctgtagtcctagctacttgggaggctgaggcaggaggactgcttgagcccagagggtcaagggtgcagtgagctatgatcacaccactgcactccatcctgggaaacagagcaagagcctgtctcaaaaaagaaaaaggaagttattcgatttctgtcttcttaaactgagggggcatatgcccttcagttgcagtcatgctttttgttattctctctacaacattgagatggtctgtccgattttgcttagttgagcacaaaatgtcatggtcagtcccaacaccaaaaagattcagggacctggaatcttagctgggtctgcaggaacgctcagatttaatcacccaacaggagtcatttattcagcatcctgagcctccagcagtaaacaagagaggacaaccaatcccaggagaaaagaatggacaaagagctgcttgggtataggaaaagctcatggtctcatgaaagtgcatcactggctttatggaaggacccttcaggaaaaagcactgctcacattcaaatgctccacccagggtatttcactctttttgctgcttttccaggaaagaaaaaatacttcctcttggaaacccaagtggaaggactcagcttttattgtaacaggagagctaccgtattttccatgcttggaactaaatatctgtgttgagaagtcactttaatgaaagagtctatgtaaatacatgtgccacttaatgggaacacagaattactttctagttgctcctgggaccaggtcatcaaggtaaagtttttcaatttcatcagggaagagcaagaagtgacaatggaatttttcttttttttcttagagccagagttttactctgtcacccaggctggagtgcaatggcacgatcacggctcactgcagccttgacctcctgggctcaagtgatactcccaccttagcctcccaagtagctggggctagaggtgtatgccaccatgcccagataattttttagtttttatgtagaaatgggtctcactatgttgcccaggctggtcttgaactccaggcttcaagtgatccttccacctcagcttcctgagtaggtagggttacaggctcaagccaccacacctagcttggaattcttaaatggatgaacaatgtcattttgtccataaatacagcatattgaagcaacccaaactctatggcccaactttacaagtgacgaaaagtactctgtgtttagaagagattgttgagacatcactcgggtgtgctcaaagagtgtctgtcagttccctatgactcatttgttaattcccctgtggctccctgcttaaaaccattatgaagatgtcagaccaaggcagcacagtggtcatgatgtcaagcacaatgtttatggtagcatccctcttctcccttcccagagagcaaaatagtaacaaacagcaagggggtgtcaacaagctggggcaacaggcctgccaggcacactggaaactgacaaccagagcatccctcaggagctacctcatgttcctggtggctttgatggggacatcttcctctactcaccctctctccactgagtactttggaattcccaaag

SEQ ID NO: 3 - DNA, 88047 bp, Homo sapiens
cattttcgtgctataagataagcagtccctgaatctcttctcatggtttatagccagaattcactggctaactgagccagccttcaccactctgctgtcacagcccgaatccatttcctgtacctccccaatcatttcagagaattgcagtcagccacaagataatagctgcacacagcaatggcatttatacctacaataaactataagataagacttcctttacaagtccatactaggcttgttcctgacttgattttagggagaaactattgagtagttcaacataagtaagacgttagctgacatttttgttggtgtcctttatcagatagagaggtttttttctctttctggattgctaagaagttttctttttttttttttttttaaatcatggatgcatattagatatcgccaaatgctttttctgtattctgaattttaagtcaaccttaaattactggagtaaactccactcggtattgaataattatctttcttatatattgctagatttagcttgctaagattttgttaagaattctgatggatattggtctttgactttcttttctgtttttcttttcttgcaatttagccgcatcccactaatttgggtatattatgttttcattattatacaatttgtataataattgtataataaataatttcatttttatacaatttgaaatatttttggccaggcatggtggctcacgtctgtaatcccagcacaggaaacggaggtgggcgcatcacatgaggtcaggagttcaagaccagcctggccaacatggtgaagcctcatctctactaaaaaaacaaattacaaaaattagccaggcatgatggcgggtgcctgtaatcccagctactcgagaggctgaggtgggagaatcgcttgaacctggtaggcggaggttgcagttagccaagatcgcatccctgcactcctttctgggccacagagcaagactccatctccaaaaaaaaaaaaaaaaaaaaaaaagaagaagaagaagaaatattttctactttgctttgtgattccttctctgactcatgggttgtttcaaagtatgttgttttgttttcagatatttagggattttatagatattttaacatttttactctcttttttttttttttttcgggcagtgtctcactctgttgcccaggctggagtgcagtggcataatcctagctcgctgcaacctgaaattcctgggctcaagcaatcctcctgctttagcctcccaagaatctaaaactacaggcctaccaccaggccggctactgaaaaaaaattttttgtagagatggggtctcattatgttgctcaagctggtcttaaattcccagcctcaagcaatcctcccgcctcagcctcccaaagtgctgagattacagacatgagccaatgagcctggccatttgctcttaaatttaatactcttgtggttacagaacatctctggtaagattttaatctttgaaatttattgagacttgtttgatggcacagatttggtctatctgagggaactttccatgtattcatgcacagaatgcctatttttttgttatttacttgaatggctataaatgtcaattaggtcaacatgcttgacagtatcttacaggtcttctagatcagcactgtccaaaagaaatgtaatgtcagccacatatgtaattttaaattttctagtagccacaatcagtgacgaaaaaagaaacaggtgaaattaattgtaataatacgttttatttaagcccaaatatccaaatagcattttaacatgtaatcaacataaaattacttattttattttatttttttggaaacagaatctcgttctgtcacccaggctggagtgcagtggtgcgatcttggctcactgcaacctccgcctcctgggttcaagcaattctcgtgcctcagcctcccgagtagctggaattaaaggtgcgcaccaccatgcccagctaattttttgtatttttagtagagacagggtttcaccatgttgcccaggctggtctcgaactcctgagctcaggcagtccaccctccttggcctcccaaagtgctaggattacaggtgtgagccaccatgcccagcctgtaatcaacataaaattatgaataaaatattttacattattgttttcattttaactctttgaaaatcagtgtgaacttttcatctcccagcaaacctcactttagactaatcatgtttcaagagcacaatagccgcttgtggctctagtggctatcatatcaacagcagagttctagatcctcaccaatttttttccttttattttattccatcaagtgcttaaagagggatgttaaaatcttcaactatgattgtggatttgcctatttatccctttatttttgtcagttttgcctcatttatttggtacatatgcgatcaagtaggcttcatccctggaatgcaacgtcagttcaacagacacaaatcaataaatgggattcatcatgtaacagaactaaagacaaaaaccacatgattatctcaatagatgcagaaaatgctttcaataaaattacacatccattcatgataaaacaaaactctcaataaactaggtattggggaacatacctcaaaataataagagccatcaatggcaaacccacagccaacatcatactgactgggcaaaagccagaagcattccccttgaaaactgacacaagacaaggataccctctctcactactcctattcaacatggtattggaagttctggccagggtaattaggcaagagaaagaaataaagagcatctaaataaaaagagaggaagtcaaactatccctgtttgtagatgacatgatcctattttacaaagccccgtaatctcagcccaaaagcttcttaagccgattaacaacttcaccaaagtctcaggatacaaaatcaatgtgcaaaaatcactgcttgatcgtggtgaataggctttttgatgtgctgctggatttggtttgccagaattttgctgaggatttttgcatcaatgttcttcaaggatattggcctgaagttttcttattttgttgtatctctgccaggttttgtatcaaaatgatgttagcctcatagaattagttagggaggagtccctcctcctcagttacattcacatatggcacaggagaaccaagatatgctctagtggatcttctgagccccaggcatagttatccatgcctccattagtaaaaagaactcttgtcttcttgaatcttctctaaagggttactagaataagacctcgtctttgcctgctattccaacagcacaagagcccccaaataatcagatggcagccatagtttaggttcagtgagttactgggtcccttggtagatatgttctctactatcatcctccatgcctctgcccctagaagccagatccttcagaccaacccaacttagtgttacagagactggaaacaaaaatatctctagtggctcactgggagtgatgctgagagatgtcccaactatttccaatacttcatttctagaaccatatatactctacctattgaggacctaccataaaatggccgttggttccaagttgtggaaacaaacaacgaccccttgttcgagaagcaggaaaaaggtgcctttaaaagtatgaaaggtgtggtggctcatacctgtaatcccagcactttgggaggccaaggcgggtgggtcacttgaggtcaggagttcaagaccagcctggccaacatggtgaaaccccatctctactaaaaatacaacaattacctgggcatggtggcaagtgtctgtaattccagctactcgggaggctaaggcaggagaattgctggaacccaggaggcagaggttgcagtgagccgagatcacatcactgtactccagcctgaacgacacagctagactctatctcaaaataaataaatgaataaataaatagataaatttttaaaaatataataaataaataaatcttattggaatttgttggcttgaggtccctggaagcattttgggtctctggccagaaaccaaccaattcagcaattgtggtatgtctggtgccccagtgtcaggagaacagagagagtaaaagaacaatggggtttggttccattctcttagagctgcagctgcacaaaattaaaagggaattcccctactccagtggtttggcttttgctgctgccatcacccctgccaaagggttttttatggaccagagcatgagagaatggagaaaaagtagaacaaaaatatgtgggatttttatctgtggcatttttctatttggccccttaattcagaactagaaagttttcctcaatgtttttctgtctctactcagttctcacttctgggtttgagatgcttagagttcatgcaggggaatactagagggaaaaataagggtaaattcatcgccagtttggtggtattctcatatcaaattctgatgtttttccctgataatcctgctgatatttatttgttggagtttttaaacagctgcccatgcatttgtccagattttatagttgtatttagtgtaagagaaaagtagtcatgtgtttgctccatgttatccagaactagaacccttcccttaatatcataacttcaaaatatagaaagcaaagcttaccagaactaaaagggagaatggaaacttttaaaattatagttggaaaccttaataccctcctctcaacaagtgttagacaaacatttagtaaaaataaaagatggagatgatataattagttgaccatcctatttttacttacacagggcactacatccagcaaccacagaatgcacattcatttcaagtgcacacacaagataaaaagcaaattccaggctgagaaaagatagttacgaagtatgtatcagataaggaattcatatccagaatatataaagtaatcctaaaaagcaattgggaggctgaggtgggcggatcacctgaggtcaggagttcgagaccagccagaccaacatggagaaaccccacctctactaaaaatacaaaaatagccaagcatagtcacacatgcctctaatcccagctactcgggaggctgaggcaggagaatcgcttgaacctgggaggcggaggttgcggtgagctgagatcgcgccattgcactccagcctgggcaacaaaagcaaaaactccatctcaaaaaaaaaaaaaaaaagaaaaagaaaaagaaaccactaaaaattggtaagagattttaaaggcacaaagcaaaagaagatatccaaatggccaataactaaaactaagactaataactaaataaataaaactaataactaaaactaagactgacaatagcaactgttggagaagtatgaagtaactggaactcttcatactttgttagtaagagtgtaaactggtaagaccacatgggaaaactttttggtagtttatttgttaaaaatttttattcatttatttttaattaggtttttttttttttttgagacagagttgcactcttgttgcccaggctggagtacaatggcatgatctcggctcactgcaacctccacctcccaggttcaagcgattctcctgcctcagcctcccaagtcactgggattacaggcatgtgctaccacgctcggctaatttttgtattattagtagagacggggtttcaccatgttggccaggctggtctcgaactcctgacctcgtgatccgcctgcctcagcctcccaaattgctgagattacaggcatgagccaccaccacgctggccttttaaaaatttttttgagatggaccttgtcctgtcgcccaggctggagtgcagcggcatgatctcagctcactgcaacctccacctcccaggttcaagcaattctcctgcctcagcctcccgagtagctgggattacaggcgtgcaccaccatgtatgggtaatttttgtatttgtatttttagtagagacgggatttcaccatgttggccaggctggtctcgaactcctgacctcaggtgatctccccaccttggccttcaactaaagtgctgggaatacaggcatgagccactgttcccggcctggtagtttcttatgaaattaaacagacatctaccctatgacccaacaactctattcatgagaatttactcaagagaaataaaagcatgtatctacaaaaagacttgtaacaaaaacgttcatagtggctttatttttaaaaaccaaaaaatgtctgtcaacctaagggataaacaaattgtagtgtgttcatacgatggaatactactcaatcataaaatgaaccaaccactgatccatgcaacagcatgcatctcacaggcattatgttaaacaaaaaaagccaggccaaaacagtataaactgtatgactgtatttatataacaggcaaaactaatctatggtaatacatgttggaatattggttacctttgagtggagggccacattgcctgggaagcggcatgaggcaaccttctgtagttatggaaatgttttttatttcgttacagatattgtattttttagttctggaattgccacttgattgccatctctatttctatgttgagattttactaccttttcattcattagaagtttaatttcctttatttcttgagcatactaacatacttataatatttaaagtccttgcctgccatttctaacatctgggtcatcttggggttggtccctccttgttgatttctctcttgatcatgggtcacattttcctgcttcttatatgtcatatgtaagtaatttgggattgtagcttggacattgtgaaggttatattataaatactttggattatgttaaatttatctgaaagttattgatttgtttgttgtagcaaaaattgatctgggaaggaaggaaggaaggaaggaagggagagaaagagagagtgagaaagaaagaaagaaagagccaaactgaacttctagaatttaaaaattcactgcaggaatatcaaaatacagttggaagccttaagaacagactaaaccaagctgaggaaagaattttagaggtcaaagactggtcctttgaattaatccagtcatataaaaataaagaaaaaagaattttttaaaaatgaaccagacctccaagagataagggattaaaaaagaccaaacctacacttcattggcattcccgagagacagtaagcagcttagaaaatgtatttgaggatatagcctgtgaaaatttccccagtcttgctagagaggtcaacatgcaaattcaagaaatttggagaactcctgtgagatactacacaagatgaccattcccaagacacaaaatcattagactttccaagttcaatgtgaaagaaaaatcttaaagacagctagagataagggtgagatctcttacaaagggaaccccattgggttatcagcagacttttcagcagaaatcttacaagccagaagagatctggggcctgttttcagtatccctaaagaaaataaattccaataaagaatttagatatacaatcatgtcatctgcaaacagggacaatttgacttcctcttttcctaattgaataccctttatttccttctcctgcctgatggccctggccagaacttccaacactatgttgaataggagtggtgagagagggcatccctgtcttgtgcccgttttcaaagggaatacttccagtttttgcccattcagtatgatattggctgtgggattgtcatagatagctcttattattttgagatatgtcccatgaatacctaatttattgagagtttttagtatgaagggttcttgaattttgtcagaggccttttctgcatctattgagataatcatgtggtttttgtctttggttctgtttatatgctggattacatttattgatttgcgtatgttgaaccagccttgcatcccagggatgaagcccacttgatcatggtggataagcttttcgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttaggcaggattccctctttttctattgattggaatagtttcagaaggaatggtaccagctcctctttgtacctctggtagaattcggctgtgaatctatctggtcctgcactttttttggttggtaagctattgattattgcctcaatttcagagcctgttattggtctattcagagattcaacttcttcctggtttagtcttgggaggatgtatgtgtcgaggaatttatccatttcttctagattttctagtttatttgtgtagaggtgtttatagtattctctgatggtagtttgtatttctgtgggatcagtggtgatatcccctttatcattttgtattgcgtctatttgattcttctctcttttcttcgttattagtcttgctagtggtctatcaatttcgtttatcttttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctatacactgctttgaatgtgtcccagagattctggtatgttgtgtctttgttctcgttggtttcaaagaacatctttatttctgccttcatttcattatttaccctgtagtcactcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggagtaggtgtggtgctgaaaagaatgtatattctgttgatttggggtggagagttctgtagatgtctattaggtacgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatcccttcaccaaaccccatcgtctcagcccaaaatctcctcaagctgataagcagcttcagcaaagtctcaggatacaaaatcagtgtacaaaaatcacaagcattcttatacaccaataacagacaaacagagagtcaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagtgcctgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaacaagaaatggggaaacaattccctatttaataaatggtgctgggaaaactggctagccgtatgtagaaagctgaaactggatcccttccttacatcttacacaaaaattaattcaagatggattaaagacttaaatgtttgacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaatctacggaatgggagaaaatttttgcaatctacccatctgataaagggctaatatccaggatctacaatgaactcaaacaaatttgcaagaaaaaaaaaaaaaccccatcaaaaagtgggtgaaggatatgaacagacacttctccaaagaagacatttatgcagccaaaagacacacaaaaaaatgctcatcatcactggccatcagagaaatgcaaatcaaaaccacaatgagataccatctcacaccagtaagaatggcgatcattaaaaagtcaggcaacaacaggtgctggagaggatgtggagaaataggaacacttttacactgttggtgggactgtaaactagttcaaccattgtggaagtcagtgtggcgattcctcagggatctagaactagaaatgccatttgacccagccatcccattacggggtatatacccaaaggattataaatcatgctgctataaagacacatgcacacatatgtttatagcggcactattcacaatagcaaagacttggaaccaacctaaatgtccagcaacgatagactggattaagaaaatggcacatatacaccatggaatactatgcagccataaaaaatgatgagttcatgtcctttgtagggacatggatgaagctggaaaccatcattctcagcaaactatcgcaaggacaaaaaaccaaacactgcatgttctcgctcataggtgggaattgaacaatgagaacacctggacacaggaaggggaacatcacacaccggggactgttgtggggtggggggagtggggggggagggatagcattaggagatatacctaatgctaaatgacgagttaatgggtgcagcacaccaacatggcacatgtatacatatgtaactaacctgcacattgtgcacatgtaccctaaaacttaaagtatagtaataataaaataaaaaaatgaaaataaaaataaaatttaaaaaaagaagtaaaaacctcacagcagcttatgttaatttttcaaacaaaaaatcatttattcacaagttacacaaaatattttttttactgtttacctgacatctaaagtaaaagcagaataaaataaacttctcaccaatagttaaaaaaaaaaagaatattctgccgaactaaacttcatatatgaaggagaaatgaaatctttttcagataagcaaatgctaaagaaatttgttacttctagaccagccttacacgaggtccttaagggagttctaaacatggaaacaaaggaatgatacctgccagcacaaaaacacagttaagcccagaaacatacgtagcctagagatcctctaaagcaactacataattgaggctacaaagcaatcagctaagagcatcatgacaagatcaaacctcacatatcaatattaaccttttgttaattgtctaaaatgccccacttaaaaggcacagagtggcaagttggataagtaaacaaaacccaacagtctactgtcttcaagagactcatctcacatgtaacaacacccataggctcaaaataaaggaatggaaaaaggtctatcacacaaatggaaaactaaaaagagcaggagtctttatatattctgttatatcagatagaacagactttaaaccaacaacagtaagaaaggacaaagaaggaaattacataatgataaaggattcaattccacaagaagacctaactattctaaatatatttgcactcaacattggagcacctagattcattaaaaagtacttctagacctacaaaaagacttagagagccagacaataatagtagggtacttcaacacccccgctgatagcattaaacaaatcaccaaggcagaaaactagcaaagaaattctggacttaaaactacacttgaccaattggacctaacatcaatctagagaatactctgtccaaaatcacagaatacacatttttcttgtttgcacgcagaacatactcttaagaccaaccacatcagccataaagcaagcctcataaaattaaaaaagaatcaaaatctgtccaggtgcggtggcttacacctgtaatcccagcactttgggaggctgaggtgggtggatcacatgaggccaggagtttgagaacagtctggccaacatggcaaaaccccatctctactaaaaatacaaatattagccaggtgtggtggcacatgcctggagcccccgctacttgggaggctgaggcacaagaatcacttgaacccaggaggtggaggttgcagtgagccaagattgcaccactgcactccatccggggttatagagtcttcaaaaaaaaaaaagaatcaaaatcatatgaagcatactctcagaccacagtggaataaaaatgaaatcaataccaagaagatctcaaaagcacaccattacatggaaattaaataactgctcctgaatgacttttgggcagataatgaaattaaggcagaaataaaacaaattctttgaaattaatgaaaacagagatacaacataccaaaatctctaggatgcagcaaaagcagtttaagaggaaaaattgtagtgctaagtgcctacattaagaagttagaaagatctcaaattaataatctaacatcacacctagaggaactagagatacaagaacaaacaaaccccaaagctagcagaagaaatcactaaagccagagcagaatggaatgaaattgagaccaaaaatccataaaaaagatcaacaaaagcttgaaagcttgaaaccttgaaaggaaacgttggttccttgaaaggataaacatgactgatgaacttcaaaagtaaccttggttccttcaaaggataaacatgattgatgaaccactagctagattaacaaagagaaaaaaaagatccaaataagcacaattagaaatgacaaaggtgacattacaactgatcccacagaaatacaaaagatactcagagaccattatgaacaaatctatgcacatcaattagaacatctagaggaaatagataaattcctggaaacacacaacctcccaagattgaattggaaataaaatgaaaccctgaacagaccgataatgagttctgaaattgaattagtaataaaagaaaaaaaaacataacaaccaaaaaattccctggcccagatggattcacaatcaaattctaccagacatacaaatcctcaacaaactaggcattgaaggaacatacctcaaaatactaagagccatcactgatgaactcacagccaacatcatactgaataggcaaaagtgggaagcattccccttgagaactggatcaagacaagtgtgcccactctcaccactcctactcaacatagtaccagaagtcctagccagagcaatcaggcaagataaataaataaaaggcactcaaataggaaaagaagaggccaaactatctctcttcatggatgatataattctgtatctaggaaaccctaaactggaagacagctagaactcataaacaacttcattaaagtttcaagatacaaaatcaatgtacaaaagtcagtagcatttctatacaccaataacgttcaaactgagagccaaatcaggaatacaatcccaactataatagccacaaaaatattttaaaatctaggaatacacttagtaaaggaggtgaaagatctctacaaggagaaacacaaaacactgctgaaagaaatcatagatgatacaaacaaatggaaaaacatccatgcttttggattggaagaatcaatattgttaaagcagtctacagatttaacactattcctatcaaactaccaacatcatttttcacataattagggaaaaaaaaactattgtaacccaaatggaggctgaatagccaaagtaatcctaagccaaaagaacaaagccagaggcatcactttacctgatttcaaactatattacaaggctacagtaatcaaaacaacatggtactggtattaaaacagatacatagaccaatagaacagaacagagaacctagaaataaagccacacatctgcaatcatctgatctttgacaggtgacaaaaataagcaatggggaaaggactccctattcaataattggtgctgggataaatggctagcctatgcagaagaatgaaactggacccctacatttcaccatatacaaaaatgaactcaagatgaactaagaacttaaatgtaagacctcaaactatagaactcctataagaaaacctgggaaatacccttcttgatgatggctttgggaaagaatttatggttaagtcctcaaaagcaattacaacaaaaacaaaactcggcaaatgggacctaattaaactaaagagcttctgcacagcgaaagaaactattaacagagtaaacagacaacagaatgggagaaagtattcacaaactgtgcatctggcaaaggtctaatatccaggatctataaggaagttaagcaaaccaacaaataaaacacaaataaccccattaaaaagtgggcaaaggacatgaacagacacttctcaaaagaagatttacaagcaactaacaaacatatgaaaaaatgctcatcatcactaatcatcagagaaatgcaaatcaaaaccacagtaagataccatctcacactatggctatttaaaacttttaaaaataaatgctggcaaggctgtggagaaaagggaatgcttatacactgttggtgggaatgtaaattagctcagtcactagggaaagcagtttggagatttcacaaagaaccaaaaatagaactaccattcaacccagcagtcccattactggatatacacccaaaggaaaataaatcattctgccaaaaagacacatgcacccatatgttcatcacagcacttttcacaatagcaaaaacatggaatcaatctaggtgcccattaatggtggactggataagtaaaatgtggtgcatcatcaaaaagcttatccaccacgatcaagtcggcttcatacctgggatgcaaggctggttcaacatacgcaaatcaataaacataatccatcatataaacagaaccaacaacaaaagccacatgattatctcaatagatgcaggaaagaccttcgacaaaattcaacagcctttcatgctaaaaactctcaataaactaggtattgatggaacgtatctcaatataataagagctatttttgacaaacccacagacaatatcatactgaatggccaaaaactggaagcattccctttgaaaaccggcacaagacaaggatgccctgtctcactactcctattcaacgtcgtattggaagttctggccagggcaatcaggcaagagaaagaaataaaggtattcatataggaagagaggaagtcaaattgtctctgtttgcagatgacatgattgtatatttagaaaaccccatcatctcagcccaaaatctccttaagctgataagcaatttcagcagtctcgggatacaaaatcaatgtgcaaaaatcacaagcattcctatacacccataacagacaaacagagagccaaatcatgagtgaactcccattcacagttgctactaagagaatcaaatacctaggaatccaacttacaagggatgtgaaggacctcttcaaggagaactacaaacgactgctcaaggaaataagagaggacataaacaaatggaaaaacattccatactcatggataggaagaatcaatattgtgaaaatggccttagtgcccaaaatattttatagattcaatgctatccccatcaagctaccaatgactttcttcacagaattagaaaaaaacttctttacatttcatatggaaccaaaaaagagcccgcatagccaagacaatcctgggcaagaagaacaaagctggaggcatcatgttacctgacttcaaactttactacaagtctacagtaaccaaaacagcatggtactggtaccaaaacagagatatagaccaatggaacagaacggaggcctcagaaataacaccacacatctaccacaatctgatctctgacaaacctgacaaaaacaagaaatagggaaaggattccctgtttaataaatggtgttgggaaaactggctagctatatgcagaaaactgaaactggaccccttccttacaccttatacaaaaatcaactcaagatggatcaaagacttaaatgtaagacctaggaccataaaaaatcctagaagaaaacctaggcaataccattcaggacataggcatgggcaaagccttcatgactaaaacaccaaaagcaatggcaacaaaagccaaaattgacaaataggatctaattaaactaaagagcttctgaacagcaaaagaaactatcatcagagtggacaggcaacctacagaatgggagaaaacttttgcaatctatccatctgacaaagggctaatatccagaatctacaaagagcttaaacaaatttacaagaaaaaagcaaacaaccccatcaaaaaatgtgcaaaggaaatgaacagacacttctcaaaagaagacatttatgcagtcaacagacatatgaaaaaatgctcatcatcactggtcattagagaaatgcaaatcaaaaccacagtgagataccatctcatgccaattagaatggcagtcattaaaaagtcaggaaacaacagatgctggagaggttgtggaaaaataggaatgcttttacactgttggtgggagtataaattagttcaaccattgtggaagacagtgtggcgattcctcagggatctagaactagaaataccatttgacccagcaatcctattactaggcatatatacccaaaggattataaatcattctacgataaagacacatgcacacgtatgtttattgcggcactattcacaatagcaaagacttggaaccaacccaaatgtccatcaatgatagactagattaagaaaatgtggcatatagctgggcacggtggctcacacctgtaatcccagcatattgggaggctgaggtgggcagatcacgaggtcaggagatcaagaccatcctggctaacatggtgaaaccctgtctctactcaaaatacaaaaaattagccgggcgtggtggtgggtgcctgtagtcccagctatgttgggaggctgaggcaggagaatggcatgaacccgggaggcggagcttgcggtgagctgagatcgagccactgtactccagcctgggtgacagaatgagactccgtctcaaaaaaaaaaaaagaaagaaaatgtggcatatatacaccatggaatactatgcagccataaaaaagaatgagttcatgtcctttgtgggaacacgcatgaagctgaaaaccatcattctcagcaaactatcacaagatcagaaaaccaaacaccacatgttttcacttattaagtgggagttgaacaatgagaacacatggacacagggaggggaacatcacacaccggggcctgtagggggtggggggctaggggagggataacattaggaggaatacctaatgtaggtgatgggttgatgggtgcagcaaaccaccgtggcacgtgtatacctatgtaacaaaactgcacattctgcacatgtaacccataacttaaagtataatataaagaaaagaaagaaaatatggtgcatatacaccatggaatactatgcagctataaaaaaagaacaaaatcatgtcctttgctgcaacatggatgcagctggaggccataattctaagagaactgatgcagaaagagaaaaccaaatactgcatgttctcacttataagtaagagctaaatattgggtacacatggacataaagatgggaacaagagacagattataagtggggtgaagtagggaggagcgcaagggttgaaaaactacctattgggtactatgctcactacctagatgatgggttcaattgtactccaaacctcagcatcatgcaatgtacccttgtacaagtctgcacaagtacccactgaatctaaaataaaagttgaaaaaaaaaaaaacattaggttaattaagaagagaatggagaaaggcagagggcaggtcttagcatggtagaaaattttaaacagcaattaagaaataaggtgcttggccaggtgcagtggctcacgcctgtaatcccagcactttgggaggccgaggtgagcagatcacctgaggtcaggcgttcgagaccagcctggccaacatggtgaaaccccatctctactaaaaatacaaaaaaaaaaaaaaaagaaagaaaaagaaaacatctgggcgtggtggtggcacatgcctatagtcctggctacctgggaggctgaggcaggagaatcacttgaacctgggagatggaggttgaagtgaaccgagatcacgccattggactccagcctgggcaacaagagtgaaattctgtctcaaaaaaaaaaaaaaaaacaaaaaagaagaagaagaagaaagaaagaaggtatgtaaagcaaatattgacagaagcaaaaaaagaagaaaaagaaagaggagtcatgggacttgtcccagcagggtggaaagctttagatggttattaagaagtgggatgaataaaatggatattgatggattaaaacaaaggatttaacacagcactaccaaaggttgagcaggcccaagggaacccctgctggtccctcaacattaaagggttccaaataagcctgctctatttactccagtttggagaaatttaaaaagccaaaggcaaagtttatcatgagaaacctgaccagcaatcactgtgacagttgttagcaggttcatcaagatgaagattgacaaaagggtcacagtcccttggctctaccccttctcagtggagacccaaagccttatgcacatcagtaggtaaaatggtcagcggtgggggcagtgtggagaaaagattactgggactcaatacaggagcccccagcactgtggtaccaaaacccattgatgaagccctgaggcaggctgcagttagaatgagggaaccgtaaaaggtaagggtttataggatcatgaaaggtggaatgtttaaacagactttaggtaaagctgtgtgtcctttacctgaatgttttatgggaatggatattacatccggctggggaacacttttttgagatggagtctcgccttgttgcccaggctggagtgcagttgcacgatctcggctcattgcaacgtctgcttcccgggttcaaatgattctcctgcctcagcctccccagtagctgggattacaggtgtgcaccaccacgcccagctaatttttgtatttttagtagagacggggtttcaccatattggccaggctaatctcaaactattgacctcaggtgatccacccaccgcaacctcccaaagtgctgggattacaggcgtgagccacgaagtccggcctaacacttcttaatacctagtattgtaacaccaaaacctgttaattaagtcctaatggaggccgcagttagggatgtagtggttgatggaattaaagtctgtaggcgaattggtgtttttcagcaggcttcgtgagaagtgcttgcgtgcgtctcttacctgattgtattatgggaatggacattgtgtctgcgtggggaatgtttcccctacctagcattgtaaaacagaagcgcgcagcacttcaatcatcagtgtggagagcgttcttagaggtcaccggtgtggaagctgaggcttcctcaccttgcttcccctgcaccacactgcagaggccaacacctatttcttattaggtcacagttctctcagcaggtgaggcattaatggccaagaaaaagaaaggatgagaatacaatcatgaataagtctagcaagggaaatatttttaggtgtttttattattttttattttttattttttatttttttgctctggaaactgttagtccaaactgcaccattttgtaaccccccagccatttcgcagacctcggtcaaagtgaaacattccacaggggttcgggctgtgacaaacagcctgcccaaccgcttgactctcttattatattctgctggaagaaagtgtaaggaacctcacactgcactggaacaggcaccaaactgcctaatcatgggaacatgttatcaacattttcccaggcagcaggccatgccccctgttccagacccctcccacctagcctataattgccccagcctgtaagtggcgatggccattggcattaagctgcaggtcttatgctggacataaagccggcatttgctgtaaagccaccactctctctctttgtgtctttctttaaccctagccttcccttcaaaacccaacaaaaactatttataagacaatttttcttcatcctccagtaagaacctaattttttgtttgtttgttttggtttggttttggagttttttgtttgtttgagacaaggttttactttgttgtccaggctgaagtgaagtggtgcaatcatgactcactgcagcctcgatctccccgggctcaggtgattctcccccttcaacctcctaagtagctgggattgcaggcgtgtgctaccatgcttgggtaatttttgtattttttgtagagatagggttttgccatgttgcccagactgatcttgaactcctgggctcaagcaatcctcctgtgttggcctcccaaagtgctgtgattacaggcgtgagccaccatgcctggcctaagaacctagtttttggacaactatgaaagtgctgttttacataataggatgtagacatgtaataattcataacacctgaagggggcacaggcaaaaaatataaagaaaattgagaatgactggatatcatatctaatggtgccacatttgtgtctaacatctttgacattgttctcagcaaatccctgggaatcagctgttgagctagatggagatgggaagaggataaagactgagatagatggctgggcacagtggctcacgcctgtaatcccagcactttgggaggccaaggaggatggatcacctgaggtcaggagatcgagaacagcctgaccaacatggagaaaccctgtctctactaaaaatacaaaaaaaaaaaaattagccgggcgtggtggtgcatgcctgtaatcccagctacttgggatgctgaggcaggagaatcgcttgaacccgggaggcagaggttgtggtgagccaagtttgcgccattgcactccagcctaggcaacaagagcgaaattccatcaaaaaaaaaaaaagacttggatagttgtattatatctattaattctaacaggttgtggagaagcttggcatgaaaatcatgaggcataatgaagtttgtgtgttatttccagattgttcttaccatgttgttaagtcatagatgaaaacaagcaatgtttgaaggatagtcccaacctccaggtgtacctaatcctgatgaagccgatgctgttagcaccctcccatatccctgggccttttagaattttcagttgatttccaactgtcagtatttgtacctctgtacctgcagccccttttccttggaaatatgtgttgcttatttgcaaggcaaaccggagtagcaaagaattaacaccccccaaagccctacaggcagatccctcaaccaacggctctcaggagttgatgtataaatgccccagctccttgtaccttgggcagaataattctgtggtgtgggttttgcaccattcctagaagttttcttgcaaggttgagctcaggtgcccactgtggtagctggctcggtgacacgttttattggctgtcctactgtccctgtatcatccagccacctcatacgagcgttccaaaataaactacccacactggaaaccttgcctcaagttctgcttctggggaaccaaactaagacaacttgaatgtgaggtctcccatgggacatctcttgcatcctagtcataaagagaacactgggggaatacattcagggaacacgtgagcgtactatttcttgtttttcaaattacctgaaagtgatctcatctagatgtactttattgttgaagtagtgacattgaaggggctagtgattagatgaaattcatgcatgtgagggaaagcccaaaataaatcattcctgagcaaagtgaacatctgaagagcatcctggatggcccacatgcagggaggataataaaaatatttaacacctggtacagcatgggcctcaaccagtcatagaagctgctggcctacctgctaagggcctgccacacaaactgaccattggccctgcccagtgaaacaaggattcctggtgctgcctgggtcaaatattcaggctgggttgagaggtcagtgggcaaagaaggatttacttggctttctccaagagggctcagaggcaggtgtgtatgattttgattccttctcagaaacagaagtgatggactgaaacattcattgaacatctccaaagggagttaaaggcccagcagggccacagtgtcacacgtccactttacactccaacgtgttatcacttgtgtcctctcctgactatggaagtaaaggccacaaacagcacacagtttccttccagagagttgtctcttctccattgtaggtagtgtgagcaagaccaaggtagcaaaatagccaaagggtaggtttgtatgtgacccaagataaatagctccgaacctctcctggcactatgaaagtgacgcagaatgaagacataatcagaaacaggtgtttggagtacatatatgaggatactggtgagggtgctaattcatttgcttactatggatgctgtaaagtatggttaacccattcctgctacccagaccccagagttgcctggtgtctcttcatctccttgaccttcttagtttgttctgttagccttccagtaatttctttttaatgcttaaaatttctataagtggttacttttgcttgcaaccaaagaaccataattgatttgggtcctacatgcttatcttcagccatgttttgtgagggatggaccccgtgaaagaaagcgtgtggcagcaactgctgaaaataagaaaagccagtccctggatcttcacagacaaaagaaaacacaggaggttgctgtgggtttgaaggacttggtgtatctaacttgaatgacagcttcacctcagttggctctcagtttcccatgaagctagaattccatccctatttcttccattgtcccatggattggctggcttacgagtcaggaacttctcataagcaaagcctgagggctctgggcagatactggaaaaaagacaaaggctcgggtaaggcttacttaacttgttagcaattctggtagacagggagtaggtgggcattggaatcacaggctaaaatgaagcctggctggaatacctagggaccatttgccatgatattcacatttactgcaaagtaattatatatatgtctatgtccgtttcctaggaaccatattgtgaactggatggatttcttttatttttctttccttttttcaatgcttattttcattcagaaaattgggaaatgaattttctttcatgattttaatcatttctttgccagtgttgtatacaacacattcacgtaaaactctcaaaggcggccatctgagcactctgccaacctggcccacccacagagctttgcctagaagctttgtcttttatagaacttagctcgagcaatgatatcattgacgaagtcattgtctatgtccgatggggtggcaatcgcttcaattcctgacttaaaagctgagagaccacctgaaatgaaacacagagaattaggctcaaatattaactttcaacagaaataagcaatgagcattgccaagatgttagctttccaggcaaatcttccaaagcaggcagtcccaaatcctcctccctctccctccctttctgaaaggacgtgctatcccaagaatcactgggaaaattccagattgctttctttctctttttccaaagtctttggtttttcttgttgcaaaaatcagatttgcttttttatgtaatccaggcctggcagaactagactcccagtacatcctctgctgaaaatgcttgtaacattctctcatttattcaataattcactcatctattcactcactcatttattcattcaggaaatgttttcaagcacctactatgtgccaggagaggtgccacactgactgcaaggtacccaagacacacttatttctttgggtatgtgtacatatgcatgtgtgtgctattttaccctagaattttatctctagtagttatgtatgtgtttaacataattgtgctctgctctgatatccagagaggaagatgcctggtcctgatccctgccttcaaggaccttgaagtagagactagaaactgttctgattaaggccgttagagtgtggaggacataacattggccaataggaggcaaacctaataggaattgatgtggttgggtgtgaagagagaaggaaccagagagcctaagaaagcaatctggttttcaggctgggatgactggctatattatggtgcctccaagacatgtaaaatgcagaagaaagagcaaatttatagtgggaagttagtgagttaattccatctgggagatgctgaacttgagggggcctgtggtcagccaagcagagatttccacttggatatatagcacctgaagtcccgaaaatactcacagagtaacattgttcagacaatttggaaagttgttgacagtttcttataacaggaaaaaacctatgagaggtaggcaaacagatagatagatagatagatagatagatagatagatagatagatagataaatttttttttgagagatggggtctcactctgtctcccaggctggagtgcagtgatgtaatcaatgctcactgcagccttaacctcccaggcacaagcaatcctcctggcttagcctcctgagtagctgggactgtgtgtcaccatgcccagctttttttttttttttttttttttttgtagagacagggtctcactatgtttcaaggtatcactcaatagctcagtaagcaatgaataagaaccccaacattctgcagaagaggaaatggaggttgaggatggaggacctctcaaagtaactcagtggttcagggaatgcaaatgcagcctctagacagctcctcccagggccactgctgaccccgtggaaatgctcccagggagtctcgggtcacactggccttcagtggtctcattcattgctcatttaaacaaagtactcagaatacagcctacctttgaggtgctgagcaacactccacgtggggaattttttctggattgccttaattctctctgttagaatcccagtagcctgtgaaaggtgctctttgctatcccaggcaccgacagggtggtacgtttgtttatcaagctagaaaattcagataataaagtcagcatctggatgaggtaacacattttttctgccattcctaatttcctctcctggtattcaagtcatagataccggcctttatccccaaagagtcaattctattgttctttctttcatatagatgagagtcagagaaacaaagtaaggtttgggagaaatggacatggtatagttttagctaaacattctaatatacaaaaaaaaaatttaagttgttttgaaacaaataacacccaaagtctacacatttatagtaataaataattatccagctaattcagataaaaatttgtttctaactgggaaggccagaagtctgtatttctacagacaatttaaaatcgagcctggaagcaaatatccagataatttggatccccttcctccagtttacccaaaggaacaagttgtttcaagtagggcacagttataccatgttttgatccacatggatgaaatttactacttcatgaaccccaagaggacacctgtaacaataatgctatttataagattttctcagttttagtgtattacatattatttattgcagaatggtagttatgaaactcctaaaatactttttaaaatatatctaataatgaataagccttgaataaaataaaaagatgtgttacagaaatcccagatcaaattatgctggagtggccgggcacagtggctcaagcttgtaatcccagcactttgggagactgaggtgggtggatcacctgaggtcaggagttcaagaccagcctggccaacaaggtgaaatcccgtctctactaaaaatacaaaaaattagctgggcatggtggcgtgtgcctgtaatcccagctactcaggaggctgagggaggagaatcacttgaacccgggagtggaggttgcagtgagccgagatcacgccattgcactccagcctgggtaacaagaatgaaactccatctcaaaaaaaaaaaaaaaattatgctggagtacctgtagccagatgccagggtattttggggcttggaagcactgcaaatggatttctagttcaggttgagcttctgtgaggagggatgcagtggggctgatagaaagtttctagctaaatacctgcatcaagccaaatttaagtcccctgtggtcccagccgtcttgcaggacagatccgccatggctttccctggagatgatggctgcgatgacagcagggtccacgcaatgtctctgcccgacttctttgatcagagtctggtaaggttttatggccctcaaatccatctcagcaaacatttcagaaccacggatccctacgtcaatagaaaagaaactgtttttccgggcatggtagtgtgtgcctgaagtcagttcctgctacacaggaggctgaaacaggaggattgcttgaacccaggaggagttcgaaaccagcctgggcatcatagtgagagcccatctctaattaaaaaaaaaaaaaaaaagaatttaaagttaaaaaaagaaaagaaactgtttcttctacttcagaagaaaaccatttttaaaaatttgctaagttagccacagcctctgatcactgctaatgacttgggacaaccattctaagacatccttttgatctctgactgcagaaacaaacagatccacaacccccaacaggtgtcgcttctgctctgtttctccttcaaattgctcatgcctgtaatcccagcactttgggaggccgaggtggacagatcacttgaggtcaggagctcaagactagcctggccaacatggtgaaaccccatctctactaaaaatacaaaaattagctggacttggtggcaggcacctgtaaccccagctactcaggagactgaggcaggagaatcgcttgaacctgggaggtggagattgtagtgagccgagatcatgccatcgcactccagcctgggtgacaaagcaagactctgtcatacacacaaaaaaaattctgccacactagtgcactgggaagcctgttgtactaggagttagccaatgcatgttttagcctggctccgccactagttggttctgttctattgggaagtattcccctccttgctgagtctttgggctctgatttgtaaatttgaggggttggggtctgatgtgaccttgtggttgctgccagctccgacactctaaaaccaggataacgtgatgaagacgactttggaacagtattgcttcaaatggtcatgtgtaacatgaagcaaacacagcagcaccacccaaaaaacaaagccagagtctaatatttattcaagcagtagtttcaatacatggaaataaacacagctggacaaagtttggaaagaatgggggtggaaaatgaaaagaagctggttgttagattggtcaggattgtggtttttgctcatttttaattttgatactattgtcataatgatgattataccttttcaaaattaagtgacttcctaagaaagaatctgaaaacgatgaaagggggaagccagtcatttgctctgcttttcacttaccgcagttcatcacactgtttgcatcacaagtggccccagaggtcttcatggtcatgatgtccccatagcagccgtggtacaggcgtggatgtaggtgaggcttcattgagtgactgaaggggtatgagcccctggaagtgcctaggaggcagaagtgtaactcacatgaatcctctgagaagatattacttgggttgctgcaataaacatcactaaaccaaaggcagaaggccacagacagaactccccaactctcttgttgccattatttgttcctcagacagaagttccccatgcccactctgctccgatcttttgttttgttttgtattaacacaggacgtaatctgaaaactctatgcaaaatattatgaaattcatctcttatagatcctaaatacatgtgcagtctttttttttcctttttttaagagacaaggtcttgctctgttgtccaggctggagtgcagtggcatgatcatagctcgctgcaggcaccaacacctgggctcaaactatcctcccaccccagcctcctgagtagctggaaccacaggtgcatatcaccaggactggcttattttctctttttgtagagatggggttttgctatgttgcccaagctagtctcaaactcctgtgctcaagcgatcctctctccttggcctcccaaagtgctgggattacaggcactgtagtcataccatgctctatgtcagaattaaaactgacaggtttttaagcaggaaacttgagagttttttttttttttttaagattcagggggtacatgtgcaggtttgttacgtgggcatattgtgtgatgctgaggattggccttctattgatccttcacccaaatagtgaacacagtacctgatgtgtagttttcaacccttgcctccctaccttcctccctccctccttccttttacagtccccagtgtctattgttttgagaggaattttaaaacatttctgacacaaatgcctctggagatgtgaacatctagattaacaatttgcctttcttaagccaaaattgacaaatggggtctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagaaaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacgtatgtttattgcggcactattcacaatagcaaaaacttggaaccaacccaaatgtccaacaatgatagactggattaagaaaatgtggcacatatacaccatggaatactatgcagccataaaaaatgatgacttcatgtcctttgtagggacatggatgaaattggaaatcatcattctcagtaaactatcaccaaggacaaaaaaccaaacaccacatgttctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaaataaataaataaaattcaaaaaaaaccaatttgcctttgtttagaaagataagaaagaagggcaccataacaatttaaatatattcttattatatatcatttactgtgaagttgagttcctatgtatatttaataaaattagaagtaaaaattgaatttgccaaaataatttaagtcaaatctattcttgtctttttgttctgtcattaaaaagtgaatttctgtccaagtctacctgttacaggagaggcagagcttttgctaaaggagatacaaagttattttctgtaatgttgaaaagtttgttctaacggtttcaaggactgttaacttgtaccttaagagtccaaatatttgttataagacagtacttagggctggatgttgtggcttatgcctagaatcccagcactttgagaggctgaggcaggacgattgcttgagcgtaggagtttgagaccagcctatgcaacatggcaaaactcatttctacaaaaaatacaaaaattagcctggtgtagtggcacatgcctgtagtcccagttgcatgggagactgagacaggaagattgattgaacccgggaggtcgaggctgcagtgagctttgatggtgccactgcactccagcctgggcaacagaacaagaccctgtctcaaatctcaaaaaaaaaaaaaaggattttgttaaaatgtttgatgtaaaaaaaatagaatctggttgggcgtggtggctcacacctgtaatcccagcactttgggaggccaaggcaggcggatcacctgaggtcgggagttcaagaccagtctgaccaacacggagaaacccatctctactaaaaatacaaaattagccaggcatggtggtgcatgcctgtaatcccagctactcgggaggctgaggcagaagaatcgcttgaacccaggaggaggaggatgcagtgagccgagatcgcgccattgcactccagcctgggcaaaaagagcgaaactctgtctcaaaaaaaaaaaaaaaaaaaaaaaagaatctaaccacttctcccacctctgcttctgccatagtcccagccagcatcattgctcatctggactctcctaacagccttctaactgacctccctgattcactcttgcagcccatcctctacttagtagacggagtggccctgtgggaatatgcatgggctgctatcagtcttctctcttaaccttccagtggctttctcctcctttaggggaatagccaagtccatcctgcagcctccaagacctactagatgtggccctctgctcctgttcctacttctctttccctttgttcactctcctccagccacattcttctttgtgcttatccttcaacatgccaggcaggtttctgcctcaaagcctgtatgtttgtggtcccttttgcctagaatgctattcctcctggtatctacatgatcatgccttcaggtctctgtccaaatatcaccttatcagcagaatatatagcgagtttatagacaaaaaaagaaaatagtccttaaacatataaaagacgttaaaccacactcaaaagaagagaaaggccacattaaaacatcattataacagcattttccaactctttttttttttttttttttgagacagagtcttgctctgtcgcccaggctgcagtacagtggtgcgatcatggctcactgcaagctccgcctcctgggttcatgccattctcctgcctcagcctccccagcagctgggactacaggcgcctgccatcacacccggctaattttttgtatttttagtagaggcggggtttcagcatgttagccaggatggtctcgatctgctgaccttgtgatccgcccaccttggcctcccaaagtgctgggattacaggcgtgagccaccacgcctggctgcattttccaactctttagttggcaagagcccaaaggtttggcaataccctctgtgggagaggttgtgaggaaataggctgtcacacacattgctgtggaacacagttttgtgataggctgttcattccagcactgttgataagagcaaaggactgcaaacaacacaaatgtcattaatttagggactggttgagtaagtgatgctacgtccacagtggagcactatgcagctgcaaaaggaaagaataagacctgtatatactcctgtaaaattctctccagggacaaaatagtatttatagaattgtactctttgtgtaagaaaggtaagaaaatacaatcgtatattttgtgtgatttgctcatattttcaaaagaaacaatacaaggatgaatgaaaaactgataaaaattgttagttatggagagagtaagaggaaggtaaagggaacagggataggggatagactaactatcttttttaaagtttttattttggaaccatgtaaatgttatcataaattttaaaattaaatcaaatggggaaaaatggaatcataaaaaagaagaacaaatgaacataactctataacaaattgaaagattaataaacacatagaggagaattatcttaagtgactttaaaatatatccatataagtctataccactacataggaatccatcctgtgaacataaataatcacaagaaaatcttaaattatatttactgtctcattgttggttggtaatactgtcatacttattttgacactattgtatgtaaataagtaataatgctaatgtcattagaactaggatttttagtgtaagatagcagaggtacaaatataaaactgatgtaaaatgcttgcattcttaaatataaatgtgaaatatctgaatgcatagttgttttccttttaaaaatatatattttctagttcctgccactgaaaacacctgaaataaacgacagctccatagcaatggagcacttttacttcccacactgtggtctctaaataccatttcctgctaagtggaaccagcgctcctcagaataatggctgattgcctgcctggggcaggaaatgttcaagatgaaccaggaacatctttttgtgccagagctggtccttatatgttagagacacattaaaaaaaaaaatttttttttccagatggagtctcactctgtcgcccaggctggagtgcagtggccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctcactgcaagctccgcctcccaagttcatgccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctccctcccttcctctcactctttccctctctcttccctttttcctctcactctcttactgttcgttcctctcactagaagataaatttcattaggtcagatactagatgtttttctctgctatatcctcctcagcacctggaacaatgcttggcacaaagtagacatttaataaacatttgctgaatggaagaatggatagttggatggatgaaggaatgagacagaaagggattgtttaaattatctggatcaagtgtccttatattgacaggttcagtatcctttcactgggaggcagtctttgccaggctcactgtgtggcccacagaccacaggcatcaaagttacccaggaagcttattaaaaatgcttatcactgggccgggcgtggtggctcacacctataatcccagcactttgggaggccaaggcggacggatcacgaggtcaggagatcaagaccatcctgggtaacacagtgaaaccctgtctctactaaaaatacaaaaaaattagctgggcatgatggtgggcgcctgtagtcccagctacttgggaggctgaggcagaagaatggtatgaacccaggaggcagagcttgcagtgagctgagatcgcaccactgcactctccagcctgggcgacagagcaagactctgtctcaaaaaaaaaaaaaaaaaaaaaggcttatcactgggcttttcacaccagatctactgcaccaaaatcttgcagtataaggcgaaagaagctgccttttacccagcattcccagttgactcttacacatgtttatgaaccactgctttaagggaactggaatatgaccatggaccctacgctgcctgtgtaggccttataaacacacaagccctttttaaattaagagtcacctttcagctatacacagctaatatggtagctcataattaatctactggctatttaactctgctctcacctggcaatctaaaaagagtaaaaatttaaaactatgttgccctgttttgaccataagtaactggaaattactttcgggtagccttgtttttccaaatttagaattaaacattttagaaacactttcctttcagtcaccattctataattaaagacaacttgaacattgctcataatggcttttcattttgcttaggtcagagttttcacattctcttattcaagatcccttaccaacttaccaacctatctttccagccttccccccagaaaccccctcgtctgtccagaccacactgacccaaagacttttcattcatttctgcctctgcttttttactgaaatctttcttcccatccagcaggctcttcctttttcttattaaatcaccaagcatccttcaattgacatgtcccccccaaaagcctttcacatctgagcattctagttggatgtgagctcttcctcccaaacctttcccagactagtgcttttttcccacctatacacattgaactctcatccactgcttggcattgataattgtctcttcatgtgttttgcttccaaggcactgttccatatacctctcggtaaggtatccagcctgataggtgcattgtcagacaggaagtaagcagatcaataaatattagattatttgaaattcccatagatcctgtttttcacctgcttagcaagcagaacacactgttaattatagaaataatagttgattaatggccaagctggtcagaatgagagcccactcttccattacaggtaatcattgctctttctgattcatgattgtgctggaggtttttgtggacaccctgtgaacaatgctaaatctcagccagtgacttaccaatgagggcaattagtccccaaaacaccacggaggataacatggcggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttacaaagcgacggcctttgtcctgtaacataggcttaacaattggagaatccattagtcagtagatcactgcgcacctggcttcaacagagtagacatcagcgtggctctactgctgtggaggaaacttttaaacaccagcatgaagactcacctggcttttcttaccttcgtcctgtaccaatgatcattagaggagctttatatatggtttaaaaccctctctttaaaccattgacctcattaggcctggttataatagtacttaggacttaggtgacccaattaataagaggatttcaaagggcttattaaccactattaattaattaacctaatgaacccccaagttgctcaggaggcatattttgatagattgtttctagatatctaaaattgtgccaaacagcttctaaatttgcgaataagaaacagataattcactttaaaaggataacaggaaatactagcaatttttattcttggattggttatttacctgaaatattgggtctcctgctttttgttcccattccaatgtcatatgatccccgtaccagtatgtcacatgatctcaaaccactatgtcacatgatcatgataggtgaacttggctccttactccaatcccacttctgagaaaaaggtgcaagtgtggccacctgctctaggagatcaatgcaaaaccagggagtagcaacgtgagtgctcatttgcccatacttgctaaggatatgggaaaaaagattatagccagggatgaaaacttcttcaagaagagagtatctttcttcaggcttatgtccaaaggaagagaggaagcatattgtgcagccccaggaacaggaaatggaagggacgttcttgaaacaggcaaagcacattgcgctgaggggaggaagaagtctggtctgggtccttccacaagcgtgtccagtttctcagactgcacacagtcctcccccacatccactgagtgaagaaaggtggaaggcagctgtacagggaacaggaagacaaaaccacaggcaacttcccagctccctggcaataaaaccacctccactcccaggagaacatgccctccccaagctgaggtctgcacagtccactggcattcacttctgccctgcctgccttcctgcttgtagaacagacgtctctggcatggcctctagccttccatccctggaagagtggcagggctgttctgagccaatggatgattcctacctgactctcaggaaagtgacccatggagggtctgctccaccaccatcaacactgcagtcaggaccactcttgaataagggatattgcaggagtctaactgccctgaggcaggccttagaaacccatagtctatgacccagcgacattgtgcccgtgacccacttcactgcagggtgagtagagccacttacctgaggcttccaggctaagtgcaatgagaaagctcaagaaagggagattaagaagttacgaatgataagttaggtaaaagagagtaggtggaggctggggctctccctacatgcactggaagaagacattgttaataaaacatttaaagcactgttgaatgtgaagaatacttatccttctgctctcagttagtggggctacgagtccttctaggtatgaggtccttaatgtccaggcttctgcaactcaaccaaaattgttttcaaactgatgtggattgttctgttcactcaagctgtgagagaacaattgaacatttatttgacacccaacattagtcaggttcctatggatattatatgactcaatcctccactggccctgtgaggcaggtattatcccttattttagagatgaggaaactgtgactcagagaagctaagtaacttgtcaaagatggcacagttagcatgtgacagagccaggatttgaatctaggcctgtaagattccaaaatccatgctcttccactgtatcgaagtgccagcacgatggacaaatgcctctgcagagcaatcattgcaacaggtccaaatcaatctggatacaaagcattgtccgtggtctggaaaaataacaccactcacagatttttataccactatctgtcaaatgtttgtaggtgctgttgtaatttctaaaatgcaaattaatataagttaactaagtccaaagtggttttttgtcactttatattttctccaccagtaataataatgtagttaatacgcactgaccttgtatggtatgactggtagaataataggaaggggcataacctaagtttgttacattctgaagcctaactcttaactgcagtaccctactgacccagtggatggttaagtgtgggtactattgtataatgaccttagaaatttcttgtcactaagaagaaatgtactgaataattctccatctcttcccagggataccaagaatgactacatgtaagttgtactgttatttccaggaggggcttgaagggaacttggcacctgtcataatctctatcagtccccaaaataaaaacacaatctatatgcaagcaatttctgtgctatacaaataaaactctatggcctggtcccctacccctcaaatcagttgcctgctcctaagactcttcagtgcagcaattctctggcagcttctggggagtcctaacagatttggggttcctggcttcagtggtggagactccaatcatccctaacgactaaatggcctcagcaattggaaaacttcaatgggaaagtttaagcagtactgtcctagttaggaggagaggaatgattatgaaaactgaggtactctgtatagccagggaagtagattctggtaggagttcctggcaagacttctcaattcataccacacaaagacctgcccttgtgccctgagctaccctaggttagcacttttgggagttaaaggaatccagcacctcaggctcccttggtcccctcgccctctgcgtccccacctgcctccctcccaacactagtctgtgctaatagagactgggttgtctccgccatgtcattatttgtgaatcccaggcacagctttcccttctcaggaacaacagccaaggaggatgaccatagccaactcatttaacctccctgagccttaattttcctcatctgtaaaatggagatgataataatgccccatgactttgttttgaagacaaaaataaattttatatgtaaaaacatgttataaactacagtgcttcatagagatgccagttactatcatgatgggtttgcactcaagtcctgatggcttagcttcttgttgatttattcatttgtttgtttatccatgcactcaggaaaaataaacagctgaattataggacaggaagtaggaggtgaagtctctctccagccatgaagaaaacttggcaggacaagcaagagctattcattgtcaggactctgtagcctgcctggtaggagtggaggaaggataagttcagaaacagccacacaagcagctgcagcccaagcatctgtttcacagctctgaaacctataaaatgggggagctgcccaagaatatgtggcaaaggtactttggcgccaatggctggtaagaaggcagaaggggagcccttccataaaatttcactaaaacattcaacttaaccccaggatatatcaatgtcaagctttaactgctgtgtgcttttcttgtcttggttttaatctactatatgataggtaaaatgcagggtatgccctgttgaagaagccacttatatggttgcattattggtcttccaatgtcaaacatttgaccaacatttcaggaaagaagatatacaaatggccaataaagctcatgaaaaattggtaaacatctttacacatcagggaaatgcaaaataaaaccaaaatgagacagtatttcacactctctaaaaaggctaaaaccaaagactagctatatcacatattggtgagaatatgaaacaaaacagaactctcatacattgctggttggagtataaaatggtatgattgctttgtagtactgttcagcagtttctaacaaagtaaataactatatgcctcaggaattttatttctagttatttacccaagagcaatgaaaaaaaaaaaaatgtctcccaaaagacttgtatgagaatcttcacagattgtaagttctgcaaagagaaaagaaaaaaaaagaatttttacagtgctttattcataatagctcaaaactggaaacactccaaaaaattcatcaacagaagaatggactaacagttgtagtataacgatataatggaaaaatacacaagttaaaaaaaaaatccaggaaaaaattccaatgaacctgggctgggtcaggtgcccacctctggatcattcaaccatgtctaggaatatatttgtttgaaaaagggactccctgtggtttggaaaggagaagggagaagtctgaaacaaaattttaaagtaacgttttcattttgaaatagtttaaatttcacaagaagcttcaaaaatagtaccaagagttctcatgtacccttcacccagcttcccccaatggcaatgtcttacataactatagtacatgtcaaatccagaacattaccattagtattatacaatactgtaaacttaggtacagaccttatttggatttccccagtttgtttttacacgctcttttaaaaaaaatatttatttatatttcagaagcgtatagtactgtgaacgtttatcccacaggtagatgcaagtaaccatcaccataatcaggatacagaactgacccatcaccataaaaagactgcctcatgatatcccctaactatgtctttcattgtgccaaaagtaaacttttttttttttttttttttgatggagactcactgttgtcagcctgggctggagggcagtggcatgatctcggatcactgcaacttccaccttccaggttccagcaattctcctgcctcaacctcctgagtagctgagattacaggtgcccaccaccacacctggctaatttttgtattttttagtagagatggggtttcaccatgttggccaggctggtctcaaactcctggcctcaggtgatccatctgcctcagcctgccaaagtgctgggactacaggcatgagccaccgtgcccggccaagtaagctattttttaaaaacagcttgatttgaggtataattcacatatcatagccttcactcatttaaagtgtgcaattcaatggtttttagtatgttgataagagttttgcaaccatcagcataatcaattttagagtattttcattatccatggaagaatctccacaaccattagcagtcattcccagtttctctcccctccctcttctctcctgttcaccctctgaccccaggcagtcacttacctagaagtctggatgattttgtaaaaaactgctctatagttgttcactatacctgtgatggagagaagagctggagcagtatctggagaaggacttgtgtcaaagacagtccttttgtcatggtttaacctgggagtgacttgaatataatcaaatgctgtagaaaatgaggatacaaaaaacaataggattatttggtcaggtaatgatgttgaagacgctagttcaaaagcttaagcatagaaattggcctgaggcaggaatgggactgcctcttccattgtaacagaaagaaaagagaaaaaaatcagatagcaatgcagttcagtgtatagagttgataggagaaaactgagggagttatctaatgatttttaagtcctttgtgaaacaggaggtcaaatcatgtgctgagagtaaaaactacgtggacttagaaaacggagagcatgtggaaaagctacccggtagaattggagagacagctgaaagagagccaaaaagatgagtggggtttacatatggactagttgagattggagtccataaatgttcatttggaggtattgaaatgctggggtctgacacggcaacctaagtacagacaaggagaaaacagagggctggagtggtccagggctgaggtgcagctctgcgggggccatgcaaggaggatacagggacaagtgagatggagtttggcaaaggaatggcttaagtaatggcaagtggattggaaatgaagggaagaaagtaaggggctatcatggggccagtgggaagatttaagcttaaggttttggaggtggagtgtatcggccatccttttctcccagcttacttctcttaccttacctctaactccacccgcagttacaacaaacagtagcatacaagcttcagcctgctttgctcaggccctttcccaagtgcttgctcactccctcgtgcctgcttcctgcagtcttgatttctaggagaactggaatcccctgtggacctctccaactcattctccttagtaacctgaccaaaatcaagggcagaaggatgagggggtggatggtgagaggaataaatcaggcatgcaggggcttgggctatcgcatatccccacagacagtggaggagcaggcaggtgtgggtgattctgggctgtgtgtgcaaagattctggtgaccttttatcaggccagaggccctcacagtgcaaagagaggaagcaggggttaggagcctcagctggaggcttcttaataataagttttcttgtttaacaacagaaggatgttcatactgttaagctctttactttacttaagcaggttattaaatggtattaatgaatgtttccaattttgttttaagtgtgtgtatatgcaggcatggaaattaagctgaattgcatcttcaactataccagatgttacaaaattcttcttcaaagcagctgtaccacatttacccctctaaagcaggatgtaagtgtttccatgctccatatctccaccgaggtttgctataattagacttaaattgggtgagaaaagtcagtttcctgactgaggttgggcatcttttcatatatgctcattggcagtgtcagttttacctgctctgaactgcccgtttgtattctttgatcacttttcactgggttgtttgcctttttcacattttatttatttggctttaaaaattttttatatcacaagatatcatcaactttttctcattttttaaaatagaagtcctcatatactatagtctgggtcctagtctttttttttttttttttttgagatggagtcttgctctgttgcccaggctggagtgcagtggcacgatctcggctcactgcaagctccgcctcccaggttcacgccattctcctgcctcagcctcccaagtagctgggactacaggcgcctgccaccacacccagctaatattttgtatttttagtagagatggggtttcactgtgttagccaggatggtcttgatctcctgacctcatgatctgtccaccttggcatcccaaaagtactgggactacaagcgtgagccaccatgcccagccctagtcctttgataatcatatgccaaaaaaaaaaaaaaaaaaaaggaagaagaagaaaaaaaaaaaagaaagaaattttacaaaaaattacataattaaaagggatataatcagtaccttgcagtaattttcaagtgttctacaaggaacttgtattaattttcagaaagacatgctatattaaaactctttagccatgtctgatcccacagatgattgctgtggagggctaccccttagatggccttcgaccccaggttttatgagaactgcaagggcgtcttctagagttctggccctgtggtgactgggatggtgagtgtcttagtctgctatttttgctgctataacagcataccacagactgggtaatttatgataaacaaaaatgtattgggcccatggttctggaggccaggaaatccaagagcatggtgctggcatctgacaagggtcatccatggtggaatggcagaaggtggaggtgaacacacaagatggagagcaaatggggctgagctgatcctgcagaaataaagcccccctgagagaacagcattattccattcatgagggcgaagcctcatgacctcattatctttttttttttttttttttttgagacagggtctccctctgttgtccacgctggagcgcagtggtgcaattacagctcattgcagcctcaacctctctaggctcaggtgaacctcttacctcgactctcgaatagctgggactacaggtgtgtgccaccactccccactaatttgtatgtgttttttttttagagacaggatcttaccatgttgcccaggctgatctcaaactcctgtgctcaagtgatcctcttgcctcagcctcccaaagtcctgggattacaggcgtgagccactgcaccctggcacctatcatctattaaagtttccatcttccaataccagtacatatgataattaaatttcaacatgagttttgatgaggacgtttgaaccaatttttcacacttctcagggttaaattcaggggtgaagggatatgcaatgaatttcagttccagatgtgtacagcaatagagaggcataggaaattgttggcctccctgaggcctcacccaggacaagcaatggagagaggatggctcaggaatcaccattgtcagcagttactcccaagatttgacccaggctcagtgggttttcctgaggctggaacaggagtgagaatgtctcagccatgttccccagctcctcctggctcctgacaatcctggggccagagaattgactattcaagacaaatgggttaatggcccagcgggtcatgacacacaggtaacaacagagagcaacctgtactgcatttccttgaaaagagtcaattaaagaaggtgctgaccctggcagagtgagtggctcagccaaaacatcattctacagctcattttgttctatcttattcatctcagtctgatttaactaattttgccagattctagtactcatctaaatttttcttaaggggttataactgtgacagaaaaaataagtaaaaatatataagaagaaaatgggagctacaggttttatctttgcctcctctctcttctctgtgtagacataagcacaaacacactaataatattttcactgccaaagtatctctgtattaattactcaccttgaaaattaccaactgtctgtagaactgggctgagccaggattgtaaaataggcaacatctatttaatatctcatattgttgcagtactttggaattttgagtgggctttcaaataagttaaaataatagaaataaccttccaggaaagatcaagcagattttatgtcccccattagacatataagaaaagagactgacttgcccaagacgtcctatctaataaatgatggagctgagactggaaccaaaacattcagattccgagtccagggcatttctttccatcatttattgggtcagatgatgatttctaaagcattttacaccctgaaacttcaggattccatgatttattttgtcatttccaacagtcaggcattcatgctctcacttgccatctggctgcacaaagactgcccttcactgccacctacgcccaccctgattttaacactgcccagcacctatgcacttcccccaaagcacccatccccagtcccagtggaaaatatacttattcggtgttttatgttcagagaccttctccacctgtgctgtccaatagaaacaaaatgtgagccgcacatttaatttaaacttttttgtcagccacattgaaagaagtgagattaattttaatgctacattttgtttagcccaatatactcaaaatattatttcaaaatcaatataaaagttgggatattttataatcttttttgtactaaatgtgtgtattttaggcttacagcacattgcagttctaactagctacatttcaagtactcaatagccactagtggccaccatatttgactgaagagtttttttttctatttttatttatttttaatcttttaccacatctttttaaatttattttttatttcaatagtttttagggaacaggtggtatttggttacatggataagctctttagtggtgatttctaagattttgccatacccatcacctgagcagtgtatattgtacccaatgtgtagtcttttattcctcacccccgtctcacccttctccccaagtccccagagtctattgtatgattcttaaggcgttgcatcctcatagcttaactcccgcttgtaagtgagaacctacaaggtttggttttccactcctgagttacttcacttagaataatggtctccgatgccatccaggttgctgcaaatgccattattttgttcccttttatggctgagtagtattccatggtgtgcatgtgtgtatgtatatatatatataaatctatctatatatatatatgtatatatatacatcacatttgctttatccactcattggttgatgagcatttaggctggttccatatttttgcaattgcagattgtgctgctataaacatggatgtacaagtgtctttttcatataaagacttctttccctctgggtagatacccagtagtgggattgctggatcaaatggtagttctacttttagttctttaaggagtctccatactgttttccatagtggttgtattagtttacattcccaccagcagtgtaaaagtgttcccttttcaccatatccctgccaacatctataatttttaaaatttttttaattatggccattcttgcaggagtaaggtggtatcacattgtggttttgatttgcattcccctgatcattagtgatgttgagcattttttcatatgtttgttggccatttgtatatcttcttatgagaattgtctattcatgtccttaacccactttttgatgggattacttcttttttccttgctgatttgtttgagttccttgtagatcctagatattagtcctttgttggatgcatagtttgtggagattttctcccactctgtgggttgtctgctctgctatttcttttgctgtgcagaagctttttagtttcattaagtctcatctatttatctttgtttttgttgcatttacttttgggttcctggtcatgaactctttgcctaagccaatgcctggaagagtttttccgatgttgtcttgttttggtcctctttagaaggtggtttcataatcagctataaaactccaacaggtgctcttaaatgcaggtttctgataactgtggagattgtgacatcagaatagaagaaaacttttaggactcacggagtactgaaatgttcatgaatatcaagcagaacaggaattaactgcatggactaaactaatagaagtctgaaataatctttttaaattttgcttaaaatgttgctgatcctttgttttgtttttcagagtcaataacacttttaagttatttacagcttttaacagttgagtaaagtatactcctatgaaaaaaatttggagcatattcatttctaactgatttctccagaagttggaaattatttgtgggtatttttaacttatgacaatatgttatttgcataagtgcaataataatctgttttctgtaacaggacacagttggagaaactggtattttaccaaggctttgacagggatggcatgctttcctttaaggaatcaaacttgacttatggagtcactaaaagccccttggaaaaactgacctcatacctttgtctacaccgtccctgtatagggttcctgacctgtggcaagtaaagaatgtcaccttctgacaggcccaggagccccaggtttatcttgggacctcaagagaagaggaatttactcaactcacaggcatttgatggtacaaatccatggctggacttggcttttaaaaagtcttatctgagattccttctatggaacaaagttccatcaaagccaatttataagcctatgtaaatatttttgctgcactgtatacaaataattaggccaagtataagaaagcaaaccaatcttaccatgatttgtctttagtaaaaatgggaaactggagagaaaaattatgtttcaaaaactatagtacacctgttgttagattctagtcttccctaatgtttttcaatttttattattttctacagtttggattgaattctaatttttcttggctacaagtcttcatcttcaaaataatgttttcatttttttctcttctttttttccccatttttcctaatttggagtcactgaaaactaaactgtgctttcctgtgaactgaagccagacaacttaaacttcagaggaaaataacagcaacctatgtacatacatgatgtacatatgtacatcctatgtacaacctatgtgcatacaaccactttcataactgcctactgatgtatggacttcagagttatgtggcctatatcgatttgccaggattgttcttttgcctgttattgtttttctcgcttcctccccttattttctcttcaaaggacatgagacttcacaaccttgtaaaaatgagctttcctaataactcaggacctacccatctaggaataaaccatcccaaccaggagagatcagatgaaacctgagaccacagactcattttcttctaaaatgctttctccaaaagatttttaataagaaaagcagggaaatatgaaaggaaaatttcttgggcccccaaaatcactaagctaaagagaaaagtcaagctgggaactgcttagggcaaacctgcctcccattctattcaaagttacccctctgctcactgagataaatgcatatctgattgcctcctttggagaagctaatcagaaactcaaaagaatgcaaccatttctctcttatctacatatgacctggaagccccctccccattttgagttgtcccacctttgcttcgagttctcccgcctttccagaccaaaccaatgttcatcttacatatgttgattgatgtctcatgtctccttaaaatgtataaaaccaaactgtgctctgaccaccctgggcacatgtcatcaggacctcctgaggctgtatgacgggcacatgtcctcaaccttggccaaataaactttctaaattaactgaaacctgtctcagattttcagggttcacataatcaaccttctgaattctttatctggcaattcagagatttctttttggtttcgatccattgctggagagctaatgtgatcttttggggttgctatagaaacttgttttgtcatattaccagaattacttttctggctccttctcatttgggtagactatttcagtggaaagatctagaactcaagggctgctgttcagattattttgtcccatggggtgatcccttgatgtggtgttctccccttcccctaaggatgggcttcctgagagctgaactgcagtgattgttatttcccttctgggactagccatccatccgggctaccaggctctgggatggtggtagggaatgtctgcaaagagcctgggatatgatctgtcttcaggtctcccagccaaggataccagcacctgcttggaccagagagttttaaatagtgactgtaatgtgagcttttgatgtcctaaggaaaagatgtggcctaacatagtttttttttttttcctgtctatggagggaatattttggactatgtgaaactgtgctataccaggtcatatcagctccaagctcccttgaagcatttgtcttaagtctcagttcaaacctggctctgcccgtaactggttgtttgaccctgagcaactgacttaacacctctgggcctctatttcctcacctaccaaaccagaatactatgacatattttcagtacttttgtgtgagttaaatttaatattctgtatagggacctatcactgtgcctgtcctatatatccacacttcaacaacagcaactcttgattgccctctcctccctctatgctgttcagtcatgctccaccttctatgactagatcagcctggtatgtagccaccacttgaggaggagaaaaggaattgacctcctcagtcacccctggacatccatgcaccagtatacctgtgaccacctgtgctgggttgaatagagtcatcctgaaattcatatccaccagaaaactgaatgaatgtggccttatttggaaacagggtctttgcagatgtaatcaagatgaggtccaaccagattagggtggggcctacatccaacgattagcatccttaaagggaggccaagtgaagacacaggggaatacataacgaaggctgtgtggtgttggaggcagagattggagagatgtgtttaccacccaaggagtgccaaggattgctggcaacaccagaaggtaggaagagctgaggggtgattcttccctagagctttcaggagtatggcctttctggcaccttgatttttaatttctaacctccaaaactgaaagataatacatttccattgttttaacccatccagttttcagcaatgtgtgatgacagtcctaggaaatgaatacagcatcatacttttttctaggtggctttgccaatagattgtcaattcatgttctgtcatattcagttttatgtcccctgttcttagcatagcacttggcctacccgggtgctcttaaatgactgtgggctgaaaatgaagcgagaaaacacatggggaaaaccaagttggataaacatggaagggtgtcagtttaaccctgatacagctcgaagaatggcttacatgggccaggggaaggggcaagtttggaacattctgtgggtgattgtgccagaaagtgatccaagaatctctgattggagagtttgaatgtaagacacagagaaggacatgtgcagtaaaggagcccaaagcagaaagacctctgagaggggacagtaagcagaagccttaaggcaggagaagccatgagtgcacacccacaggagaccagagagtactcagaaagtcacttggctgttagaagtggtcattatcaatacagaatggagacttcccgagtctcaggaaaggccaccaagagctgcccctaggccactaggaggtctcctggagaacattctaggtcctcatgccacctactcaccctctgctgaggtggcttccaatgctttctcactcacttcccttatgaatctttacagctaatcaccatcctctgaggtaacctgagtatttttctcaactgcaggcctaaatgtagtttgatttaatttgactgcttctagatagttttatttttactttatagaaaaggaaactgcgattcgtattagcccattggtgcgtttaagcgctctctctctttctctctctctctctctctctctctctctttctcttcctttgtctctcactatttttccctcttaggttagttagagagtgggcatgtgacacagagaagacagcagcaggaaaggtacattttgatgggacaaggaaggtgttgtgtgagaaatcactgggtgctcacgggttctgccgagacctgcttggtcgtggagaccctaacccagtggcgctagacaaactaaagacacacacacagaaatatagtgtgtggagtgggaaaccagggggctgacagccttcagagctgagagccacgaacagagttttacccatatgcttattgagaacaagccagtaataagcattatttctatagattataggttaactaaaacgggaaacaaagggatgggctctggctagttatctgcagcaggaacatgtccttaaggcacagatcgctcatgctattgtttgtggttcaggaatgtgttaagcggttttccaccctgggtgggccaggtgttcctttccctcattccggtaaaccaacaaccttcagcgtgggcgtcatagccatcacgagcatctcacagagctgcagagattttgtttatggccagttttggggcctgtttatggccagatttgggggcctgttccccacctgtccccctttttgtttttgcaagacgataaaagcaaaggtggctttgtcacggtgagctacttctcacaggagctgggatctgcatctgcagactatacaaagacaagcaacacagactaataacacaatcatcattgaaatcacagagcatccaagtgtttttatccattttaatgggttgatagctgctaatccatctgcagctccttcaagcactccagttcctggcattaaggtcaggtgtgcctgggatactttaaatatttgttcttttaattttggaatatctgacgacaagtttgtagagtgtccttctagatgcttttttattctttcccaaattttgatcttattaagagccattaatagtttccacaaatcctgatgtttagctcctagaatgggccatatcatttgagtttgaggtgccactgtaccaccatgtttccagataataggaactcttgccatacttcttaccatttctaccatctgaccattttgttcagaccagctgaacatagtatggccatggcatgcagactgagaggtgcaattcaaactaaacatcctcttagggaaccaatcagtaatgattccatgggaatcgttgtgcagcctccctgcctgttctgcaatgcaatctttccaaacaagtacgttcatttcttctgaccaggtccaatcctgtttacaaataggtttttgagggtggtattcctcaagtatagaagcagatttgttatggcaaatactgagaccagaaagcatgtgtaagtgtgtcatagagtgattacatccggtcattattgccagtcaagatttgatagcgagggggtaggcaactagtggcctttcccaaacagataggtggatgttcaaatcctaaagaaatattcataacagttccttcctcatgtgggtgagatgggcctctatcatctgtaggaccgagcatccaagagttatcattagtgtatacctccattggggggtccagccaagttacaggctgtagaagtggtggaaaaggtaaatatgcccaataagtataatcgttctctgtgtcagcccttgctaaaggaatactcatggcaatggtgatcaccgctaccatggctatcattaaattactcattgtgactggttgtcctgctttcctcaggttttcttctgccatctgtgacagcttcttgatctgtccccaggtaggtggctgtgttcaacgggtgttggtcgtgacagttggggtcctccttagcatcaacttggacaatgctgccactgataggtctttgggatccccccaaaacctcttcctgtgtatctggctcatagtgatgctttagaggtctcgatggtacccaaataggctgttgattcagtcctggagaaacacaagcataacctctaccccaagttattatttgacctatttcccaactttttgttatcggatctctccactaaaccagttgttctgcttgtctttgcagctggtttctgtaaatgctgttcagccactgttgtaactgctgaacagatgctgttcagatgctgttcatctggtctttaggcacactcaaaaaatttaaactcaataatgctagattcaattgcatgtgtggtgtcctgtagtctctgtttccacccttttgcttttgcaactgctgtttcagggagagattgattctttccactatggcttgtccttgagaattatatgggataccaataatgtggttaatattccatatagagaaaaatgtagctagagtttggctagtatagcctggggcattgtctgttttaatagaagctggaatgcccaacagtgcaaaacactgcaaaaggtgatgtttaacacaggcagaagactctcctgattggcatgtatcccagacaaagtgagaaaaggtgtccacacatacatgtacataagctagtctcccaaacaagggaacatgggtaacatccatttgccaaagagaattaggttccaatcctcaaggattaactcctcctgtaaaagatgagaaatgcaccatttggcaagttgggcatcactggataatagctttagcttctttccaggtaatgctgtatctgcgtttgagaccagaggcattaacatgggttaaattgtgaaagtgtctggcattagatattgcagtagcaactaggtgatcagccatttgattacctgcagtcaaaggtcttggaagaggtgtatgagccctaatgtgagtgatgtaaaaagggtgcattctactcctgactgctgtttgcaattgggtaaataaagtcatcagttgttcatctgtatgaaatcgtaactgagcattttcagttaattgtgtggaatgaaccacatatgaagaatcagaaatcatattaataggcatatgaaaagcaatcaatacctcagttagagctacaagctctgccttttgagctgaagtataggatgtctgtaaaactttacctttagagccagaataagaagttttaccattactagacccatctgtgaagatattttcagcaccttcaattggtttaaatttagttattttagggagaatccaattggttaatttcaaaaacggaaacagttttgtttcaggaaaatgattatcaagaatacccacaaagtcagctaaatgggtttgccaagtaagactatttataaaagcttgctgtatttgcaccttcgtgagagggacaataatttttccaggatcatatccatgtaatttaacaatccgagttctcccatttcttttcatagtagcaatttgatccaaataaggagttagagtctgtgaattagtatatggaagagaaagccactgtagaagatcttcctcttgaacaataactccagtaggtgaatgctgagttgaaaaaattagcaaatctggagtcttttcttgatctattctatttatttgagccttatgcactcgcttctcaattagctgtaactctccctcagcctcctttgttaattgccaagggctagtgagactagaatctcctctaaggttagaaaatagattattcatggcctaggtaggaatgcctagagcaggtcacatcaagttaatgtctcctagtaatttttgaaagtcatttaatgttttcaattgatctctacatatgtttactttctgtgacactattgtagtgtcatttactaaggtctctaagtaggagtaaggagtagtagtctgaattttatcaggagctatagttaaaccagcgtgagaaatcgaattttgcaagtgatcataacattggagtaatatttctcaagtgggggcaacacaaagtatatcatccatataattaataatgcaatactattaaaattttttacaagtaggttcaatttcttaccctacataagtctggcaaatttttggactgtttaacattctttgtggcaacactttccaatgaaaacacttagcaggctgcaggttgtttactgcaggaattgtaaatgcaaaccgttcacagtcttgctcatctaaggggatagtaaagaaatagtcttttaaatctatgactattgaaggccaatttttcggaatcatagcaggagaaggcaatcctggctgtaatgcccccataggttgtataactgaattaatggctctaagatctgtcaacattctccatttacctgattttttcttaataataaagaccagagaattccaggggaaaaatgttggagctatgtgtcctttttctaattgttcagtaactaagtcctctaaagcctccagtttctctttacttagtggccactgttctatctaaattggcttatctgttaaccattttaaaggtataggttctggaagctgaacaatggccgccatcaaaaatgatatcctaaaccttggcagaaactttgtctttccacttgaagcagttctttcaaaccttgcaaattttttcctagtcccataccagggacataccccatttcatgcatcatatattgactttgagggctatgtaattgctttggaattagaacttgtgatccccattattgtaataaatctcttccccataaatttataggtacagaagttacaattggttgaatagtcccaggttgtccatcaggcccttcacaatgcaaaatataactactttgatatacttcaggggcattaccaactccaactatgataattgagcaggttgaattggccacgcggacggccagtgctgtagagaaataattgaaatgtccgctcctgtatctaccaaacctttaaatttctttccctgaatagttatttcacaggtgggatgtctatcagtaatttgattcacccaataagctgctttgccttgtttacttgtgcttccaaatcctcctgtttgtttagtttcactttttctccatttccacatatggcacaatcaggagctgtgctgtacactctcctggctctgctttccagggaacagaagtagatacaacaatttgaacttccccattgtaatctgaatcaatgactcttgtatgtacttgcacttcttttaaatttaaactagatctacctacaagtaatcctaccgtccccactggcaagggtccacagactcctgttggcactttttgtggggatctccaggcagaaggctcacagcttctgtgcagcataaatctactgtggcactactggctgtggcaggggacaggcattgttcaggagtgaaggaatggcctgagccagaaatgccccggtttggaacagggctcaggacgggcccctcatggcgtttcctgaaattgggtttccatcgttatcaaatttagaatgacactgattggcccagtgttttccttttttgcattttggacatattccaggctcggcagttttcttttttccctcaactggctgcatgacttgctgattttttctacgttcttttttagtatgaccatgcttcccacagttaaaacaagctccaggagatggagtatttcctttacccattttcagtcctgccatggcttgtgccaacaaagtagctttatgcagattacctccgataccatcacaggccttgatataatcaactaaatacactttccctctaataggtcacacagcagcctggcactcaggattggcattgtcgaaagctagtaactgcaacactatatcctaagcagccgaatctgcaatcatctttttaagagactcctgtaaccaagctataaaatctgcatacagaaacaacaggtgctggagaggatgtggagaaataggaatgcttttacagtgttggtgggagtgtaaactagttcaaccattgtggaagacagtgtggcgattcctcaaggatctagaactagaaataccatttgacccagcgatcccattactgggtatgtacccaaaggattataaatcatgctactttaaagacacatgcacacatatgtttattgcggcattattcacaatagcaaagacttggaaccaacccaaatgtccatcaatgatagactggattaagaaaatgtggcacgtatacaccatggaatactatgcagccataaaaaaagatgagttcatgtcctttgtagtgatatggatgaagctggaaaccatcattctgagcaaactgtcacaaggacagaaagccaaacaccgcatgttctcactcataggtgggaactgacaatgagaacacttggacacagggtgggaaacatcacacaccggggcctgtcatgggatgtggggatgggggagggattgcattaggagaaatatctaatgtaaatgacgagttaatgggtgcagcaaaccaacatggcacatgtatacatatgtaacaaacctgcatgttgtacacatgtaccctagaacttaaagtataattttaaaaaaatctgcatacagttcttttggttcctgttttacagcactaaaggaagggtattgttctcctcctgaagtgattttttcccaagctctgatgcacactcctctaagctattctatggcatcatcctgcatgaccacttgtgcatctaaaccagcccagccgctgacccccaaaagatggtctgcagttatattaatttgaggttgggcctgggtgttgcaagcagcctgaatggaagcttcatctgcccaccaagttttaaattgtaagaactgagcaggagttagataagcttgagtaagagcatcccagtcagtaggaatcatccaactggagacagcaacattctttaacagtcccattacaaaaggagaacttggtccatactgatttatagcttgtttaaattctttgagtaatttaaaaggaaaaggctcaaatgtagctataatatttccctgttgatctggggggggtgtattctaacagggaactgccaagcctctatattaccctctcatctagcttgctgaattcctgcctaaatacaactgagagtggtagctcaagatgctgctcgaacagtcactggggcaactactttttgcccagtgtcctctggaaaagaaagatctggagggtcaggccaatctttttcttcaaaataatgaaggggtgcagaaaggtagggacaaacctctcccttctttgccgctttagctttagctggcaaacaaacctgctctgttacctcttctgttacttcattatactctccttcctcctcatcatcagtgtgaaaaggttccaaggtggaaccaaccagagcccacacttgtcccattgttaccttgatgcttctgagctccccttcttactcaccatggggattgtttaagagtacttgggtgtcctccagcatagttccatgttctccaaccatcgctctggtgacccttcgacccgggttcgagccacacatatgggtgccacttgctgagaccagctcggttgtggagacccaaacccagcggtgctagaggaattaaagacacatacacacagaaatataaagtgtagagtgggaaatcagggggctaacagacttcagagctgagagccacgaacagagttttacccacatatttattgacagcaagccagtgataagcagtgtttctatagattatagattaactaaaacgggaaacaaagggatgggcttggctagttatctgcagcaggaacatgtccttaaggcacagatcactcattctattgtttgtggttcaggaatgccttaagcagttttctgccctgggtcggccagctgttccttgccctcattctggtaaaccaacaaccttcagcatgggcatcatagccatcatgagcatgtcacagtgctgcagagattttgtttatggccagttttggggcctgtttatggccagatttgggggcccgttcccaacaggttcttggttggagacatcagggcaacacgtcaccaacaggaaaaaaacactgaggggagcttcccattggtgcttaggaatgaacaaaaaattatcaactgtaaactgtttccctcagagaaaacagtgtcacaaaaatcttttttaaatgcttgggtgttttctgtattgtgttttcacttagcttagaaaggacaatgcctgccaggctgtaatcaatgttgttacatcaggctctaaggacagttatgaacagtcttctctcctgagatgtttcaaataacacatcctgatgcaactttatcaaataaggcagctgcagactctccaaggccacataatactgtgttttcctaaggattaggttgcataattccagagatatctgtggtttgaagcaaatgaattatcaacagaagagtcatatgtcaatgagcggaatggaaaaacaaggtagaggcagtctttcatctgaggagaaatgcagggtctcccttcaggatgaacagatggttcacccatcttccccaggaaaatgaaaccacagctgtgggtctgagtgccgatgctggatgaaagttggaagctgtctctggaaagcaggcttccccaaggctggatgagtcaggccagggtgctgctcttctggtaaagtcagaattccactaagcaagtaataagcccattggtgtgaagtgtcaacatgtatgtaacaaagaaaagattttacaatcttctaaagcaattatgtccaacctgggcctcatgcagtccaagacagctttgaatgtgacccaacacaaattagtaaactttcttttctatttttttatttttatttattttatttatttatctatgtatgtatttatttatttatttatttattttgagattgggttttgctcttgttgcccaggctggagtgcaatggtgcagtctcagctcactgcaacctccgcctcctgggttcaagcaattctcctgcctcagcctcccgagtagctgggattacaggcatgtgccaccacgcctggcttaattttgtatttttagtagagacggggtttctccatgttggccaggctggtctcaaactcccgacttcaggttatccatccgcctcggcctcccaaagtgctgggattacaggtgcgagccactgtgtctggcctgtaaactttcttaaaacattatgaggttttttttttttttttagcttatcagctatcattagtgttagcatattttatgtgtggcccaagacaattcttcttccagtgtggccagggaaggcaaaagattggacaccactgttctaaagagaagaaaaagaaatatagagagaggattaaaatcaaaatgatttcagtcttctcaagagtaaccctaaaagcccaaagaccaacagagcaatgctttaaaaactccaaaggaaaattatttccaaactagaattctgttccaggacaaattcactaattcatgtgataatagaaagaaagatattttggatctagaaagtctcaaaaaacttatctcccattcacttttctcagaaagctgctagaggatgtgctccattaaaacaaaagagtaagctcagaaaggatgtaaaaaatgaaaggtgcaacataggacagctacaaaggaatatggggaaggggatcccaggatgtttgcagggctttctgacttacctgagacaggagcaggtcagaagtttccaggaaagagttcttcatgaaaaataattgatagactctctgataagaactaccaattaagaggatatttagggttgaattaatgataagtacagacagaactaaggcagcaagcaatggataattattaactccattattattcaagaaagtaaagtaatcttgggtgattacacaactcagctgtaaacagtgtttgcatagtatctgatatgagaccaaaccattttttgtgatgtaattcacagtctctaggaagaaatctctggcatcctgatagaaaaatcttgtacttaaaaacaaacaaataacaactttaatgtgattaagacttacactgagacaccagtcccctacacacccagctgactgtcagcccagagtttagtgatctttaaccaaatattctttcctttttgtattgttgggaaatttaaaatgtctacaaaacatcaaaaagaaagaaaccagagtaccatggacaaaggctcatcatctgcaaagatattttatatgcagagagaaattccaccctacttaggcagccaagaagtaacaatccttttttctttctttcttttcattctcaaaggaggtgagaagttacattccttttctactgccctatttttagccattacatacatatgttctctattaacagtaacctgtcctcctatgagaagaattaacagagccatttgctgtacattctttcacagtttagcctaaattcacctttatcaaaaggaataataatggcatgggcaacatggtcagacctcatatctaaaaacaatttaaaagttaccaaggcgtggtggcacatacttgtgttcccagctacttaggagactgaggtgggtggatcacttgagcccaggaggtggaggctgcagtgagctgtgattgtgctgctgcactccagcctgggtgacagagcaagaccctgtctcaaaaaaaaaaaaaaaaggaataataaaatttatctctgcgacaagcagatgaagatagagacagaaaggtgctcagaggttaaacttccacagtgaatggaacatagagacattattttcctaggtgtttatttacatttcaaaaagatggctctcagatttctgaaaaaaacaatctgggttgtaaagtgacaaaaggctaactcaggaagatataaaaataaaattttatatacttttcactgggtgggaccatcccgcccagtgcaaactgcaaaatacttagcagtctttgcccagccccttcccaatataccagtaatgtctaaccccaaccccctaccccgggcattgtagcaataacaaaagaaagagaatgaggagaagggagggagggaagaaaactgccctcacatattttcaaatacctcctggaaaaggaaggccaagctagaatgaccaactcatcccaatttgcctgggacttttcaagtttaattttaccagttttggcactaaaagcctcatgtcccagaaaatccactagttccaggcaaaccaggacagttggtcaactgaacaccccatgacatatgcacacatgcacatgtgtgtgccaaccatctaattatgtatgtgtgccacttaggaaaaaattaaaacttaaaataaaaagataggctttaacattgaagacatctgggtttgtattatggtcctgtccctcaccagttttgtgacctagggcaagtttctgttgatgaattacaatcatccctcggtatcctgagggactgggtccaggagctaccccccatacccaaatccacggatgctcaagtccctgatacaagatgatgtagggtttgcatataacctatgcacaacttcatgtatactttaaatcatctctggatgacttataatacctaatacaatgtaaatgatatgttaatagttgtactgtttagggaataatgacaagaaaaaaaagtctgtgctttttcagtacacataagtttttttttctttttaagacaaggtttcactgtgttgcctaggctagagtgttgtggtgcatagctcactgtggcttcaaactcccgggctctagctatcttcctgcctcagcctcccaagatgcaatttttttcccgaatattttccattcacattcaatccaccaatgcagaaaccatggctatggagggccaactatactatcaacaactctggttgccacttctcttgtctgttctagggaattaaaatgatgtaacctgtcagggctggtgtgagagcaatccctaataaatggccttgcctctttcttgcgtgaatttgggcctcagttctccaaaattcacctattgacacaccctcgatattttttatttcttttttctgagacagagtcttgctctgtagcccaggctggagtgcagtggcaccatctcggctcactgcaagctctgcctcccgggttcacgccattctcctgcctcagcctcccgagtagctgggactacaggcgcccaccaccacgcccggctaattttttgtatttttagtagagatggggtttcaccgttttagccaggatagtctcgatctccttacctcctgatccacccgcctcggcctcccaaagtgctgggattacaggcgtaagccaccgcgcccggctgatattttttatttcttctttagcgaaattagcttattgtgttcttaactaattttctgtatctgaattagaaaaggagctgatatggtttggctgtgtccctgcccaagtctcatcttgaattgtagttcccataatccccacattcccattacctccatgctgctgttctatgatagtgagtgagttctcacaagatctgatggtttcataaggggcttttccctctttgcttggcacttctccttcctgccatcatatgaagaggatgtgtttgcttccccttctgccatgattgtaagtttcctgaggcctccccagccatgcggaactgcgagtcaattaaacctcttcctttacaaattaccaagtctcaggcagttctttatagcactgtgataatggactaatacaggagcctttgtgaacaaggacaatgtctttgcatcctggttttatagttcttaatgcagtggctgcagatagaggattcagtaggatttgttagttgctatatcatctttctcaatctgtaaagtgctgatattgtacagataatagaatgggacatgaataacttttatagaatataaatcttcaaattcagtaatttactagtacggtgcacagccaatgtgcttgggggcagctccggctgatgaattacctcccatggcctggctctcttggtgacttaagtgcccccaaactagggaatagtttagctgagttagagacaatttgggcaggaaaattagggagtttgggtgtaggagaaggttcagttgtccaggaaaggaaaggagacaataactttcatgacagagagacaattctagggttaagatgatgccagaaagttagcaagtgactttcctaaagccatttcatacagtatatggggctggctgccatcttaccctttttctcatcaaaatttttcaattaaaatgtgaaacactgacttttatcaaagaagttaatgttagggttgccagataaaatataggaagcccagataattttgaattttaaataaacagttaataatttgttagtgtaaatgtgttctaaatattgtgtgggacttatactaaaaaattatttgtcatttctctggaattcaaatttaacctgggcttcctacattttgtttgctaaatctggcaacgccagtcagtgaaaaataaaattcacttcacagaaaacccacagcatggctaatgtccatgagaatacctttaaagaaacacggcccttgatccacacagacatacactacatattataaatgcaggtcaaaattcttcctttaatgtgattcatgttattttaatgacttttaggtcaaactcagattcccagttacaggtgcccttggctagttttatctgtgtaacatttgaggctgcatatgtgatcatggtcttgggtttcatctgagatgttagaagccatgtctcttgaggtacttggctcgtgcaaggacatcattgcagaagtcacagctcaggtcctggctgcttcggacatagccagcacccccactgtaggcacagagtccacctgaaatgcatgagataggttaatgctgacctagggtactcagcagttaactctgattctctttactaactacctaacaggaggcagctggagtttcggggaatctggtgcaatgtattatatttgtccctattaattctgtgcttgagacaactgactgatagcgttacacgtacctctcaggtactggtcaggggtccaggttggaaacctcctctggatttctttgattctagtagtcagaacttcagttgtctgggaaacctgagactcactaatccaggatgtgggagcttgagagccagggtcctgcagggaaggaggcagagaagaagccacgtaagctgggtgggagggtgatccggcttactgggctcaatggcgcttgttcatttcctgtctcttgttctcctttcacctttgatggaaccaatgccaccgtcagtctcctgtgaggtaggttagatagggtggtcatagcctcccttatggggaacaaatttgccagacaggtggagagaacaaaccactgacagtgcacaaactacatggtcagaatatcctacagtgccagacacggtggcttatgcctgtgatcccagcactttgggaggccaaggtaggtggatcacttaagctcaggagttcgagacgagcctcagcaacatgggaaaacttcatctcaacaaaaaatacaaaaattagctgggcgtggtggtgtgtgcctgtaatcccagctacttgggaggctgaggtgggaggatcacctgagcctaagaggatcaattgagcctgggaggcagaggttgcagtgagccatgattgcaccactgcattccatcctgggtgacagagtgagaccctgtcttaaaaaaaaaaaaaaaatatttgcagtaaggagacaaagaacagaagggaaaattcccaaatccatgcaagcacagaaacccatgattagtgtccttgggctgacctatgctcattgtaagagtgaaaaaaaagcacactcctgggtggagaattaaaatgctgagacacgcgatgtatgtgctagcatgcacaacaatagcgcatgtgcatcccggagaccctgaaacatgcttaacagcaataaccatcccctctgtcttatgaataatcatataagctttccatgaagggattttcccaatgtcacatgaggctgtctcattctccacccagctaccagagtgtagttttgctttgcaataaacttcttcgcctacttttaatttggactcgtgcccaaattcttctgtgcggcaaagtcaagaacttgaactggccctccaacaacacctggagatcagacagtaaagccatttatacctgttagaatagctactgtcaaaaatgcaaaagacaggtgctataatttgaatgcttgtcccttgtgaaattcatgttgaaacttaatccccgatgtggcagtattgagaggtggggcttttaagaggtgattagattaatctatgaatagattaatagattagtgggttaatggttatcacaggagtgaggctggtggctttataagaagaggaagagagactaagccagcacactcagcctctcaccatgtgaggccctgagccaccctgggactctgcaaagagtccccaccagcaagaaggctctaccagatgtgtccccttgaccttggggtccccagcctccagaactgtaagtaataaattttatttttcataaattacccatatttaggtattctgtaataagtaacagaaaacagactaagacaactagggttggtgaggatgtagagaaactgaaatcattgtacattgttgatggcaatgcaaaatggtgcagctaccatggaaaactgtactgtggtttctcaaaaaattaaaattagaactaccatatggtctgggtgcagtggctcacacctgtaatcccagcactatgggaggccaaggcaggtgggctcaccaggcaggagtttgagacctgcctggccaaaatggtgaaaccccatctctactaaaaatacaaaaattagccaggtgtggtggtgggcgcctgtaatcccagctactcgggaggctgggacaggagaattgcttgaacccaggaggtggaggttgcagtgagctgagataatgccattatacttcagcctgggcaacaagagtgagactgtctcaaaaaataaaacaaattaaagtaaaaattaataccatatgatttagtaatcccctttctgggtattcatccaaaagaattggaatcaggatctcaaagagatatctgagctcccacattcattgcaaagctattcccaatagccaagaggtagaaacaacctaaatgtacctgacagatgaatgaataaagaaaatgtggtatacacatatcatggaagattattcaaccttaaaaagaaggaaatcctgcattatatgacaacatagatgaatcttgaggacattatgtaagtgaaataagccagtcacaggacaaatactgcatgatttcacttatatgaggtatctaaaatagttaagttcatagaagcaaagaatagaatgatggttgccaggggctgatggggagagggaaactgggagttgctaattaatgggtataaaattttagtcatgcaagacaagtaagttctagagatctgatgtatgacattgtgcctataattaacaacactgtattgtatgtttacacatctgtagccagcattatccttagcaaactaacacagaaacagaaaaccaaataccacatgttctcacttgtaagtgggagctagatgatgagaacacatggacacatacaggggaacaacacgcactggggcctattggagggtggagtgtgggaggagggagaggatcaggaaaaataactaaagggtacaggcttaatacctgggtgatgaaataatctgtacaacaaacccccatgacacacgtttacctgtggaacaaacctgcacataaacccctgaacttaaaggttggaaaaaaggctttctttttttttaatattaggtttgtgactgtaaatctcccttaaagcatttttaccatatctcatagtttctaatatctagtgtttctctatcatcctgttttagttatttttaagtttcactatgatttgtttctttaacctaagagttacttagtgttgtgtatgtgtgtgtgtgtgcatgtattttaaatttccatatgatcagagatatttttaatttttaaaattatcttctagcataattgtattattgtgatatctgaaatttttgaggatttctttaatagatgatatatgatcaacttttgtaaaatgttcctcatgtgcaggaaacaattgtgtatatcctaatggatacgtaaataattacatccccctcatttttctctcctgctctccctccctccccaattaacaatcaagcctcttaattgtgttcttattacatgtgttaattgttttacttatttttcttctatatctttgctggtttgtttattgtataacctgtaaataatcaagagagatgtgttgaaatttcccattatgatagcaggtttattattatagtaataataatttatgctgcatatattttgaggctattttactggcatctacttgttttaaattgctgtatgtcctggataaattcaatcttttttgttatgtcataattctctccataccaaatattttttcttctaaagtgtattttatttaatatatcatagttatcaacattattttgattattgtattcctgataggtcttctttttaccatacttttacttcaaacttttgcatattcaaatgctttaagtgtttctcacataaaccatgtaaatctggatttgggcttttaatctcgttcatacatctgtgtctttaaaccagtaggtttcctatatttatatttattgccattattaatatcgtgtagttgctactatcatcttaatttgttatttcaatgtgtctctctttttctacattcctttttactcttgtcttaactattattattattaatattgttagaggtagggtcccactctctcgcccagactggagtgcagtggcgtgatttcagctcactgcaacctccgcctcccaggctccagcgattctcctgcctcagcctcctgcgtagctgggattacaggcacctgccactactgcctgactgatttttgtatttttagtaaagacaggatttcaccttgttggccaggctggtttcaaactcctgacctcaaatgatccatccgcctcagcctcccaaagtgctgggattttaaagacgtgagccactgtgcccagcctattttgtaaccgaaactatgtctcaccctaaataaggcaaggactctctgatcctttgtctccccaccactgcttccagcacccatcatattgaccaaacctataccctgggttttacttaaaatgtggtccgggaaccagcaacatcagcaacaactgagaacttatttattagaattgcagaactttgggccccatttcagacctactgaatcagaattctcatgtaaacaagagctccaggtgttcatatgcacaataagcttcgagagtcagtaaactagacttaaaaaacaaaaatctgtggccgggtaaagtggctcacacctgtaatcccagcactttgggaggctgaggcaggcagaccacttgagtccaggagttcgagaccagcctgggcaacatgatgaaaccccatctctacaaaaaatacaaacattagccaggcatggtggtgcatgcttgtagtcccagctacttgggaggctgaggaggatcgtgtgagcccaggaggcagaggttgcagtgagctaagatcataccactatactccagcctgggtgacagagccagaccctgtcttaaaaaaaaaaaaaatctgttaagatgatagatctcatgttaatgttaagtggtgttcttgccaaagaaaaaagatagtcaagttacaaggtttgggctaaggaagggatgagcagacctttcactgctgcttcagcttaagggtgtaactcagttaatgactgagttagtgtaggtagcagtgtgatgccctccttcaatgctgccagtgcaaaccctccaaacagtccagaaagggatttttctgtctgaacttgtaattctttttccagatagtctgaacgtctaaagggacttctaacccttcttatacgcctttgattatcacttccatgtaggtttcatcatatttgggagaaatgtccaaatctagagaattctcttgtttgttgttgttgttgttgttgttgttgttgttttttgagatggagtctcgctctctcgcccaggctggagtgtagtggcatgatctcagctcactgcaacctctaccccccaggttcaagcaatcctctcacctcagcctcccaagtagctggaattacaggcatgcaccaccatggccagctaatttttgaattttagtagagatggggtttcaccatgttggctgggctggtctcgcactcctgacctcatgtaatccaccctcctcgtcctcccaaagtgctgggattataggcatgagccactgcgcctgacccaaatctagggaattcttatttcatcttcaaaggaaatggactcatcctttcctcaaaagccagattttacaaaggagacagaacagcgcagcagaaatgatgccagccctaacatcacaagatattcagtcccagttctgcctcttgcagctgccatgtgactttgtagcagcaactccttccttgtgattctatttcctcacttgtcaaggatggattacgtgtccctcacctcatcttatcagattattggatgggtctccaaatcgaagtaaaataaagtatttgaaagtactttaaaagtatcatacaaaaaagtcaagggaagcaaatttggagagatcattgagaaataaatttttctaaaatcttaaaaaaaagactgcaatactcacaggttcctcaacaacaaccacaaaagcagtgtgagatcaatggaaaaaatcaagcctcattctcacccttgccatcactgattccctggcgcagagttaattcaacagtggattagtgaccattccccagaagtctctatctggcaagtgacaccagacggaattcatgcaaaaataaaactcaatcttcagaactaagaattgtatagaaaaaggtaaaggaaaataaatttaacattttttgagaatccaacagatatcaggtacttttttgcattgtttcatggaatcttcataataatgctgtaagaatggcattttataggtagagaaactaaggcccagtgagattaaatgacttattcaaggccatgtggctacaaagtaactgaggaaagatttaatctgtgatctttctcttggaccacttaggtccagaaatccagaatagggtggcccggatgatattctggaaacacggcattatttactgtgaaaagaaattgtggctcaacatgaaacagaaatgttgctgctcatatctctcaggcagaactgtcactgtcacagctctagagaccttcattcatgctgtgttctgtgaagctttgccatcatccaaaaaacaaagcagtggtgccacatagcagaatggccacatgtgtcaacggatgaagagttacctgcaccatgctagtcctatcgcccatgttgaccagaattttgtcaccgggagacttcctggacaagacaccagcgatcacggcaggatccatgcagtacttttggccaatggtttgcatcatgggttgatatttcaggaggtatggcatgtctatttcagccagcctttcagaagcacgaactcctaaaccaaacgcaaaaggaatgatgcagcttgttgtgacttatgctgcaacaggagctcaaggggagagagaaagaacaatccaaggatctgagtaatggtcgaggactgacaatcccagattttggtcttaaatctttagtagtggccactccctgacctgaggttagggctctcctcctgtgagcttgagtcagcatcccctgagccagggtcccctgtggctgtcagtgcccttcgactgggctctcaggggctgctctggcccacccaggacaattccatggccataggaaccattggtcccattctaagcaccccaataaaatgaaatgtgcctgcctatcagctgcaacctgacatgaaggagaaattctgcaaacccttcaataagtctttagatagtgttcctcaacaagtttgttcacaattgcacagttttccactcctaaacgataccaacaaatcatgcaagtttaaacctttctgaaataataagaatgctgggcaaaaggaaagccaatattaatctacttagctagccttaccttctaggtgcttttatggtttaaaaagcaccctcggccgggcgcagtggctcacacctgtaatcccagcactttgggaggccaaagagggaggatcacctgaggtcaggagttcgagaccagcctgaccaacatggtgaaatcccatctctactaaaaatacaaaattagccaggcatggtggcacatgcctgtaacccagctactctggaggctgaggcaggagaatcgcttaaaccggggaggtggaggttgcagtgacctgagattgcaccattgcactccaacctgggcaacaagacagaaacttatctcaaaaaaaataaataaaaataaaaaataaaaagcacccttgtccacattgtgtcaatcagagctcacaacaacactgtaaataccgtactgctagccgccttgccacggatgcaggggcagctaagtgacttgttcaagaagcagagctttgggaccccatacccggaactctttccaacactcagtagcgtgaggcatgggaaacagtgaaagccgggggataggttgagagggcgaaagctcatagctaccacagtagttcaggccgtgacgtcttccaatcccacaagatgctccaggggtgtccaggctttggatgtttccatagcatccccagttgctgctttcagacaagtctacaagttgagaaaagttcagcctaaggcatggaactagttctcatcattcttctgtccatgaataaaattacattaataaaagtaacaataataaaatccattacatcaccttcactctgcaattgaaactcttgaaatttaaatgagaaatatcccataaatgatcacaaaaacttcctcaataccaaattctcacctgctcccctgcagacatgagtaactactggagctattgaagcagttacactctttgtaaagctctggtgccctttgatgttgtcaggtggtatcttggaacacaaaggagaggatttgttccctgtaaagtagtcctcatcttacttttttttttttttttttttttttgagatggagtctggctctgtcgcctagtctggagtgcagtggcacgatctcgactctctgcaacctctgccttctgggttcaagtgattctcctgcttcagcctcccaagtagctgggattacaggtgcatgccaccacgcccagctaatttttgtatttttagtagagacgaggtttcaccatgttggccaggctggtctcgaactcttgacctcaagtgatccgcccgcctcggcctcccaaagtgctgggatcacaggcgtgagccaccgcgcccagcctcttctttcatcttatatgaactctgagcacttctccgtcaaatactcctaacttgttgctctgatgaaatatttatgtttgctctggagaaacaagtataaaacctggatctctctgggatatcaacccagatccaaagtaaggcactgctcgtaaatgaggatttgaggctggctacactttctctcaggtacacttctagataagagcctaaggctgcagaagggagtgaaggagagaggcatgggaccagtctccacatgggatcacccactttccacttcttccctttatctctttctcctttccatctctctctacctctgtcattctagtcatcactgaaggggaggagtggtttcagacactcgggatttcacaaaggccattgaagaggagaatgttctttctcttcacaccaggaggagagtgcatgagtatttagatctacaattcacacaaggtgggtacacaagtatttataatatatctacaattcacaccagaatggggacacatgagtcagtactaagatacctacagtaggcaggaaattgctccttttgagaatcatctcaccattataaggctgtaagaatgtctcattagattactctttaattaattaattaattaattaatttatctatagacagggtctcactgtcacccaggctggagtgtagtggcatgatcatggctcaccacagcctcaacctcccaggttcaagctatcctgccacctcagcctctcaagtagctgggaccacaggcacaagccaacacacctgtgtaattttttgaagagatggggttttgccttgttgcccaggctggtctcaaactcctgagctcaagcaatttgcccgcctcgacctcccaaagttctgggattacaggcatgagccaccgcatacacctggtttactctgtttaatctatttgatcctttgactaaagtagattagattatcaaaccttaatgatttgcagatctttggagatatatctattgcctataatcatatgtgtcctgtgtgtttacataaatgcattttcaggttctactttcttagaactttatggggttgataaatactcgtcttttggagtaaatacttctactttacaaacttgtgataagtaacctaagaaaaatgtggaaatgaaaagactagatcttttatgaatatactaaaaattaaaccagctgacaggttcttttttattttttaatcagtgcacttttatctttatgactggtgacaaatacccttagtactgcagttggttttatcactccttggttcctgccttgtggacctctccctagccacactctatgatcctcaaaattctttgtattcccaatgcttagcaccttgtaggcatttttaaatatttgttgaatgaatgggtcaataactaaatgaatgactatgagacctcatctaagaaatctattaaatttagagtcaggaaaatttagcttctcctgaggaactttgcttcctccttttatttattaaaaaacaagtaggctgggcgcagtggatcaccctgtaatcccagcactttgggaggccagatcacgaggtcaagagtttgagaccaatctggccaacatggtgaaaccctgtctctactaaaaatacaaaaattagccgggtgtagtgacaggcgcctgtaatcccagctacttgggaggctgaggcaggagaatcgcttgaaaccggaaggcagatattccagtgagctgagattgcaccactgcactccagcctgggtgaaagagcaaaattccatctcaaaaaaaacaaaaacaaaagcaaaccaacaaaaacaagtactttccctttttcctccagctgcaaagctgaagttcaatcacagcaactaaatcagcctcagtgattagcttagtcatgtgtactcggttgccttgattctggttttctatttgaattagtcttattcattagtcttattctggcaaccacctcaattcttctatggaaataaatgctttaggaataaattcaatttggcattttttatagtggacaatgagcagctattgatggtgtatatttaaagtctggcttcaagcagtgctgttttaagcccaccttgcattccagagaaccccaatcttttgtgggacatttggggagaggctgattgttggtggctgttcctaactccaggatttgttggacagtttagggaaaaaataatcttttttgttgcattttcaagtattagaagtgccattgtgttcctgtgcttatccttcccatctccaaagtcatttgtaaaaatcagccacactcacccatcagggcaaggaggcccagcagcagccacaatgcagacatgatgacgatctggctctacggctcctgaaacacttttaaaacaaaaattagcttgagaatacaaaaatatcagtcatcatcataaccacatgtaatatttccacagaagcaggggtgaaaagaacaaatttccccatatctgacctaagaaaatgaattatttgaatcatagtgaaaaaaaagcaaaagtaggacaagtaagtgctccattcatcctttcaattaatctaaaaatgagaagactcttactcagcccacaggaactcaacatacagtcaagttactaactactttatttcaagaaggcaagacactttgaatctcaaccaccaagaaacatactgacctggctccagaccctgaaaagcaaatttctgatgcccatacctcatcccaagagcctttttattatctccattatcaaaaggagaattttgtattggtgacttcttggaatttaggtcccttcttcttcaggtttgaggaaagaccacgctttcctcagtgccctggaatgtacactggttggaagacgtttcccactgctctaaccccagcctggaatcacagaccccctttatcaccttgagccatgttccccattccccctctgtaaaaccccaatgcggcaacaaacctggaccagagcccagggagaatggagctacctccaccagcaaatccccaagaagctggctcatgggcaggggtcccaggattgaactcatgaggtgctcacaagactggagaatgaacacgtggccaacatggagcacccgctcatgtgctctctctctctcttatcccaaccattcccctaatcaccttccatgagtacaaacagccctggttctcctactggctaccaaaccaatacacaaataccaccaaggatagtttgctgttaacctcagggaatggtagagtttctggacctttgcctccaaagcgcctcccaccaagccctgccactccagggtgtatgtcatcattgccccagtcagcagagcctggcagcctagcattttgaattattactgtcattacatgtaggaatgtgcatataaacaaggcacttggtactttcataatgcttctctcatctcttttgttttgaggttaaccttatgggttgtttctttcaaacacccaggaagagatcacatctcaagatggagaggctttaaggaagtcatttgaagccaggtgtggtggcatacacctgtagtcctagctacttgggaggctgaggcaggaggactgcttgagcccagagggtcaagggtgcagtgagctatgatcacaccactgcactccatcctgggaaacagagcaagagcctgtctcaaaaaagaaaaaggaagttattcgatttctgtcttcttaaactgagggggcatatgcccttcagttgcagtcatgctttttgttattctctctacaacattgagatggtctgtccgattttgcttagttgagcacaaaatgtcatggtcagtcccaacaccaaaaagattcagggacctggaatcttagctgggtctgcaggaacgctcagatttaatcacccaacaggagtcatttattcagcatcctgagcctccagcagtaaacaagagaggacaaccaatcccaggagaaaagaatggacaaagagctgcttgggtataggaaaagctcatggtctcatgaaagtgcatcactggctttatggaaggacccttcaggaaaaagcactgctcacattcaaatgctccacccagggtatttcactctttttgctgcttttccaggaaagaaaaaatacttcctcttggaaacccaagtggaaggactcagcttttattgtaacaggagagctaccgtattttccatgcttggaactaaatatctgtgttgagaagtcactttaatgaaagagtctatgtaaatacatgtgccacttaatgggaacacagaattactttctagttgctcctgggaccaggtcatcaaggtaaagtttttcaatttcatcagggaagagcaagaagtgacaatggaatttttcttttttttcttagagccagagttttactctgtcacccaggctggagtgcaatggcacgatcacggctcactgcagccttgacctcctgggctcaagtgatactcccaccttagcctcccaagtagctggggctagaggtgtatgccaccatgcccagataattttttagtttttatgtagaaatgggtctcactatgttgcccaggctggtcttgaactccaggcttcaagtgatccttccacctcagcttcctgagtaggtagggttacaggctcaagccaccacacctagcttggaattcttaaatggatgaacaatgtcattttgtccataaatacagcatattgaagcaacccaaactctatggcccaactttacaagtgacgaaaagtactctgtgtttagaagagattgttgagacatcactcgggtgtgctcaaagagtgtctgtcagttccctatgactcatttgttaattcccctgtggctccctgcttaaaaccattatgaagatgtcagaccaaggcagcacagtggtcatgatgtcaagcacaatgtttatggtagcatccctcttctcccttcccagagagcaaaatagtaacaaacagcaagggggtgtcaacaagctggggcaacaggcctgccaggcacactggaaactgacaaccagagcatccctcaggagctacctcatgttcctggtggctttgatggggacatcttcctctactcaccctctctccactgagtactttggaattcccaaagcactgtgtaagtttgtaaggcataatggaccatgtcttcttcagttcatcaatttttctagaaaaggtagaaacaggtatctttggtcttatggttttctcaccttagaaacttttccatgaatgctctcaatctttaccttgaacagtatcattgcaggtcattggggccctccatccagcccagaaatgtgacgtattaacacctcaacgtgcccaatgaaggtgcccctgccccattgtggtgtccccatctaatcctgagagaactgagaactcctgtatgcatccacattaggcatggtctcctgctctaagctgtgttgtcacccttgtttattgctaacatgtctctgtgtctacctactcattgtgtgccaacaggcctttctttttttaattttttaattttaattttaattactttttgttttgttgggttttgctttgttttgtttgagacaaagtctcactctgtcgcccaggctggagtgcagtggtgcgatctcagctcaatgcaacctccgcctcttgaattcaagtgattatcttgcctcagcctcctgagtagctgagactacaggcactccacgcccagctaatttttgtatttttagtagagatggggtttcaccatgttggccaggctggttgagaactcctgacctcaggtgatccacccacctcagcctcccaaaatgctgggatcataggcatgagccaccgcgcccagcccctgggtttttttctttttcttttctttttgttttttctttttctttttctttttttcttttttttttttttttaatcgagacaaggtctcactctgtctcccaggtgggagtgcagtggcccaaaattgtggaatcatctcaccattataagcctgtaagaatgtctcattagattactctttaatttttaaaattgttttaattttttttttttcaaaacatagtctgactgtcacctaggctggagtgaagtgctgtgatctcggctcactgcaccctcgacctgcctgagctcaggtgattctcctgcctcagcctcctgagtagctgggattacagccctgtgccaccacgcccagctaatttttgtatttttagtaaagacggggtttcgccatgttggccaggctggtctcaaactccagggctcaagcaatctgcctgcctcagcctcccaaagtgctgggaaccaccaacacctggcctgttttaaaattatttttaattttttattattttaactttttaatttttttaatttttgtttttttaaaatttttaaatatttattttattccatttttaaaatgtttaagtttttaaatttcttaaaggccttaccagtagcatcatgtcgtactcatcctcttcttgctattctaatcttctccctccctacatatatacacacacacgtacacacacacacgtacacacacacacatgcacgtacagcaacactccagcccattgcctcacagattgctatgcaccaacaggcctaaaattaaaatagtaatagcaatgtagtcacaaatataaaataatataaaattattctgccactaagatctttttttttttgagaaaaatacaactttttagagcaaaaatatagggcagcaacaggaaggctcattttaagctgttacgctgcgtagagctgcaccttcacatggcctgtgaaaatacctattcactgaatttggattgtaatcaataattaccagcctagaagacctctgaaagtttgatcattttcttccctctgggcaggcaaatcttccctgcatagagacactgtgagctggaagggagttccttctctcagtgcgtcctctgtgcctgcttttcccatttgcgtttttgagagttcagaactccaggaaggatcatcctatgctggagatttccccgtgaacgtttccttctgcacagagcaaatcagggagacttggcccctctgttccgtctatggactctagaggcgtatctgtctttttagtctgttagccgaggctgttagacatgttggccttagttcttacacagcttgcagagaaaataagattgttatagaaccaatactcatggtctatgggttaatgtagcattggcaagactgcccatgagggcaggcaagggatttaccgtctggcaaaatacaaacaccttagtcttttggctttcagttaacaaatatgacgtcgcatttggccctattacagctacagttaagtgcacacacatttcttttctcccattattcgatttgcacatgctcacaaatccaaaagtaatgacatacttgcattaaaagatatctaaattttgatgagtgttgtaatgaacaggaaaaattattctatcatctacaaatcttttcaaacttgggttttctttgcaaggtccttaagtttcgcctgagtccaatatttcttatgcagcagagacacaatcattgccaactgatcaccatacactggattttcatcctcaataagcccgagtgtaagatccatgcctctgcttcacactcacctgtcttcagtcagtgctcctccttagaggtggtgagcccacagcgatttatatagagtcctgttctcttgttaaaagtgttcatctcatcctattttggagagatttatgacatctcataaattataataataatcataattattataaatactccgaacttatatagggccttttattcgagaatgtcctggcattttgcaaacattaaccaatttgtttcttgccatacctcagaaggcagatcctagttgtagtttaactttgacacattgaggtccaacacttgtctttattcacatcattttctgggaatgtgggttaggtaagaaaacaaggaaggaagagagagagaaagagagagagagtgagaaggagagagagagtgagaaggggaagggaggaagggaagaggaagggaggaagggaaggaagaaagaaaaggaagaaggaaggaaggaagggagggagggaattgaacttggtgtgtcagaaactcattattggtttgtatttcaggtaagcagagcgcctagaccaggggttggcagctttttcttacagacccagacaggtttttgggctacgtggtctttataatgcctctgacattgtagcatgagagtgatcatagataatatttaaatgaatggccaagactgtgttccaaaaaaaaaactttctttactacacaggtggtggccctagggccgtaggttgctggcccctgttctgaaccaccgagagataccagttcacatgtcctcagttcagcaatgtggggagagatgatcggctggatgatgctattttacagacacccaggacctacagcgtgttccaaatgtctacatcaataagtactttgagagggttcatatgaagtttccaggaaggattctttcccaagttgtggaaagggtgcatttcatgactgaaagagggagccccctccctcaccacaccctgtgccccagctcagctgaacagcttgattttccccaaacacagcgccattctttgcactaggcattcctacaggatctttcctttttatctaaaccctcagggacaggggctgtgtctcattcgtctttataataccagcatgcaacactctgcatgatacatattagacactcagtaaaacacgtggaatcaatggcttgcttatcggctgactggtatacagtctgtttcttctgcatcccctgccttagctccctccccataccacaactcaaacacaagctccgtgagagctgtgaatctggctacttcatttataagactgagtcttcagtgcccagataacagcctggcacactgtaagtgttcagtaaatctttgttgaatcagtcaatgactgaagaattcctacaacctcacccagcaagatttggactgggcttccaatgctgggccccaggttagacgtgtgttccttgtgtttcaagcaacatgtggatatttctaccatagcacctacagcactttggtttgttgttgtcttgagaacaaaaacaaaggcttttttctcctgtattccttatggcacataaggggtattcagtacatgtttacggaatgagtaaatgaatgatttaaagcgtatttatgactttttggaagtcactcactctgcatccccagtgcagacattgagggttaagattttgttattctcagccgggcacagagcctcacgtctgtaatcccagcgctttgggaggccgaggcaggtggatcacttgaggtcaggagttcggaccagcctggccaacatggcgaaaccccatctctactaaaaatacaaaaattatccaggcatggtggcacacaccagtaatcccagctactcgggaggctgaggcaggagaatcagttgaaccaagagggagaggttgcagtaagccaagatcatgccagtgtactccagcctgggccacagagcaagcctccatctgaaaaaaaaaaaaaagaagattttgtttttctctacttgtgactgagatggtgagaccacaaggcagggcactgtgagcaagggtccagatttggacacccagggagttcctgaactttaactctgggaggggagtgtgagaacactgggttcctctcggttgttggcagagttggggtaaaaagagaactaatgcacccattaaaaactctatcctgacccccaaaatggaactcatccattttattttttccaccaagctctagcacataccaacaattaaaaggtattacagtgtggggaaatctggggatgcccagctccacctacaaaagcaccctgtcatcagcccagagggccatgttagcatcctgggaggttctcctgggcagcagccagcatgttgcctggcaaaggctccacagagacgaaatggcttctcacaaaccctgcctctctatgatgacttccacctcctcacctgctgcacctgggtccccaccctaagaatcctagaagctgaggaggtcgttctccatccagcctccgggacactccgcaggcacatgacggtcagatttatgttttaaaaagtgtcccctggctgctgattgcattggaggtgagccagagtgactcgggagacttcacagaagaccagaagagagatgatggttggactagagtgacggggctatggcttggctgtgtctccactgaaatctcatctcaaattgtagcttccataattcccttgcattgtgggagggacacagtgggagacaattgaatcatggaggcagtttcccccatactgttctcctggtagtgaataagtctcaagagatctgatgattttataagaagaaaccccggccgggcacggtggctcacgcctgtaatcccagcactttgggaggcccaggcaggcggatcacgagctcaagagatagagaacatcctggctaacacagtgaaaccccgtctccactaaaaatacaaaaaaattagccaggcgtggtgggggcacctgagacttcaggggattgttgggaaggcaagattggttttgaaatgtgaggacatgagatttgggaggggtcagaagtggaatgatatgatttggctctgtccccaccaaaatctcatctcaaattgtagcttgcataattgccttgtgttgtgggagggacccagtgggagacaattgaatcatggaggcagtttcccccatactgttctcatggtagtgtataagtctcatgagatctgatgattttataagaggaaacccctttcacttggctctcactcttctcttgtctgctgccatgtgagacatgcctttcaccttccgccatgattgtgaggcctccccagacaagtggaactgtgaatctgttaaacctcttgcttttgtaaattgctcagtctcaggtatgtctttatcagcagcatgaaagtggctaagagaaaaaggaaagatattacagatctattttagaggtggaattgacaggactcagtttgggacaagacgccaaggatgagagcaaagaagaggacataagtgcctgggaggatggtactaagtctggaatgctgaagatgaaagcacatttaccaaagaagatgaagttttaggctgggtggagtggctcacgtctgtggttccaacactttaggaggtcaaggcacttcaagaccagcctgggcaacatagcaacatcctgtctcaatttatgaaaaagaaaaagaaaggattatgttttaactcccatgtaacaaacctacacgtgtacacctcaatctaaaaatgtttttaaagagaaaaaataacaaattgtggtgtagatatggagaaatggagcccttatacactctaggtgggtatatacacgaatctagccattatggaaaacagtatggagatgcctcaaaaaattaaaagtagaagtggcatatgacccagaaatctcactgctgggtatgtatccaaagaaaatggatatgtcaaagggaaatatgcactcccatgttgactgcagcattatttgtaatagccaagacacagaatcatcctaagtgtccatcaacacatgagtggataaagaaaatgcagtatatacacataatggaataatattttgtcattaaaaagcatgaaatcctgtcatttgcagcaacacgatcaacctaaaggacattaagtgaaataaggcacagaaagacaaaatcacccatttgtgaaatctaaaaaagttgatcatgtgtaatggccaggtgtggtggctcacgcctgtaatcccagcactttgggaggccgaggcaggcagattacctgagtcgggagttcgagaccagcctggccaacatggtaaaaccccgtctttactaaaagtacaaaaattagccggacatggtggtgggcacctgtaatcccagctactcaggaggctgaggcaggagaattgcttgaacctggaaggtggaggttgcagtaagccaagatcccgccactgcactgggaaacagagcaagactccatctcaagaaaaaaaaaaggcgatctcatagaagtaaagagcagaatagtggctactagaggctggggaggaatggggagagattggttgcatgcaaaattacagctagataggaggagtaagttctggtgtcctattgcacactgcagtgactatatttaacaatattgtagtgtatactacaaaatatctaaaagggaagctatttagtattctcatcaatttgaggtgatggatatgctaaataccctgatttgatcattacacaacttatcccataaatctatgcaattcttatgtataaattaaaaataaaacttttacaaaatatataatatctttttattttgagacggagtctcgctctgtcacccagatggagtgagcgtgatctcagctcactgcaacctccgcctcctgggttcacaccattctcctgcctcagcctcccgagtagctgggactacagtagcctgccaccatgcccggctaattttttgtatttctagtagaggcggggtttcaccgtgttagccaggatggtctcgatctactgacctcatgatccgccggcctcagcctcccaaagtgctgggattacaggcatgagccaccacaccctgcctcatgatttcttataagtaaaaaacacacaaaaaaggagagaccagagaattgaatccagccatctaaatggacattgaacccactcagc

SEQ ID NO: 4 - DNA, 3319 bp, Homo sapiens
gatattgctgctgcaaccaacttcataggtctttcaggaatttactgtttacaagtgtctgcagtatgaagctttaatgcatatgatctataatattctaacctaacatttaagcttccacattattggaaacacagtcgggtctacatgtggtctcttctttccctctttccctccctcctttctatcttatttaatgtccttgtatcctgtgatatctgtactcttttttttttttttttttgagatggagtcttgctctgtcgcccaggctggagtgcagtgacacaatcttggctcactgcaagctctgcctcctgggtttatgccattctcctgcctcagcctcctgagtagctgggactacaggcgcccgccaccacgcccagctaatttttttgtatttttttagtagagacagggtttcactatgttagctaggatggtctcgatctcctgaccttgtgatctgcccgcctcggcctcccaaaatgctgggattacaggtgtgaggcaccatcccggcctatttattttttaattgagatggagtttcgctctttttgcccaggctggagtgcaatggcaccatctcggctcactgcaacctccgcctcctgctttcaagtgattctcctgtctcagcctcccaagtagctgggattacaggcatacatcaccacgcctggctaattttgtatttttagtagagacgggggtttctccatgttggtcaggctgatctcgaactcccgacctcaggtgatctgcccacctcggcctcccaaagtactgggattacaggcatgagccaccacacctggcctgtttttattttttatttttcaagtccgcactgcctggtcccatgacccaccccctagaactgggtagattatgatgagtgagaacatcatgaactctgttatgaaaatcagagtccatgtgtagtgtaaactgttaagtgtcatagagataaaattcagtgtactatgagtgtataacaggaggacagagaaggcgtccttgagaaagtgatttagagctgagatcttgaggaggaggaggaggggttacctagaagaataacttacatgaacatgttctgcatggtggggactggtgtctgaggtctttctttttgacagtgtgttttatcgggattactcttgccggttcgccgcctccccatggcaaaaacctcaattacttttgtaccaacctataatattataagcaaagaactttaggcctaaataattctcctcatgttaagagttcatctttggcaagggtggagttaaaattaacaatggcaggccaggcgcggtggctcccgcctgtaatcccagcactttgggaggctgaggcgggaggatcacctgaggtcaggagttctagaccagcctggccaacatgcacctagctgggcatggtggcgcccaactctcagctacttgggagactgaggcaggagaattgcttgaaccagggagatggaggttgctgtgagctgagatcgcatcactgcactccagcctgggcgacagagtaggactctgtccccgccgccctccccccagaaaaatttacagtggcaattgctctggctcaaacatattttttccccttgtaaaatggagaggatatcacttgtttgcctacctcacagggctgctgtgaggaccaaattgggaatgtgcaagtatcttgtgcattgtaattcctggtatagcgtgagatggtattattttccaactatttgttcctacaataatgtggctgtttcaattctgggccaatgatagatgcttatctctcattctagaggcatcctaggtgccaatttccaagatggacatttttccaagcagaaagggttttgttttcttttaaaaattcatggccgggcgtggtggctcacacctgtaatcccagcactttgggaggccaaggtgggtggatcgcctgaggtcaggagtttgagaccagcctggccaacatagtgaaaccccatctctactaaaaaaaatacaaaaattagctgggcgtggtggtgagcacctgtaatcccagctactcgggaagctgaggcaggagaatcgcttgaacctggaaggcggaggttgcagtgagccaagattgcgccattggactccagcctgggcaacaagagcgaaactccatctcaaaaaataaaataagataaaataaaaattcatgctaagggaaggaaatagagttaaaagcaaaacattcaagattcttagggtgattggtaggccagattgtttagtgccttgccttgtgctccctaaaaatacagtcacaaagtgttctttcttccttgacaagatagagtccaaatgctcagagcagctgagactggggatgcccaggttttcatatcaacataaggcacagagtggtgttgcatgatccaaaccagacggctgtgtgtcggtgcagtcgggggccttgacctttgtttctagtccatgtttttatgcatgtaaattctcccctagatagtaatctccttggagactggaccatatcttcagttcactttgcatctctcctagctgcagggcacagcatttgtgggactaaacatttcatagacatgtctggaaacagctagttgggcagctttgagacaggaaggtagccctctacagagagacccggagctgcagcttcctgctgctcctcatccagccagtgttcacctttggctgaactcttaaacaggaccttcgttggcattacaggaagaaggagaggggccaggatgattgcaggccagagtgttgttatcccctgctgtgcagaggaccagacgtggcatcatgggcttcatcctctgtgggagcattgatgggcattgagctttaggctgaagcctgccctgatagatgacaaagtgaatagtcacttgcaccagactgctggaaagaacccgagttgtcatgttgatctcaggcctaattagtgtgctgctcacttaatctgggagacgctgggtaaaagggactgggagaaaatgtacacgaagcagcccctttcttagggacttaagtgggaacagaatcaattgtgcatctgagctactttcccatcgttgggaggaggaagggagaagtgactgatggtcttgatttggacaacaggtgcctcggaaacccagccagaatcttggcgtgctgcagctgctgaggggccactctcccaagctgcaactctccctcgcaccagcttttggaagttacagagacccactagagagaagactttggactcatgactggagccttcc

SEQ ID NO: 5 - DNA, 1235 bp, Homo sapiens
gatattgctgctgcaaccaacttcataggtctttcaggaatttactgtttacaagtgtctgcagtatgaagctttaatgcatatgatctataatattctaacctaacatttaagcttccacattattggaaacacagtcgggtctacatgtggtctcttctttccctctttccctccctcctttctatcttatttaatgtccttgtatcctgtgatatctgtactcttttttttttttttttttgagatggagtcttgctctgtcgcccaggctggagtgcagtgacacaatcttggctcactgcaagctctgcctcctgggtttatgccattctcctgcctcagcctcctgagtagctgggactacaggcgcccgccaccacgcccagctaatttttttgtatttttttagtagagacagggtttcactatgttagctaggatggtctcgatctcctgaccttgtgatctgcccgcctcggcctcccaaaatgctgggattacaggtgtgaggcaccatcccggcctatttattttttaattgagatggagtttcgctctttttgcccaggctggagtgcaatggcaccatctcggctcactgcaacctccgcctcctgctttcaagtgattctcctgtctcagcctcccaagtagctgggattacaggcatacatcaccacgcctggctaattttgtatttttagtagagacgggggtttctccatgttggtcaggctgatctcgaactcccgacctcaggtgatctgcccacctcggcctcccaaagtactgggattacaggcatgagccaccacacctggcctgtttttattttttatttttcaagtccgcactgcctggtcccatgacccaccccctagaactgggtagattatgatgagtgagaacatcatgaactctgttatgaaaatcagagtccatgtgtagtgtaaactgttaagtgtcatagagataaaattcagtgtactatgagtgtataacaggaggacagagaaggcgtccttgagaaagtgatttagagctgagatcttgaggaggaggaggaggggttacctagaagaataacttacatgaacatgttctgcatggtggggactggtgtctgaggtctttctttttgacagtgtgttttatcgggattactcttgccggttcgccgcctccccatggcaaaaacctcaattacttttgtaccaacctataatattata

SEQ ID NO: 6 - DNA, 449369 bp, Homo sapiens
cccccgaatattcagcatcttaaagtcctggaaacactgaactttttagtaacttgtatttcacactatgtgcagggttcagtggaataaccctcaaaattccaccaagaattaattctaagaaatttggtgttataaggggagataaaaatctagagaactgtgagactgtattttcctttttaaaatcttagttaaagtaattgcaactggggagattagtgtgatccctgcaaactggaaaatgcagttcttttcacagaaagggaagacagtggatttcagaaccataaaagtctaaaaaaatgagtagtgaatagctggcaagggaatctatgaatactaggaatctgccagcaccattttattttcttttttggaaggtatcattcaagtagagaactagaagaacactgtatttttgtgagttaataagctatttctgcataacaattcatcaaatatcccatcgctttaaaaaagaatcatacatttagctcattttggatcaataacttacagtgagtttgcctagaggggttttcttggcacccctgaactcctatatatgttcaggggtcagctggataccactattttcagctggtatcaacaagaacagttaggccagctggcataagtagacataaatggtatgttgcaactcttctcaacatgttcctcacatccctctagtagactaccctgggaattttcttatcgtgaaagcctgggttcaagagagcaatacagagtttgcaagcagtttgcaagctctgtttgcatcatatttgctgacctcagttggccaaaccgtttatatgactgagcccagaatcaagagatggttcagattattacaatgggaaaaatgaatattaggccatcaatgtaattactctatcacacttcaccctctggccacatccctcttacatgcaaaatatgccccacttcacccaggatctctaaaacttccttcagtcctgcactaggcttggagtccaggatattatcatttgcatcaggtccagatggagctcttcagatgtggttcctctagatgtgaagataaactaaaaggaaaatctatccaattcccacacaccaaactatgagacaagggtaggaagactgcaataaatgccattatttgaaaagaggtatttaaaaaagaaacatagtagtcactggtttataaccattctcaaattctgctgctgagcccatgttgcaagattcttctgatctggatgcagggaatgtttcctgttcaagctttatttatgctttttggaagtgtctctccagcccaatgttctctatgattcttggttccacgttctgggatgcccttcgtttttcaatttctgtagccacttttgagactttattagaagttatacccttggaacaatattctaagactacttcctgtttgtagaaatgttggggccccagagaccattatgcactttgaataatataataccattttaaactaagatggctttacttttcccaaaataaaaccctgaaatattgtgtggtttttctgtaatgcaaccatgtcgtgttccatgtgtttttgtttatcctccttagatttgctcagtttcttagatgtgtaatttggtactatgtgataattttgggttgtcctcagacactatctctttaaatatttcttctgccccattctcatgtgtattatgccatttgatatttttccacagacattggctactctattttgcttttgtttgttttgttctctcctttcttttttccctttgtgtttcagtttggatctttctctacatctgtcttcaagctgattcgtacctttgttgtgtctaccttgctgttaaagccctcaaacacatttttaatttacgtattatattttatatctagtatatccattgcttctatttttaatagtttttttgaaatattccacctctttctacatattgtctgttttcccactagatatgttataatttttattattattttaaagaccctttctgtcagttctaatttttaagtcacttccatatatattattgactgcttatcttcttgattatgggtctcttccactctatgtgctcttgtgagagacccattttcatttttcttgtaatttgcggggggggggtactagttattctgtataaaattaatactgatgttaaaacaaaacctgcccagagatacttccttattctgctaggctgctagagttaataacttgaatcaataagatgtatagtagaagtaggtctgagatttattgcaaattttgattcaatttcccattgacttttattattttgagcgcaagattagaagtattccttcagtaggacatgaacactgatgttattctgataaaccatttgttctttacagcctggactcagctttaggaattatgagagctttgcttcacagagaagctttgcttcaggttttgaataaaggggagattctgttctctagtcctgcttttggcttgctcttacactgacttcctgtcctggcctctggatgtttctctagcctcctgccctgtctccagtcttccaagcacagatgcattacactttgtgatgggtgtggaggatatttaggagaaacttatctcaggttttctgcttttagccctccaaccatgccttggtgaagttcccaccatcagtttctaaaagtctgaagtgccttggtggggtttaccttgccctgaccctggtattttgtgacgccccccaggcacacagtgaacacctgtggagaagaattggtagctaggtgctgacttacactgtggtagccactgttcagtgttccagcctgaatacaatcattaacatctcatttaaattgagggcagttctttttaccccttctatggtgaatttctagtcctcccactactccaccagggatgagttgatgatatctgttatgatgcttttctctctcgtaaagtgcttaccactatttagaatttagttcattaactttcacaaaaactcaggtttttatggtaaaaaacaaacaaaagcaacaatgatgttgtagattattgggctcgtttttagatgtcaggtatgagtgatgttctttagagatatttacattattaccagaaacaaaatatgcaattagatattaattcatatttatagatttttaaaaaataactcttaatacaatggaatgggaaatcattaggaataaatagtcacatgatatgttatttatatctgtgttatatgtattttgctgacaacctcgcttccacttaataaaaaaaaaatcccagacacattattttggtatatttcatctttcattctgataatgttaaaaaatatattcttctacaaatcattttaaacgttttataagaataattcagtattcttggtaaggtaattcaatacagggcacaaagaactgaaatatacaactggcttcatgccatccccatttgggacaatgttatcaaaaggtacaaaacatctctgatctcataagactgcttcctgcagtcattaaatatcaagtcattgcctactgaagttcaatgcacaaatgggttttgttgcttattttacactgaggaaacattcagaaaaaaaaaccaaatacatttaaagaattgtattacctcaatctgacaatgtgcaaaaataatgaccgatagtttttagctatacttaaacttagttctattaggagctagatatttaacataaatattgaattatttttatatatcattgtaaatttatatttaactacatagcgtttcttctttcatggtgaaataattctattattttattttatgctttaaatgtgtaatttttccaaagaatgagcagagctgagagaagcagtcttctggctctgcagatctgtgtttccaagaatcttatttaattagaagaattttgctgcaattgtcctttctcgggcattgcgaaggctgcaaaatacttttaactcttcccaccaatcagaaaacaaatctgattaccatgcaaaataaaaataagtttaattcaagtctattcaattccacaggtaatttttggcttatttgaatcaattttttcagtttgcaactcaaaaatgagattgcagacaaaatgcttgcttaaaaataccctgcatgtgattaggagcacctaataatcggtaggcaacaaaaccttgttttatatttaattatgtgtacctcatctaaatgtctgataaaatttgtacagacatgttagccacatatattggtgttaacaggacaaatagcatgtctttgaataacagctgctgagatttttataaaaggttttctatctgtaaaagcatgctaatgatagacaagacgacaggaactaggggtaggggggatcttctaaagcagggatccccaactcccaggccaaaaaccccatacaggtccatggcctgttagtaactgggctacacagcaggaagtgagtggcaggctagcaagaggagcttcatctgtatttacagccattccccatggctcacattaccacctgagctccacctcctgtcagatcagcagtagcattagattctcagaggcgcatgaaacctattatgaactgcacatacgagggatctagactgcaacctccttataagaatctaatgcccgatgatatgtcactgtctcacagcctcccagatgggactgtctagttgcaggaaaacaagctcagggctcccaattctaattatgatgagttatataattatttcatcatatatttcaatggaataataaaagaaataaagtgcacaataaatgtaatgcacgctaatcatcctgaaatcatctccccaactcctggtacatggaaaaattatcttccatgaaaccggtccctggtgccaaaaagtttggggactgctgctctaaaggatctggtacatagattccatgaaagaatttgagaagccaaggtctggtgcttctggtgagagtcatagaaaaagtggtcacttagcctcttcagggttagtttcaaagtggatgattaatgtcttagcaaatgtatagagattatctggttcagcatattctgatgatttattctaaattatattatggagtcatctaaggttttattttgcatagcaatgtagggcaagaaatttagatagctttacctgctctgataagtttctgggttaaaatgatatgaaaataaatatacatggtagaactgatgagaacatcgttgtgaagccctagagcaagtattgacgtaagaaggaaatagactaggatttaaaatctttacattccccttactacttgtaaggcatattacgtagactgacactcatcacttctcttgggctattagagttcaataaagactagaggctttatatgtaaaattcttagtacaatgccttgcacatagtagcaatgaaggagtagagtttagtacatctttcattggctaactcgcactgacctaatttgaggtgggaattctgaacttacagggcaccactaaaaattcttcttgatccatatttgcagatcatcaatggaatgtaaatgtacagtatcaaagaactattttttgttaatataattgctttcttcattaaactaatgtatgttcattactggtctagatgtttaaacctaattacaccatagctttattgtctctgcattttaacctaattcctttctttgtctcctttccaaacaggtactataaaaacaaaatcacataattcactttaagtcattaaaaatagattaaagaatacctttctacaaacttatctttgacatttgaagttgttattaaacatcattttataaaactttgaacccaaagtcacaaacgaaaattacttgtaaagaaataaatgaattcaattatttttgtatgagctttaaaatgctggtggtttttaaacatgaggattttctatttcacttggcggttaaagaacaaaaggcaaataaacatttataattatgataaaaatgggagatttttatcttttattagaataatagtattttagaaatctactttgaggcaaaagatgaaatgacacatatttgaactaacgccaaataacactcaatttactatttgacagtttctcatttcttaaactgtgccagaccttgtgccatattctttacatatattactccaactagtttatcactgcacttacatggaatacctcgtctgaatatttctattttacagctgtggagttcacacttgtaaaattctgattttagatttgaatcaattcattcttttttattttgataaaatatacataaaataaaattcatcttaaacatgtttaaagtttacaatttagtggtaataagcatattcacattgttgtgtgaccatcaacacgatccacctctaggactttttcatgatctcaaacccaaacgctgtacccattaaacaacagatctccattcttctcacctctagtggctactgcccctagcaaccactattctacttttcatctcttagtatttgactgttctgagtacctcatataaatgaaattatacaacgttcatccgtttgtgtctagttaatttcactaagcataatgttttcaaggttcagtcacactgtaacatacatcacaatttgattccttttttaaggctgaaaaatattatattgtatgtattagattttgtttatccgttcatccattaaaggacatttgtgtcgttgtttccaacttatggctattgtgataaagcagctaagatcatttgtgtgcaaatacctgttcagttctttgctttcaatcctcttgagcacagacctaaaagtggaattgctgcaccagttggtaattctatgtgtaagtttcgaggtacttctgtactgtcttccacagcagctgcaccattttacattcccaccaacagtgtaaaaacagtttctgcaaatccttgtcaacacttgaccttttcttttctatttttaaaataatagctattctcatgtgtgccaggtggtatcttgtggttttgatttgcatttccctaatgattagtgatgaacatcatttcaggacctaattgattatttttatatcttctttgaaaaaatgtctgttcatcctttgcctattttctaattgggttggttggttgcttgttgtagagctgtgggaattctttatattctggatattaatctatcagatgtataatttgcaatttttttcttcaatttgggaattatcttctaactctcttgttggtgtcttttgatgcacaaagtttttaattttgatgaagttccatttacctatttttttcttttcttgcctgtgtttttaatgtcatatccaagaaatcattgccaacaccaatgtcatgaatctccccccgccacgttttcttgcaagagttttttagttcttacatttagccatctgatcctttgtgaattaactttttatatatgatgtaagggaagaatccaacttcattttattctttttttatgtggacatccagttctctgagcaccattcattaaaaagaataccttttactattgaatgatcttggcattcttattgaaaatcatttgaccatatatgtgagggtttatgtctagactctgcattggtctaaatgtctgtttttatgccagtaccacactgtttttatcactgtagctttgcagtaagttttgaaattgggaagtgtgagtcctccaattttgttctatttcaagactccttttgctattcaaaatcccttgagattccacataaacttttggatttctttttctattccttcaaaagatattgttgatgttttaatagggattgcatgaaatctgtagatctctgtgcaaagtactggcacttcagcattaaatcttttgattcattaacaaaagatatattgctatttattggtgtcttctttaatttcctttggaaacattttatagattttagtgtaggcgtcttctgcctcttgggttaagtttattactaaatatttttgatgctattgtaatggaattgttttcctaatttcctttttaaattgttcattctcactttgtagaaaagcaacaaatttttccacgttgattttgtatcctgcaactgtgatgaattaatttattagttccagccagcttttttgtggaactttaggattttctatacataagataatgtcatctgtgaagagaggtaattttacttcttactttacaatgtagtgcctttcatttttcttcttgcctaattactcttgctagaatttccagtgctttgtggaatagaagtgaaaggaacatccttgtcttattcttgatcttaggtgaaaacttttagtctttcaccattgattatgatgttagctctgtgaattttttaaatatatggcctgtaatatgctgaaaatgtttctgagttcattccttcttaccttagactctccaatattaattatacttctaagttgcttcctggttgtttgtaaacttatttttaaaatcaaattatattaatagaaattatatattgagtgctaagaaactcctggtcactatgttacctgttggtaagtcagagattgctgaaatatatttctttttcttaggtgcttaagcaagcagtgggaaagaagttaaatggagttttaatagaagtatgcacagattgctatggagcagagaggaagacataattaactttgcctagacagaagaggctgtacatcccaaaagtgagcattgaaggataaataagaatttgtatagtaaagaatacgcctggcattcaggagatagaagttgtttccaaagcattctcggaagaaaaatttcatgcacatagggttggaaatataatgtcacattcaaggaatttcacatagaaatgcataaactgtgctgtgaatttggaataggaataatagaggaggattgagagatggtagaaacatgcaggaaaaaaactacgaagggcactgtaaacctttgctaaaccatctcaaatcaggacttgacgataggcaaaaatgtatcaaactaaatttgtaaatgacagctttcttgaaaatttagacaaaaattctttttatgtaaaaagcatatattaaatatgtgatgaaaagtgagtctcacgtttttcttttagcaatatgtttctttaaaacaatatgggaagaaatttggtgtttgctatgggcaaaggttttctacatccttggaccttcaggagcacctgctctttggtttggggagaaccagagagaaagccactgcaggaattaagcaagacaagggcgtgatcacgtctgaattatcaaaggaattacactttagttacacgactcatctttcaacatctcattacactccctaaaacaattcccaaaacacacactttcagtattatctgggtctaaatacatctgtagtgtttctggtaatgttctaagacagattgaggaaaagagtttttatgattctatttgtttttcaacagttatgtaaatccttatacatatgctccccattgaatatttactgtttcttcattataatttagacaaatgttatataggaagaaagtattgaaaagaaagcacaaaacattcaagaggcattatggcgtgtgtcatgttagaagagtttaccacagggtcttagctgggcttttatcctaactagctgtgtgatcttgagaagttactacttctgaatctcacacctcatatgtaaaattaatattttatttaaaaggaaattcaatctccaaactcccttctaattttacatttccatggctgtaaaatttcattaacaaatatacaacaatctttttaatgagactatttttctcttaattcatttcatttaaggtggtcactatgccaggtggctgctgttgtctaataggagagtcagtaacttcccacaagcaccatggtcctcagatgtggatcatttacagtgctcagaaaagtcctgtaaatagcccacgcccagatcaggactgcctcatgttaaacttatcaacttcattacaatgtcactctcatgcttgcctactaagaaggaagaatgacacaggagtggatttcttttctgaatcacagaaaaaaactgtaaatccatcagatttcccaagcaggcagggtgctttattaggtgataagaaggaaaaagaaccttcttttgccaactttggcttgtaagttttcccattatcctgcaaagtctgttcattataccacatcatgtgtgatgctgtggcatttgtctggagtgagtgattcacacctgtttgttaactagactcacattttaggaagcaatagaaactgtgattattttattagtctgacttcaacaaagaaacggaaccaagattgtgtgtgtatgtgtgtatatatgtatatacacatatacatacacatatatatgcatataaaattatatatatagatagatacatgctcctcaacttaagagcattgtaagttgaaaatattgtaagtcaaaaatatatttaatacacctatcattagcactgaaaagatcaaaattcaaaattagaagtatggtttcgactgactgcatattgccttcacaccatcacaaagctgaaaaattacaagtgaaaccacagtaagttggatatgtctgtatacattcattttatatatatattatatatatatatatatatatacacatgtaatttattatgggaattggctcacacaactatggaggctgagaagacccaccatctgcagtctataagctggagaacgaggacagcagtggtgtaatttagtctaaatcaaaaatcctgagaactaagtggggttggggatgctgctgtaagttgcagagtttaaaggaccaagaaccaggagctccaatatgcaaaggcagaagaagatgtatgtgccggctcaaaaagagaaagaatttgccctttctctgtttctcctatccaagttttgctctcttcaacagattgcataatgcccatccaagtaggtgagagtgaatcttctttactcaatctactgattcaatggtcatcttttccagaaacgccctcacagagacacccaggaataatgttttaccatctatctgggcatcccttagcccagtcaagttgacacataacattaatcattacagtaataaatcaatacttaaaatctaaaataaattttgtaaaaaattaagtataattttcaaacatataatgtgagattcttttaatatcttggcaagaattaagcaaatcttttaacttgtaattatttttcatgtaaagtttcaactgccacctatatgtcattttctcttccatctctgtttctggatcttaactcttgtatttacttgcagatgcctgtgcctgctgttaggctgtcagctccttggaggcaacactgggctggagcaaagctcaatagggccttactctggccatggaggtgcaaccaccgaacacgtagaggtctgtagaagtcagtgtgagaactcctaattttgtctttaataagaaaagaacagtgggaaacaggaatctttcataatcacataatctttaaggaggagtaggattagatctcaggtcttctcacttccatgttctggtttttaaaataacagctcccttattgtgttaggaaaaaccttctgacaaaccccgaatatatcatgttctagactgagagcattctgaaagtcctgtgaggacagggttggttgccttctgcactagtttgtctccaggacctagtatgttgtaaagcacagttaacattataaattgatattacaagtatttccgaacaactttaaaagtgagagaaagacatatatcaaagcaaacagagggactgcattattactatgacacattagcaccttaatttataaaattaagagcacaacggatcaaatttgaatagaaatgaacgatttaataaatgttcagtagtgagattgaacacaactttaccaaaacgtagttgatcattcacaaggagttttgaggatcttatatgcctgtcattttactgtatgtttgactaacacatttggttagactatcaactatgtatcaatggaatgtttccagtatgatcagaaccatatcatctttattgctgttttataaagtacagaatatttttgtgagaaaagaacctattattctgttcttttgtttcaaaattacatgatccgactattatcaagatgcataaatccttggctttggcttggtaacattatatgtatatttcagtttatataaatataactacttatttgtgccattaaatcaattacaataaattagtatcagtgttctaaattagtcaccacaaacgtatttatgtaaaattttttattcttcctacttcagaaatatgcaataattaacacatttaaattatatattattaacactttgtgtgaaagtgcagaaattgtatatcgaatattttctatgttgaatcaggatggatgttccaatagtgaactgtatccaccaaatgaaagcagaatatgtctctcattacttttcactgtctgcaggatccactttgatatttcactttcatctattatgttagtaatttgagtattattttccttgataagcctgaatgagattttataaagtgatgttaattttttataacatcatcgtttttgctttatgttcgttataaattgtattagttttttaaattaattcctgttcttatctttattaatcctttttttattgattgggtatactatttattcttctaagtttttgagattgaagttagttcatttgatttcaaccttccattcttacatgttcatttctggttataaaattctatctaaatactgcttttgctgcatctcacaaattttgttatgtaacatatttataattattaaattcaaactattttctaattttccagtgacttttttgactcaggaattatttagaagtatattagtttttaggcagtgagcatgttctaatttttttattgtttttgaattgatttctgaattccactattttcagagaatatactcttaattgtttcaattctttggagacttatgagatttctttagggtggttaatcactttcaccacctatgttccacgggtatctgaagggatttgtagttactacattggtggttacagtattccagatttgtcaattaggtcatcattcttatgtgcatggacagactttctatagcttttctatctttatcatctatcaaaacttcccccatgatttccctttatagttctgtataatttttatttatatcatttgaaattatatttttggggacatgaagattttaaattatgctatcttccttgtgaactgaccctcattattaagaaatacctctttttctctataaacactgcctgccttaaagtttctttcgtctgttggttagtatagtgacaacttttctagtcattagtgttttgtgatatatgttcttctacatttattttctagtgttttctgtcctcatatgtaaaatgtgtcttacaaacagtataaacgtcttttttccccccagtctacatttttacttgatgatagggtatttaggcagcatcaagtcaggaccacctccaacacttctgtcttttatttgctgtattcccagggtttctccctcggaagttctttgtctcctaatcactgccagactgagaaattttgctctgcttttcagaacgattttatcttaactcattagttgcttaccccacacagctttagaacttagcacaaatcttgagggacatactgtctctttgcttgaggcccacatttttggaactgtgccccttcatgtctttgtgctcaccagaagctccaggtagcaatcttctgtcttggataaatccaaatgctgagcctacaacaaatgcctggaattgacagaagccccagaagaacagcagcagcagattcttgtctcatttcttaaagattcgcccatgtttacaatcttggtctcccattgtcttctgtgattctctgatgatagcttgtgatatatttgtaggttttcctagattttctacctattgtcaatggtagtcttctgcttgttacaatctagtttgcctacccaaataagacagggtattattttttaagtgagagtcaagcatatttgcatattaagaagaacaatcctgtcgaggagaatggatgtcatggttggtagagcagaaaatagctttatctgtattcttctttaataagtgagacagagaattcatctaatgtccaaggggagcaattagccctaaatagcagtagtgagagcttatttataataacagaaaaatcagagctattctttgaccactgcaggtcagatggtggcggtatatgtggtaatgggaacttatgaaatttttcttctgattatttctgtttctgtcagtaaacaggaagtaaggttataagttgagaatgatgaattgaaaggagtgaaggtatgaagatgtggaataaccctttaaatgagtgacagagaagtgtatttgtaagactcttagctcacttggtataattaatcatgcatttaaagtcaattcaatcaccatgcgtatgtgtttatttctaaccaagttcagtgacttcgagcaggaacagagtaaatggagaaatacatttaattagagttagtatttcactaggagaatatgatggaagcagaaatgagcaaaagagtgaatatgggagttattaaatgattatttgtgcaatttaaagtagcagagatgaaattagggatatgaagcaatgagagacagtgataagaagatagtatgaatggaaattacatctagcagtgtaaaaaattccaggagtcagtgaacgaggggaattgaactgagaagtaagatgtaatagttggagattgaaatccttgaaatttttattatagagaaggtgaatttctgtgtaatgacaagttttagagtgtgatagggctgggtaattgaagtcaatgactggatatgaggagaggagaccaaattattaagaagtcaaattattagaagagtcatcaacaaataaaagtgtcacgagagagagagtagccctggtgctgaaatcttaaggagtgatagaaatgggagaagattttgacgatagggttagtggattgtacaatttgaaggaattaacttaggaaatgatgatgttagacaaatattttttaatgtctctcattgaaatatcacgatttcctccataaagatctttcacattcattaattcattcggtaattatttactaggagcctaagccccgttccggacattagaaatctagccacttaactttgtcaccgccttactaaaatattgctctcatatttaaataatctggaggaattttttaaaatgttaagcaaaacaccacattcttcagctcaaactcatccagtattgactcattacatgcaaaagaaaataaaattattttaccatgtcctagaaaatctctcttgttgggaaaggcagtcatatgcatgcagtcttttgatgatgctgggctgcacaagaatggtcctggagatggagacattttcttaccaagacagaaagagcagtcacagtctgtgttggccttacggccatgtacgggaatgtcttactttctaccgatctcaatatgtgttcctttgctctacttaagcgtatgtgtcatatagcacctcgccaaccccactagtacgtgtgtactatgaagtccttctcctgcaacacaagaggaaaggtaggctgtagaaggagcttgttctggccatgggggacccacagccacaatggaagctgatctggccctgcctctgtatgtgagcaaagcattgctccacaccatgcctgcaggttgtgtcttccttggatactctgaaccatggagtgagttggatgtcctgggactgctgttcctgctggcagcattatgctatttgctattctccatgaaatggactcccctgctatcaccaacagaggtggaaaaaggtgtgtcacttgccgcacagttacacacacaagatctggctcctgtcttcctctccaacggttttcttataccaatcatctccttccacacttccaaactgttttgaatggccaagcttctatccttcagtgagacattatattagttgttcgttctgcctggaattcactctcaccagatctgtataaggctgctaaacacttgggttattcacatgccatctttccaaggaggtcccctccaaaacactcaattaaaaatagtcatcagtcatcattcttggtcctaaacttggctccattttcttgataacactaatggtctatgaaattcaacatttaaaattgtataaaattatatttatcacttgtatattgtgtgtctcacacacatatgaattttttcaggagagcagacccttattttgttaaccacttaatctttaattactagaatagttcacagaacacaggaggtgtgtagaaacactgtgaaaggaaaggggaagaaggaagtaagaagggggcaggagatgaagaaattttgagaatgtctgcttactgcctttgaactcgaatacaaaatgcactttatttagactgtgcaggtccacttatatatggattttcttcaacttcttccccctcctcctcagtctgctcagtgtgaagatgatgaggatgaagacatttaaaaagatctatttgcacttaaatatattttattttccttattaatatcattattttttctctagcttactttattgtaagaatgcagtatacaatacatgtaacatgcaaaatatgtgtgttgatgttctcagtaagtcttctagtcaacttttagtagttaagtgtctggggagtcaaaagttgcagtggattttttactgaggaggggactgacacccccaattcccatgttgttcaagggtcacctgttctgcttaacagatttaggtaataatttctttccctcagaatgtctagatactacttgattattcataactctgaaagatactatgaaaaaatcatgtaaacttgacttttttccttttgtatatgacttgttttatttctgcgtggttacttgaaggattctttctttatccctgcatgttactaataatccagatgtatctcaatataaaattgtattatggtgtcctatatatatgttgttcctccaatttatttttcattctgcagataaagttatttaaatagtgttttgtctctaatatatatgacaataatttttgttccatttgttagattccctagtttagaaataagtatttgctttttacggcagatatattctttctgctgttcttatctaacagcttctctgtaattatgttaattatgcatctattgcctctctctatcccaggcatttttatcatgcttatattcacttttcagctgtgctcaaaacccttccattctgactggttctaagttacttacttgatattcaattatgtgaattgtggtctcagggtttcttatctcagaaatttctttttccatattaaactctgattttatcagtttacttcctcacctcttagatgtgaatttgtattttttaaatttgtaatgtttgtgggtacctaatagatatacatatttatggggtacatgaaatgttttgatacaggcatgcaatgggtaataatcacatcatggagaaagaggtatctatcccctgaagcttttattcttgtgttaaaaatgatcctattatactcttttagttattttaaaatgtacaattaattatctattgactatagccatcctgttgtgctatcaaatagtaggtcttactcatttttctatttttctatttttgttgcacccactagccatctctaacttccttccactcccccactactcttcccagcctctggtaaccatccttctactctctatgtccataagttcaattgttttgatttttagatcacacaaataaatgagaacatgcaatgtttgcctttctatagctggcttaactcatttaacataacgatctttagttccatccacgttgttgcaaatgacaggatctcattctttttatggctgaatagtactccattgtgtatatgtaccaaattttctttattcattcatctgttgatgaacctgtaggttgcttccaaatcttggctattgctaatagtgctgcaacaaacatgggagtttttgatatccttgtgataaactgatttcctttcttttcagtatacgcctagcagtgggattgctagaccatatgatagctctacttttagtttactgaggcacctccaaactgttctccaaagtggctgtactaatttgcattccaaccaacagtgtacaagggttccctttttttcaacatgcttgccagcatttgttattgcttatcttttggataaaagccattttaacgggggagagtttgtacttttattaatgccttctccaatgatatatccttgcagggaatgagatgcctttgttagaagagttttgttcttctggacaggggtatgacatgttttgtgcactctcctctcctccatcattttttggtactatgtattgctactgtttgttattatcctattcaaggtagcagctctaacaggttgtttgtctattatttctttctggaacttctttaaaacatatcgtggggtgcgtgtgtacgtgtgtgtgtgtacgtgtgtgtgtgtacatttaataccgctgaacttttttcttcacacttgctccctctttatctcccattgttctgtcttcaggaacatctcctacctagtttgttttgtcttgatttagtactagctcacttatttagcccaccttaatacgtaatttaatttcaaaaacttaggttttatatttctaaattttctgcgttttaccactaatttctgcacttcgctgaactaaaatgtgttcttgttagataatagatctgattcgccccctgcctctactggggtattaaatatacttgctttactgtccactattatctctatttcttccatgagggtttctcccatttgcagagtctgttggctctcatgatattggcctttgtcagacgttttgtgattcctgcttgtacatccatggggatgttctcccacatgtcttttcggttatgatggccacttggctggttccctatcacaggccctccatgcttgaggtgagccctgttgcagcaatctctggttagagcattgcctcatcacctgctttcctttctaagacaaatcattctttaatttagttttattgtcataggttatatttttactcatctttaatgtttacatttcacttactttctcttttttgctccaacttggggtcatatttttgaggtagacttcaatgttttgaataatttgcttttattgtattaagtacttttggcatgtttacgaaaacatacacaaagcaagggaggatatctatttattcattttcttattatttcttatctaacgacttccctgtacatgttcatagattctagagacttgatgactattttttaaatgacaatatttggttgaaatatcaatttttaacatttgtattcaactattgtaagtatactaacaatagcatagctatctatattgttgcttatttgatttgggtgcttagagccaggtattctatggtataagttttgttttcttagattcttaattttgttcaacatctcagtttgctggtcatcaaatttaagtactttaaaaaaagaacatgcgtatttttaagttcctatataaacaaaaatgttttcctactgtctttatcaagaaagatgtcattttttcttttaaaacttttcatatagttctccattgtcttgacagttagagctgttgagaagtgtgcagtcagcttaatttttgtctcttttgtagattaattactttttctttcctgcccggaaacttacagattttgtcctaacccttcttcctgggctttctttgcctgaggcaagttttacaatttttaatgtttgactattatttctgtcacattttctatgtattcttcacaattctattgtatctcatttttctgtcactattactcaaaaataatttcatcatattactttcatttatttgttcacaatgttgcattcttggaaaatttgtcaaaaatattactcaaattatcaacttagttgtccaggacactaattaagctgattttttgatataaagcagactaaaaaatagaattagaatttttaacacaaatagactagaagtttatacttacaaagttcaaatgatctgctcaaataaaagaatggtgaaatataatgattattgaaaaacttccatactaagatttataaaaaaaaaactgaaaagtaaattgtggaataaatgtgtgtctgtttatttgaatatcaattcagaaagatgctgtgtcatttttaaaattaagcaagataaaataatttatagaagagtgaagagtatattgaacccatacagtaatgctgtaagtatggtatttacaagtccattccatcttagcatacattgttcagtatcgtcctgcacattccatggttgaaattgcaaacttgaaacaagttccagcattatactgaatgggcaaaagctgggggcattccctttgaaaacctgcacaagacaaggatgccctctctcaacactcctcagggaggaaatgacctggccttttggaacttcagcttcctcatctgtgtcctattcaacatagtactagaagtcctagccagagcaattgggcaagagaatgaaataaaagccatccaaataggaagaaaggaagttacaatgtctcttcagataacatgattctgtatctagaaaaccccatgatctcagcccaaaagcttctttagctgataaacaacttcagcaaagtctcaggatacaaaatcaatgacatggaatcaacctaaatgcccatcaaagatacattggataaataaaatatgatatctatacatcatggaatactacgtggccataaaaaagaatccaagattatgtcttttgtgggaacatgaatggagctggaggctattactcttagaaaactggtgcaagaacagaaaaccaaataccacgtgttctcacttataagtgggagctaaatgatgagaacttaggaacacaaagagagaaacaacagtgaggtctacttgagactaaagagagggaggagggagaggagcagaaaagataactattgggtaattggcttaatacctgggtgatgaaatagcctgtacaacgaatgtcatgacacaagcttacttatgtaacaaaccttcacatgtacccttgaacctaaactaaaaatgtttaaaaaagaagttcacaggaaaaatacagggtgtataacaaaaataaaaggaaaggaagaaaggaaacacataatacagatgactaaataaaattatttttgtaaaaatttcagaacactaaagttataaaaagtattaaaagttgagtcaattaacttactcgtcaacatgagagagggaaggagggtctacatcatcacatgaacttctaatttaagctcctggagttcaattatgcttaaattggttgggctcatgaaggctgaaaattaaaagactgtgatacagtagagaacatcattaagagcagtgtaaagttaagagcatatatatggactgaaacaatcttaggaatgactttgaatttaagatgaaaaagttttactcaattttttatgcactgaagtgcacagagtttttggaggagggatgtgattcaaatacagctgcatatttacaaaattaaactgaccatttctgattttgagaaggagagatagggaaaccagatagaaatccattttaataacccaaacaggcatttgcactaactagatcggaatgcaaaatcttgtaatatttcaggagatgttataaagttaatttagctgaacttcaaaatagaagaggatcaataccaagcagacactatgtattagttagcagtacatagttatgagtgaccagattttctcttgtgtgctttaagacaaatgtgacagggaaaatagtaggtggcaacagggttaaatttttgcactctctttgaaacttttatatctaggctgttgattcttaagttcaaagatatttatttttcctaaaaattatttcccttattatcggaaagcaagggtattcttccagcctcttgttttagcacaactcagaatgatctgccaactgaatgttcactacttatttaatttttaaagggcattacgcacattcaaggtggaaatcttataaaacagatttggactttgtgacccaagatatggtttgctttaaggagggttcggaaacagtgttaagaatgtgggaagaacacttgtagcaaagacaaaagcaaattttttttttttttttttttttttttttttttgagatggagtcttactctgtcacccagactggagtgcagtggcgcaatcttggcccactggaagttctgcctcctgggttcatgccattctcctgcctcagcttcccaagtagctgggactacagcacctccccccacaacaatgcccggctaattttttgtatttttagtagagatggggtttcatcgtgttagccaggatggtccaatctcctgacctcatgatccgcccaccccagcctcccaaagtgctgggattacaggcatgagccaccgtgcccggctgcaaaatgccttttaatgtcatgatgatatgctcaggcttccacattctgtcctaagtagcatttccacaggactacatgcatgttcccactctctctctctcactctctctctctctctctctcacacacacacacacatatttcttcacattctaaaaagcatattagatgaggatgatggcatcatttacaggatttagtcgtttttagtagaaataaccccatattcacattctctaattcagtgaacactagtcaccatggaggtgaagcaatgttcagttatgtggtgttccaagaagattaataagggaagtaaaaacaaaaatagaaaccagattcttttgctattatgcaataaatacaactgtaaattctttttcatagcttgtatgaattcatattaatagtgtatagccagcaaaaatatggttgaaaacacttctcaaaattatcctatgaatctttccttgtgggcacactgtgatgtgttactcagatgccccggcaaataagaactcactgctgcagttattgagaagactctgagcagatgtctgtcagccattagctccttcaaggattgccttagctaaggaaggttatctccccaagcctgtgcctcttctcagggtccctcacgtcgaatgactgagctttgagagattataatggcctaaagattttgtcccaactaaagacaactctgacgggtcattctacctccagaactttccatgggattaaccaagaccatcttgggtctacatcacagttaagtagctttctctgcccaatcctgctgtctctcccatcttcctggaatgctgatcccaagggaactccccaataaacatactgcatagtaaatgccattaaagagtgagtttcccaggatcccaaattgtggcattatctttcattagaggactcggggggcggaggcaggagaatcgcttgaacccgagtggcagaggttacagtgagccaagattgcgccactgcactccagcctgggcaacagagtgagactcagtctcaaaaaaaaaaaaaaaaattagaagatgttaatcaaaacagatcttcctcatttatgtcttaataaaagttgcgtgcaaggttcactgcaatataaaagttaagtttctcttttgaaatacccaataaggaagtgctaaaacttagaaaatgcaatcgtttgctagtactgacagagtaacaatggaacagctgctaatccagggctatgcttctctggcaaggagaggacaaaggtaatttttccacaaacagcatttgatagatcaaatgtgcttttttgctttcttggaatctccaatcatccaggaacacaggtgggataaggcagtagacacccaaaatgtaagaaaaacattggtttatgaacgtatttaaaaaccacataaggtgaacaacagcaatttatgttcagcaaaattcttaggcaaaagtaatttatgtaccttcctttaaacagggacttacataaagcaactattagaatttgattctaataaatcattattatatgattctgtcacattttgcctcaaaccatgcctatgaagcaaagtcgggtctaataaatctttttgctattatcagacaaaattccaatatttcacaaaaagcagaaatgccatttcaacggaatttgataatactatgtgtcataaaaagataaaacgtataggcttttaaggggaaatcctgaattttttccaaattaaagtaaaaatccttatatcccattatgtgctaaattgtgtcctcccctaaaaaagatatattgcctatattctaacccacagtccctcacaatgtgaacttatagggagatagagtcttcacagagacaatcaagttaaatgaagtcattatggtgggtcataatccaatatgacaggtgtccttacaaagaggggcacagggacagacacgcacggagggaacacagtgtgaaagacataggaggaagaccattgctagctggagtgatgctgccacaagccaaggaacacctggggctgacagcagctgaaaaatgcaagaaaagatccatgccctacaggtcccagagagaggagagcctgccaacaccttcatttcagatttttagcatccagaacagttgttctaagccactctgtgtttctctgttatggcacccccaggaaactaatatgtaaccccaaacttttaaaaattgattttggtattttcttattttttaagattctcttgacccttcagttatgtgatttgacaccatattacacacatacacacacacacacacacacatttatgtctacttgtgagaatccatttgtatggtattggtttcaaaagccatacttgccatatcattactattttataatattctacatttttattcttaaaaaatgcacattatgttaagcggaagcactgaactttatataagaacatgcgcttgaaggaagtttggtacaacatcactttgagtaactgcaaatttcagcctgggtttaggaagctaaatttgaataaagaaactgatcatttgtaccagttctaaacaacaatgacttgtcagttaatacaatttggtaactcaagcataatattaataaaatgcatttatttcacccaaactctgtcttctttttagctacactcatatcataagtttctaactgggcaagttaatggccccaattattaggttaagcaattttggaggaagaaatcagagtgatgcttttatttttaaaaagaattaagaaatttttaaaaggcattctcagtttgtagtaataatgactaagttttaaaatacattcctcaagcatagtttaggtcctcagtaaaatattggatgttacacagtgttagttatttcaagatgatctcatatcctcctgcagacatcacattctgcctgtgtcatcacatcataatctaaaggaaaatgatgattccctcaatggtcataatatcaagctaggaaataagaagaataggaagttatcagtgaagagatactgagatatatgtaaacatatctctagtaataatcctctctggctgggaaggctgaaagtccattaggaacagttatacctcgtacaaaatgctatcattggaattcctagccaaagcaatgaaactagagaaaataaataaaaagcatccaaattagaaatgaagaaataaaactatctctctttgattatataattatataactagaaactcctcaagacttctccaaaagacttctagatttaatacattaattcaatgaagtctcaggttacaaaatcaatgtacacaaatcagtagcactgctatacagcaacaatgaccaagctgagaatcaaattaagaactcaatcccttttatgatagctgcaaaacataaaataaaatacctaggaatatacttaaccaacagatgaacaatctctacaagaagaactacaaagcactgctgaaagaaatcaccgatgacacaatcaaatggaaatatatcccaagcttatgggttgaagaatcagtattatgaaaatgaccatactgcctcaaagcaatctacagattcaacacaattcctatcaaaataccaacaacatttttgaaagaattagaaaaaacaatcctaaatttcatatagaaccaaataaagagcctcaatagccaaaataatcctaagcaaacagaaaaaatctggaggtatcacattatccaacttcaaaatatactataaggctataataaccacaaaagcatggcactagtataaaagtagatacatagaccaatgaaacagaatagagaaccctgaaataaaactgaataccactaactgatcttcaacaaaacatacaaaaacataaattgcagaaaggacaccctgttcgataaatggtgctgggaaaactggatagccacatgtggaagaatgaagctggatccctatctctcaccatataaaaaccaacccaagactaattaaatttatcttaaatttaagacctgaaatcataaaaatcctagaagaaaacctagaaagagctcttctggacaatgtcctacacaaagaatttatgactgagaccccaaaagaaaaacacaagcaaatataaataaatgggacctaattaaagtaaaaggcttctgcacagcaaaagaaataataatcagagtaaatagataacccacagaatggaagaaaatatttgctaactacgcatccaacaaaggactaacatccacaacctgtaaggcactcaaacaaatcagcgagaaaagaaaaaaacaagaaatcccacaaaaaagggagcaaatgacacgaatacacatttctcaaaagaagatatacaaatggccaacaaataggaaaaaaatgctcaacatcactaatcattagggaaatgcaaattaaaaccacaatgaaataccaccttattcatgctagaacagtcattattaaaaagtcaaaaagcaatagatgttggcatagatatggtggaaaggcaatgtttatacactgctagtgggaacttaaattagaacaatctctatggagatttctcaaaaaaaactaaaagtagatctaccatttgatccagcaattccaatctgggtttctacccaaaggaaaagaagtcattgtatcaaaaagacacctgcacacgtatgtttactgcagctctcaattcacaattgcaaagatatagaactaacctaagtgcccatcaaccaatgagtgaataaaatgtggtaagcatacaccacattgaaatactactcatggaatactactgagttataaaaaagaatgaaataatgtattttgcagcaacttggatggagctggaagccactattctaattgaaataactcgggaacggaaaacgaaacaccctatgttcttacacgtaagtggcaggtaagctatttatgtcttcacaaaagcatacagagaggtataattgacaattgagatgtggaagaggggagagtgggaagagggtgaagggtaaaaactacatattaggtacaatgtacagtccttgggtgatggtgcactaaaatctcagagtttacaactctgcaattcatccatgtaaccaaaatcacttgtacacataaagctattgaatattttttaattattggaaaaaagctattgcttgttaataagagtaaccacaaccattttaaacaatcaaaatacttccctttgcagaaaatggtcccagaataatctgagaaatagacctattttatcagatcttcgcttctgcagattgctgtggtctaatcactcacagtttggattcaacaacagcacccacacatagctgatgtcccaaagatgtcagggtattcacccaggtaaccatgagtcaggaaaacacaacacttcaaagacaatgcattgctttctgactcaatcacaagactattaccccaggataagagggacaaacaacatattttcattgtattttaattagcattgttttattttatgtattaatacaacttaacatgttccagctttctgtgttaaattgatcttagagccaggcatactcaccaaggtgctcagtgctgcccatcacaggaaaccatcccaatgacaccatttcaatggtgagcaaagtgatttcctaatagccttaggttgcctaataagttaattacattaattggtttatacttccaatcttgaaattttactggtagatgtagttactacaactacaatatgttgttttttgtgcgttattggggtagaatacgcagaaaagaatatgctgaaaacaattttcttaggaaagcagctatctctgggagagaggtttggatggggaaggcagggagaagtggcactgctattagagtcagcacattgagagagaagcaaattgagtaaagtgatgtgtaaattggggaattctcaatagagtcagaacaatgagcaatttcagaaatcaaaactacctatctggacattcattgtgttactacatccattttgatgcctgcaaatccgtcgaaatcattaaaggtgttcaaagttctttgttaaggagtgtttagctattctcattctagttataaattgcacatcataggtaatcctgtacttaccagttcatgaagaactttttgccatcaaataactctctcagctatataaaagcttaaaattaaacaaccttttaatgttctctacagatcagaaaaggatgatgcattagactgtgtctggaatagtcagagaaacattctgatgggaaatgacctttgatctgagtcttaatgaactagcatttccaggtggacagactgggtaaacaaggaagggagtaaaagtgagaagttatcaaggtcgttgttaaaagcatgcactggtgtcacaggcaggtgttccaattccaattttcctgtgtcctggatgtattaccaaggcaaggactctaattttccttgactcccattttcccatatattaaacaaaggctataaaatacggacctcctcaggtagctgaaagacataaatgaaataatgcatgtgatcataaagcctgtgtacctgaaatatagtaagcattcaataagtgttagccatcattattaccctcacatcaaactgtgggcattcaattcaccatgttttttttttctaagagaaattagaacaaaaagaatatagatattaaaataatagagctctgaattgatataaaatttggaatatttccaaaatactttttcaaaagtaattattacatacattaatgaatcactatactacatatatatcaataaataaccacagttatttaagtcactttcagctctaatctataggaatttaatgagattttaaactctgattattgtcagtacttgtagaaaatttgattatcctcaattcatttttattcttattttgttctccttgctaggtcaacctagacttttatagtgatcgtagcctcacaaaataaaatctatttttcaaaattgaagtgttacctattaaaggataatagaaagtctaaatcagtttttccaattttctcccagcacaataatgatacagttctcatatttatttattcttgacctgtcaggtcggactttatgttattgaattggctttatatttcttgcattaacagaggggatagaagcagaggacaatgaactagacttagtaattttctaacttagcctcagcgatgactcaattactctcagccaacaatccttgaaaacctactgtgtgtaaaattctcacgagctcacagaagcttcttcaagtgatgttctgatatttatgcagttgtaattgaaatgattcaagtagattataagtcgcttgaaaaagtaattatttcactcatttattatgcatttgcatactatctaattttgtgctacaaattggtgcccttaaatgaagacttactgaattaaattgaataataacatactatcggtggctcttattaggaaaaattattaggcaatgagaaatataaagaaatgttttgccaactcagactcacaagaagcagagactttacacagtattgcgcttcattatcagttcaatttcatatacgtaactacgaagcagagaggaagcatgaagtcttgactctccaatacagctctggacatgcttatttgctgcatgaggaagtaccttagccctgatttagcaaaagagctctctctaaggattgcaagcaccatcacttatacaaacaaagccattttgatgatgaatgttatattatagatgctataacaggtcaccccaatgaatagagaatatttcgtgcaaaatgggcccaggacttttaagagcaagagctatgtaatgaccttgagctctactcctttagaggattatggatatgattctatctaaggacacataccttaagtgagtctatttctacgtaagtatatttgagggagcatcatttgttactttgtgtcaaaatcccttaggctatatttgacatgacaacttattaaaagcaatttcttgttttaaggtataaagaattatcactcacttaagaacaatgtgtctttgatgcaaacaacttcctaatataaattttcttccctggaaaaaaaaatccatacctaagtatttacttttcttccttcctcatttaattcaagcctgtacaaatgtcacttactgcagagatatgtccccatctaaaatagtaatccatcattcattatcagttcccttactttatcttctgtcttatagcacttctcaagacctgaaagtgtagcatttatttatttgtttacttgttatagtctccctcctcagctagtgtgcatgaaggagaaacctaaaaagtgcttataaattagcagatgtttcataaatatttccagaagaaataaatggattctcatcaaaagaacatagcaggtgcactaagtctgtgggtttcttctgtcggcttttctggaggcatagttttgaaagaccaacttttttaagtttaagatttaattgacgtttagagcaatatattttgcagataatatttattggtgtggtagactgcataagggccctccaaaaatctacatcctaatcctcagaatctatgaatatgttactttacatggcaaaagaggctttgcagtatgattaagttaaggatcttgagatgtagaaattattctgtattatctgggtgggccccatgtagtttcaagggtccttatgagagaaaggtaggaggatctgtcaacaaagcgagtcaaactgtaaaatatttaaagaggcttattctgagccaaatatgattgactaaggcccatgacacagcctcaggaggtcctgagaacatgtgtccaacatgattgcactatagtttggttttatacattttagggagacataacatagccatcgatacatgtaaggtatacactggtttgttctagaaaggtgggacaactcgaaggttgggggggcgggggtcgtgggggagggtgggttccagtcagaggtggattcaaagattttctgactggcaattagttgagagagttaagttattatctaaagacttggaatcaatagaaaggagtgtccgggttgagatgaggagctgtggagaccaaggtgcttattacgcaaatgaaatctccaagtattaggcttcagagagaatacgtgggaaatgtttccaatcagatctaaaaaggtaccaaacacttaatctctcctggatcaagaaacatcctgtaaagggtctacatgtagagaatctacgttctctactgaatgtagatttttcccagaaaagacagcttagcaggaccatttcaaagtaggtaaaagaaatatatttgggggtaaaatactttgatttctttcagggcctgctatgtgtcatgtgatgctgtaccagagtcaggttggattttggtatcttattgctagagagtctgtttagtcagtcttaagatctctgttttaatgttaatgatcagttgtccccgaactccaaagacaggagagtataatgagacacatctgacctctccttcccatcatggccagaactagtttttcaggttttctttggaatgccctgggccaagaggagaggttcattcagttgactggggggcttagaatcctatttttggcttacagttcaaagacagtaaatgtaatctgacaatacaagcaaagagagaggacagagagattagaagttgatacgctgctatgtttaaatgtggactaagaagccacctactgaaaactatggataggaaggtggcaaaggcaaggaagctgagtctcccctagagcctccagagcaatcagttctgcttacacctggactttagcccactgactgattttagacctctgactttcagaactgtaaaataataaatgtgtattattgtcatccactaagtttatggtaatttgttggaacagttacagaaaactaatacaattgataaattctgttgatcacatacaacattcccaagaatttctggacagatttttttttcttcttaatttaaagtcctagatacttgggaaggtgaaaacaaactgtgtgagaaaacaaccctcatgaaatctacatatagcaaatttgctttatggcaacttcacatttagtgctagctggttgttgatgagaaacagggaaaaatcctaaagattcttgttctttctgcttgtggtaggaaaggaatctaaaattctcaattcttgtttaaacgtgatcttaagtccaatattagtttgataggacagctataacaaagtcccataaactgggtgatttagaacacaaaaatttattgtctcacagttctgaaggttagatgtccaaaatcaaggtatctgcagggcacatttcctgtgaaagatcccagtaagggtctttttcaggcccctctcccagcttttggtagcaccaagtattctttggtttgtagatgaatcactccagtcacaaggctgttcaattcttgtgtcttcagtttttttcctctgtaggcctgtctctgtatcccaatttcctcttttataaggaccaattattcattttcaaagagctatggtatatcagtataacttgacatctaaataaagaaacatttaatgcataccataaggcattatgcatttatttatgcaccacaaaggcatatgtatttatttctaactctcattctattccaggacatgatgtaaacaatatttaaacatagaaacgttttttatctcacattttagtatctcaatttagtttctgaaatgaggaaaagaaaaaaatgagatgaatttcatttaacttcattcaataaaaattgtgtcattccttcttttaaatgcacagactcaaattttattttcagagataatgagtaagccacaattgcaaaggtgattataatcaatttggactggtaacaaaatcaggtggtcagagagaagctgaactcatttacaataatgaatcaactcaatgatgatcatttctgaataactgcattccggtatccaacacttgaaagggaatataaattactatcatgtgcttactataagaggcttctatcagcattattgcctctacattagagaccattaaaatgcttattttaaactaaggaaactgacgcggaggaaaattagttaacctgtccaacccacatagattgtaagagctgaagggaagatttgaacccatatgtgatgctagagtttgtattcttaaccactataacatactggctcccatatatcccatagctagataaagtattattatatacctgaatatcttctctgtaagctttgggcagagtcagagttaatatgctttgcacacagactcacataggctcccagactctccaagccctttcttacccatcctccttcttttctttctcactcactgacaatggaatataacaattgcagtggattcctggggggattcaagtggtcctgaactaagaaaaaaacaaaaatataaaccacccatttccaatgataaagatttaaaacttaatttacatttcatacaaatcaataattttagtcttattacactaatgtgtagcataagcttatccaactaaatcacagtagaaaatctatggacagaatatgtgctaatgtgatctttgcaaactccgtcttcttggaagtacatgtcttctgtctgagtagagttgaactatcacttcactcttcttaataaaatcagttcaatatcagataataatttggagaatttggagaaaacctgtgaaaaacaaggtttgttctatgttgtatcacagctctagttcttataacttggcaggttagtttttttatactaaagatcacaatttttggtgttaaaaatataagctaacaaattaatatctccttatatattatgattgtacaacattttaaaagactaaatcatcaaatactgaaattcaaattaataatacaaaataagttgtgaaatccaaaggtctttgtttatataactaaaatatatatgtatatatgtatgtgtgtgtgtacacatatatatatgtcaagacaatagtgccattgctgtatatttttctaattaaaaatctagcagttgccctttatttatctgtgttgagtttcctggctatgaagctacgttaacactgacctagatcaatacacctcagcaaaaccctgtaagcaacaagcttagaaaggaattgtgtttttactattgacttcagaataaatctcctaatttcttagctgaagcaaacacttatttaacaaaagctgagaatacagttgtgttgtttcttaaaacaatgcaaccaaatagaagtatttttactataaaattctccaattctattttaataaatatgtgccagacttaaaacaaagtaatccagtgggtcaagattatatgtatgaagtatttaaataatgcaactatttttctaattataaaagcaaatcatgttttgacagggtttgaaaatattaaaattataaataagacagtcatctagaaaaagttttatatagtcacaatatttggcattacaaaacagaaacaactttgcataaatttattttaatagctttggcctcagtgaaaaatgtcttagagcccaaggccagaacagggcaacatccacgttctgggctgcactgctggactggagagccagtatccagtctggctattcaccatatagctgagataggttcaggggtctccagattaccccaggtttgtagagtatatgtatgaataccaatttgtggagtgtctattattccctaccagcgtcttaatgcccccaaagcatgaacattatctcagtcttagtaactggcagcctctcaaagacccccatccaacctgccctacttagtgcagcactctcagatatacaacatccctgtctacaaccggtcgggagcgcggaggaccatatttgggccccgcagaagaatgtggaagattttctgagtccactgctggcaaagacatgcattacccaggccaaagagttgacaggtaccctgcaggtcaagggctactttgaccagcagcgcaaagcctggctcctgaagaagggctactgaggtccagcagagcagcttgcatgacaatatccccacaagctgcactccaaggaacctcaggaggaataaggtgggttttggagccttgagacaggcaatccagagactcgggctaagggatttggtggggcagagtgaaggccaaaaggattctttgttaggtcttagttgcataaagtgggaaacaagaccctatgtacaggtggcagcactaggtgagcactacctgccaggaacagccaagctagtgggggctattagctcttgtccctccccatcaccttggcccatccctgctttcccttcattggtgctccttgggtgcagctattaaaattctaggggttgtcacctggtgaaagcaataacctaactccatttaggagactgtagcagagggcagattcattgggtacattccttccttggtcctctggccttccagagctcactgccacaaatttacctgagcccttgtcctagttcagacctggcttggcagaggctatggagaacacagatgattcaggcatgggtcttgggggtcttctgttccaagtgcagtgctgagcatgagacacagagttcctctgttagccactgaattatttctacctgatggaggagtaagaggcccagactgggtgcctgttccattccagaccagacttgggtctaaccgggtttccagctccaggagattaagtgattcgctttggcagggctggccacaagcagtgcctgggagctccaagtagtccagtatagggctatcctccccagcctgctgacctggaatcaaggctggatgggggtttgcaggcaggaagatgctggcctttaaacccggccatcccatcccatcccacccccaatcagctagccatcacacccaggccatacttggaatcacaggcgccaagggcctgagttctcacccccatcccatcctagcatcaaactggctaagacatggttcagatactagctctcctccatggtctctgacctaaggtagggtactgaatttctttgggactcagtttctttatatgtaaaatgggcacatctttgtaaggatattcctggcttacatgttaaaccctcactcctggagactccaggaccctctcaagtctaaagcctctgcaaagaaaaggagctcaatacattgatttaatgacataagccccaccaatcattaatgcaaatttttagttagctgtatatacgattcaagctattaaaatttttacaatatttacaaattagtcttccgaaaaaaaaatgccttacaaggaactagtactgacaataatgacaagtcaagattatttgaattgcatcaaatatttccataacacttataaatataaaataagacataaaaataagaataaaaatatgaaatgataacataatttaaaataagaataagcatatgcatcaaagattacttgcacagctagaagcccgctcagaactctagtcagttaaggagcaaaatacacatttaatagagtttcaaataaaaagttacttctggaatgtatgggaaagtgactatgttcccaaataatttaaaagttgaatgcaatcttttagatttcagagtgaaagtgactcttgattgtataatttattaaaattagaatcagagttgcgtttgggccaggtgtcagtaaacaaaaatgagtgactctatctctagtaactccaaattcctccttatcacttactgccttgagcttctctcctcagttatttcgtgtccaatgacaaggttcacctgatagactggtgtggccatagggaaaattaccgccagggtcccctcaggctggccagtattcatgacaaactgttaatgattttgaaaatcactacctccagtgtttccagagtctttaactgatgaccatttacaaaagctattcatagaaatataagcctgatatctaaatgaaacataaggttgctctgttacatctcctacaatgtttgcattttaatattggccatgcctagtttaagccaaagggagcctcattctctctgcttcatgtttccaaaaagagaccgcccacacctcgacttccgctagcctctggtatctctccatgattcctgttcactcttgttggaaatggaggactggttcctctaattggtggatttggaacaaaaaattcagatgtgctcacctcagcctctcctcttctgctttttatggagctaatctatttagctcactggtatcaacccacgtatctggaaatttgcctggattataggatgggcttcagaagtgtttaccaaacacttacaaacatttaacaaatgaataataatgaatctgttgagtcagtaactgaatggataaatttcatataatgtgtcaaatatcagcatgtccatttggtcaaagatctgaatctacattcttcacatggtttgtcagtatttgagtaaataattttaagtgcatctatgtgtctttgatccaactctaatagtctcagaattcagtcatggacaaggggtatattacttgttgtttgttctgaaaccacttaatagaattgaaaggaaaatacagcgaagaagagttaaagttaatataatagaaaacttttttaaatggaagcttttgaaaaaccaggatgtaccgtcgcgagtgtaacattcacctcaataggtgaatattagtagagaatagatacttgttagataagatgtagaagagatgatcccagcaccagagagagaattggtcagtgtcaagtaataaaaacaggaaccactccagatactgcaagagaagaggggccaaaagcagggaataaactacaaaattgttggaagggcaaaaatcaaacaaccaaaaaaaaaaaaaaaaaaaaagaagaagaaaaggaatattggaagagtgaaagggagaagggaatgaagggaatgttacctagttatcagggctgtcttttcaattcaagactcaacacaccagccatccctccagctgatctgctaaagatgttgcagaaacaaaggaacatggattccatggatgctactgaaacccctactgacatgttggtgaccctgtcacctgaagttgctctcagagcccatagtcacctccccatgttatcactgcaaccagagacaccacagtaacagaaaataaataattattctttctttctccttaaaaaaaatgtcctgcaagggcttcgcattggccaaatcttactggaaacttgttagcaagggagcctgggaaaactgcttggcattcttccagctccctgccatagaaaagcaaagaagggtttgaatgaagctgagagccagcaagcaagcaaccagaataccagataatgtattctttcacatttttcaagatccaacagaaatttgttagaggaggaacactattcactattaacctctctagaaattacagcaacagaccattaaagacatttagaataaataactagcagctacccacagtcgcaaaaatatttgtactgaattacagctgtcaaagtatatatgacagcttacactgtacatggagagaatgaattatagaactaagaaatgccaaacctaccgactttatttatactcataatgcagagtgaggaaaaaatggtgtgggcaactttagaaagccttcaagaggagatcaaaggtaacgtgccctggtaggggaggtaggatttcaatgaaaggaagttattttatactgatagagaacataagcaagggaactgaggctaaatgggagtaacaagtatatggagaacatggaagaaggagtaaggtaagaaaaatcagtctcactcaaggatctgaacattaaaatagggtccaatatggcggatatagttatacttaaggtgtggaaaactacagagtattgaggaaatgatgaaaatagattcctttggagttcactttgttagattttatttcacaatgttctatctgaggaaggctgatattccattcttgattacaatctataaacagtgattagcctaaaatatatggaagtttgtttgggggggtcttccaaatctgacttgaggtgttattttgagtggtattcgcagcaacattccactttttctgacttccttttcctttctatactaatttgacccccatttctatcctactatataaatatttatacgacattaatatcagcaataggaacaaaccactctgagaatgaatatagtctaacagttaagagaatgaactctggagccaaactacataaattcaaaacccaactccacaagtactacttatatgacctttgatttacttaaaattttcttagcttcatctttaaaatggggtgatggaagaatttatcatctaacattgttgtcagcattaaaggcaatgataatgttaagcactggccttagggcctgacatatacaacatcatgtaagggttagctttattttttctgttatccccagcatgtggttttaacttgtgcataagttctccattttgacaaaggcatcattatcccctgttgcaactcatttcattttggaccactgaaatcatgaagtcttctctatacgtttcttcatattgaatttgttataatttccagccattgtttctatttctacctttgacgctacctagaattcatgcaccacattctctcttgagtagggcaggctttcctagattgagagagaaataattaccctcttccaaattctcttattttgctcatattaatagcactgttcttatattaatacttcatattgtatatttcttagatctacatgaacttgattatttgcctttggatctccatttgccaatatcattctcaaacatcctagtaacatctgccatctcatgtccaaagatatgcacactggggaactctcaaatggccagtgggacggacataagtaaactgggggccttctactcccccgttgatcacctgtgtacgaaactgtccctgtcacctgcaaactgtgacttctttggatacagtgttcaaaataatctcccttacttggactaataaactgaatagagataatcccagaagagagagacaaagatacactatcagggctcccccttcacatttgtgttcagcaaatttaagctgtaaaaatgaaacacttatgctgctttcaaatgatcaatattcacagaagtgtgtcatagtaaccatggattaaaaattataataatatgtattaaagtaacataacgtcttaacagggtcaaatatttttaatgatttttacagacaaatggttcctctaagaatgctaacctattatttaatgaaactgtgttaaaaattaaaatcaattaaccaagttttttcctcagccattgtattttatattagcaatgtgtttttcatatatgtttcatatgtgtatatgtgtgtttctcatatatatagcacatatatagcaatgtgtttcatgtatatgttttatatacatacacacatacaaggtagtgaagaaccattgtgtgtgtatgaatgtgtatatgtgtgtgtgtgtgtgtgtgtgtgtgtatatatacatatatatatatatatatatatatatatgctgtacaccaacattgcccagtgctaaaactatatctcacttcaaggaaatattataaaaatagaattgtgaaaattccaaaagacaaaccttttctaatagttgtaccatatgtcaccatatcttataaaattatatattaacttgagaaaatccagataaaaatattttactaaagataaaaccaatgtccattttgtagaactcataatctgctttgtattattctaatgcaagggcaggtcagtgcaattaactttgggtgagagttgttcttctccacctgtggtccttggagagctcatccttctaggcttccgggtaagctgtcaggtgcactgccaaccaagattcaggcttagattaaaccttcagggcccacataacaatttatacccttgacaatttttttctgctgattgaataatggtattttatggcccatttaaaaaacaatgtatttgagcacattttatttgtactaccctaagttgctgatcctataaaaaactgtaagccaactatagtgtgccgtcacatttttggagttacgtatttccctaattgaatttgttgatttattgctaacaaagataaaattttctatttcagccaattttctgggatgtgaaattgcttcaacatggaagcaaattctatgactttgaaaaaagtgcttgaaatccatttagtcaccaaaatattaacttgatagaagtgaaacaaccaaggaaaatgatcctgtaaagtcttctttcaactctaaaataaaattattgaaagtacagctgcttgagcagaaaagtagattgtgacaacttctgccacttaaattttctgagtatagagtaagtttcataatattctagaagaatattataattaatgattatcaatttcttaaacttttatgaaatttcattatgtaattaatatttcataactaattaatatttaaataggaaataaagtatttccaaaagtccattacaaatacaaaatctcatagcaggcaattggaaatgctgtactttttcgatctttctaaaatggaaaaggcatgttctcaatttttttctgaaattttattctataattgctagcttagattagaaaacaaaaatgtttgattgaatttcctaaaaggtttctattaggtggtaggtattatgcatacactattaccttatttaataaaatatctgttgtttcattagaaattttctacttatgatgtttgatataaacccccatttggaaatataaatctatctttctcagagcaaatagaaggacattgtcatgcttggaaatctccaggtgtgtctttgtatcttagaaagcttaatgtaataccatcatccccaaatttgcactaagcttggcaaaaagaacagcaaatcccaagaagcaattaatcttttctatcctactgaagacaatagctgaagttttagaattcaatattcagtcagcatacagaaacaacactttgaagttatataaaataaaacgtgatgactctttaaaaatagttttaaaatttggctgtactccacaaacatgaatctatgctgtgccttctaagtacactctcgcatttcttccatacagacaatgcaatgcaatgacatcatttcattatatggaatgttggaaatatgcaaatagaaaggtcagcagaagaaaccactgcagaaagaagcttggtcaggacagcacagcaggaaacagattcaacatccttgtctccgacctgtgtttgcctatgaacccatcctagtcaccatattgaggtctgatcctaccagcaccaaaagagtgaagtaagttatacagagaatggagaagtgtattattataaagtgccagaaattgttgctgcaggattactacggaggattaatctagtaggtagcctaatgttttcccttcataggttaagttgtaaaggatgttaagataccaggtcaagcatgccaaattacttcccaaaattgtagtacggctggcaaaggatattttgaactcctattttccaaattctaactaacaccaatagggaattatgcttaggtgggaaaaagatgaaatggaaagcattttggaaatgaggggacacgagaaaagaggaagagattcattcaacacacagctaccaatatccataatttggctactcaagccacactgatcctacctgaatttcacaaccaatatatttggcttaagaagaaagcagctaatctgacgaatgcttacagtgttgaataaggagattgatgcttttttgtaaagccacatgcacacggaatactgacgtttcagaagaaaattcaactgttgaaattctaacacattggagttggcaataaagattgtcacatagtccaaattagtaagattcttagctctcctttttcagaaacaacacaaatgattgtctagcaggagaatctctgccagaaagctgacaaaatgctgcttttgcttcatttttggaattttcaaatttagaatagtaaaagaagaatttggccacaaattactgacctctttgttttggcaacataaatcaatggtgagaagtaaaacaggcaatctgcgaaaacaacaaagaaaaccaagttaaaacaaatattgattgtaagtggagaaatgcaatggagaaatcaatcactattataattcatcattcatagaaaaaatacaaaaatagaaaaattaaaacttaagccctgaaatacaagataagccctgaaatacaaaataaaccctagtcaatgaattctgaaaaccacatagaaaatactctttccaaacggtcccttcctcctttatttactgcttcactgccagcatttcttccatttacattttagggaaattattaagtttcaaaagatccacttcttttggtaatatccagttgttaaccctgaaactctgtgactggctgggtctatgtggcaaatgtcaatggaggtaaccaagatgcttgtaattttctaattctctaatcttctaagaataagaaagctatttatctcatgcttttttatgaaagtctttctcccagctatttctgacacatggaagatcccaactctctaattaggacccatgtttgttatgaaaacttctcttatttactcagccttttctcctcctgacaacattccttgcaccaaaacacgtgtttaggtaatttactacattcctgccattcgttttcactttatcttgtttacacaaatacctattagcaaaaggggaacagatattagttattaggttgaatctcacacttagctgttccattttagtacctttttcacatgaccatacaatgttatcacacgtgtagtattcatcttctgtcctcttcattctttatgcaaagtttataatgaagactccgaggcctatgtatgcccaatcagttatgtgggggtaacagaagacatcttcatttgtaaaattttgttttttttttaatagaaagaacacttaacataagaactaccctcataacaaatttttaagtgtacaataccacattatgaaacataggctcagatgggcaccacagctcacgcctgcaatcccagcactttggcaggccaagacaggtggatcacctgctgttagaagtttgagaccagcctggccaaaatggtgaaaccctgtctctactgaaaaaaaaaaaaaaaaaattagccggacatggtgggaggcgcctggaattccggctactcatgaggctgaggcaggagaatcgcttgaacccggtaggcagaggctgcagtgagccgagatcacgccattgcatgccagccttggtaacaagtgaaacttcgtctcaaaataaataaataaatacagacactaggattatagcagatctctagaacttactcatcctgcataaccaaaacttcacacttgttgattcacaactcccatttcttcctcttcccaacccctggcaaccccaattctgcaatttgcttctataggtttaactattttagatacctcatgtatgttgaatcatgaagcgttcgtatttctgtaactagcttatttcgcttagcataatgtcctcctcctggttcatcaatgttgttgcaagtgacagattttcttattttaaggctaatatgtcattgtatgtacatgttaaactttgttcgtttcttgatgaacattacagtttttttacatgttagctactgtgaatagtgctgcaatgaacacagaagtgctaatatctctttgagacccttattttaattcttttggataaatgtcgagagtgggactgctagatcatatgatggttctattttaatttttggaggaacctccatactgttttccacagtggctgtaccattttgaatcctacccacagtgtgcaaggttttctaatttctccacatcctcactaataagcttgacttttttttttcatatgtcatccagacaggtatgagataatatctcattatacttttgaattacatttctgcgatgattagcaatactgagcactttttcatatgcctggtggccacttgtatgacttctttagagagatgtctatttaactcatttcgttttaaaatctggttgttaggttttttttttttgcttttgacttgtaagatttccttatatattttggaaattaaccttttatcatatatatgctttgtaaagatgttctcccattttgtggattgtttttttcactctgaggattgttttctttattgtacagaaggtttttaatttgatgtagtcccattcatctttttttttcttctgttgcctatgcttctggtgtcatagccatgaagtcattgacaaaaccaaagtcctaaagcttttcccttatgctttcttccagggattttacagtttctggtcttacacttaagccttaaatccattttgagttgattttcatgtatggtataatataagggtccaactgtgttcatctgcatgtggatatctagtttctcaacatcttttctgaaagactatcctgtcccccttgtgtattctttgcaatcttgtctaagtttagttgaccatttatgtgtgtgaatttatttctgggctctcaattttgttccattggtctatatatgtttttatgccagtaccatactgttcaaattactgtaactttatctgcatgtggatatctagtttctcaacatctttgctgaaagactatcctgtccccattgtatattctttgcaaccctaagattgtctaagattagttgactatttatgtgtgtgaatttatttctgggctctcaattttgttccattggtctatatatgtttttatgctagtaccatactgtttaaattactgtaacttggttacactttttgaaatcaggaagtataatgctttcagctttgttctttctcaagattgatttgtctattcaaggtcttttatgactccgtatgtattttagatagtattcttttctatttctatgaaaaatggcatcagaattttaatagggattgcgttacatctgcaaatctttttgggaatatggatatcataaaaatagtatgtcttccaatccataaacacaaatgtcttttcatttgtttgcatctcaatgtatttcattaaagtttcgcagttttcagtgtataaaccttccccttcttttattcctaattattttattatttcattctattgtatgtgagatttttcctaatttttttcagagagtatgttttcagtatatggaaatgcaattgctttttgtaacttcactgattcattattagttctaacagttttttaatagagtctttagggttttctatatataagattatgtcctctggaaacagaaacaatttacttattttccaatttggatgcctttttttttcttgcctaactaattttgcaaacacttccagtactatgttaaatagaattgaggacagagggcatccatgccttgttcctaatcttagagaaaagttttcagtttttaccattgatttaacaactaggcttttcacatatgtttttattatgttgagctactttgcttctatttctattttttcagagtatttatttataaaaaggtgtttacttttatcacatgcttttactgtgcctgttgaagtaatttttttcatcaattaatgtatcgcattaattgaattttagattacccatccttttattccagggataaatctgacttggtcatagtgtatggtccttgtaatgtgttggtttgcttgtattttattgaggatttgttgcatctatattcatcaataatattggcctgtagttctcttgtgtttttttttttttttttgagatggagtctcgctgtgtcgcccaggctggagtgcagtggcgcgatcttggctcactgcaagctccacctcctgggttcacgccattctcctgcctcagcctcctgagtagctgggactacaggccccaccaccatgcccgactaacttttttgtatttttagtagagatggggtttcaccgtgttagccaggatggtctccatctcctgaccacgtgatccacccaccttggcctcccaaagtgctgggattacaggcgtgagccaccacgcctggcctcttgtggcatctttgtctggctgttatctgggttatgctcgcttcataaaattaatttaaaagtgtttcttcctcttcaatagttttggaaaagtttgagaatgattgatgttcattcttcttcacatgttggacagaagtcacccaagaagccatcaagtcctgggctttttttttttttttttttgggagattttgcttactgatatcatctctatacagctctgttcagactttgtagtacttcgtaataaagtcttggtatgttttatgtttctaggaatttatcagtttcttccaggttattcaatttgtttgtgtataattgttcatagtagtttattatgatttttcttattcctgtggcatcagctgtaatgtcttctctttcatttacaattttatttatttgagaaatggatctttgccatgttgaccagactggtcttgaacttctggcttcaagaaatcctcctgcctcagcctctcaaagtgttaagattacaggcgtgagtttcattttatttatctgaatcttatgtctttttttcttaaatagtgcagctaaaatttgtcagttttgtttatctttcataaatcaaggatgcttgggggaaaggaaatcacatggggaattcttaatgaatctactaaggtctctctatttctgaattaaattccagattgtctaacctatatttaaactctaaatccagctctcactccccactttcagttttcagcaagatgatctagtaacttctttccccttgtccttgttcttactaacagctcatattcctcttgttttactcatccttcttcaatatggtttttgttggaacgttatattaattttttcaagaaggattgttggaggacctactatatggtaggccctacaatagtcattaggaatatgtctagcaaaacagtgctaatctctgtggtgcttttaatatagtaggggtgagaaagattaaagagataatcacatatttgagtatatggttacaggtttcagtgagtggtattaaaggaaacatacgactgttgaatgagtagagagatcagacttaatcaggaggacagagaaagctctcctggaagaagaatattgggctgctgtctgaaggattaatggagtgagctaggcagttgtagtgatgcagagaagaagaggactaaaagaagagagaaatgcagatataaaggccctaagttagatataaagcttagcatggtgaaagaactgagagagtacatgtataactcagtgcatgaagcaaagaggaaattggtaggatttgcaaccggggagactagcagggcagattcatgtatcacgttacaagtgacattaaagatcatggtcttctcccagcagtgagaagccactgaaggggaattactctgatctgatctgaatcttcaaaatatcacattggtttcagtgaagagagaagcatgaaaggggtaaaagaaaaactggggaaagatttcttttgtccaaatgagagataatagtttgaactagaatggtacagctgataggataaattgaatattggagagagctttagaatgaaataaattgtactcaggaatagattacgtatgaaggagtgaaagaaggaggtcatacgatgggtgctgctgagagtactagttaaagcagatgtctcaggttcgattgcttctaacgaagtagacacaatgtggactactgagtatctgaccaccagatgttagcttcagagagcattttaattcttagtcctctgtttgaggttggaaggagaatagatgtactttctacttcacccattttactaaattcgtacattacacttcctcatgctaaatggttggacatagctctgggtccaatcaggaaagggatagcaaatgagtctgtaattacagcacctgagtgtaaatcctgtgatgggccacccacagagggagatgttggctctgtctgggaggtccaggaaggcttactggaggaggtggcatgctagctgagtatgcaggatgaaccgggggaatttgttacatatctgtgcaaatcatttctccaatcagattataagcatgctttggggagaatcataatatatacatttctctgctacagactagccctgctgtgagctcaccataaatgcttcctaataattatttattggaaaacagaagtaaagtttcttgggaaaaatacctcattcaaactaaatctaccactgaaacttcctttttagactatgagttttgtatacattactccacagcttgattagtatgggtaattgaaattctttaagttttcaaatggaagatgaaagtgaaaattttaagttgataactgtgcaaattataactgttagttcacttacttgaggaagcaaactagactgtatagtcctaaatgaatattcacatgtgttctctttcattggcagggaaatgcctatttttaaactcacagaaaagactttcaatttagacttcatttcatattaacttcctctgtttccttccctgtagtttttactttgttctattcagtgtgacaaatttatgcttagactgtatttttaaaaattaaggatctgcttaacttttaagatttttatagtatagagattatggaccttatggaatagtttgacaagtgactgaattgccagatgtaaaaacctaaactgtgtctcagttttgaaatgcctaaaagtctgcgacaaaatccacctagtgtattttgaatgtgtttttattgtttggatttgtcacgtaatatgtatgcatgacatgaggatattataacttaaataactagaggggtggacccaataattcaaacgtggacctttaaacatgggtctgcacctctaaggactacatattggctggactgctgacttgctgcttacagtttctgctatgaccttatataatctatgcatttttgctccctgtttgcatctagtaatcatctttaatcagcttacttccctgtagggaaggatttacttctgtttctgtcttactgtttgcaacttaaattgttttgcctttaagttcttgtaactcttctatcatttaaccttaaaggcattatttaacatatagcaatggtgatttttaaaaaatcaaactatctcatatgtcaaggtcaaaaagcacaaataaaaaacaaccaaaatgcttctctgacattttctcatagtgcgtatactacctatatcttcatatgtgatagcacagatccacttcaataaatgtaaactgatttttcctattaaaaaatacactcaatttttaatatttgaacatagctctcaagaaacatttcccttggaattgaggaaacagcaatcagagcaacagcagcaatgaatgaaggaagaaccagtgcccagactatgccagaaaaccaaacagatggctctcagcaaatgagccaaaacatgtcctgcaatgtatattttatgtgtgggcagggacaatttcaggcacatttaccttgcatcctgagtgcctggcacagagtaagtgcttatatttatatttatgtggaattaactagtaggcaactcaacactaacttgatttacttaaaaagtacattcatggtctttatgaataagagataataccattggtactagcagttattttggggatgttgctgaatgactatttgaaatgattctgtatggttggttgatggaatttactatacttaacagaatatcattttctagaactagatattttctgttgcagattacaaatgtcattcttgaagaatctatgcttatccaacacaggtcatttccatacctttcattgttttttgggggggaggaaataaaacaaatttctttatgacttgtaataaaaattttaagcccaaataactgaaattgggggacatagaccattttttgatgcaatatattcaattcctcaaaaagaattgcaaagtcaaatctacattaaagcatatagaaaagtgaagtaggacccttataaggtactctcataaaagtaatatggacatgacataaatatgatcaaatcaattctggaaaacagaagttgactgcaaaatcaaacttatgtttactttaagtttgtaagataaaaaagcctcatgtcctgatttgttcagaattctttaataatcaaaatataggcagtatttgacaatctgccagcttttggttttcacaaaaataagttaacgtacaccaactcagttactctttccttcagcttctctcttgagaatcatgcttagatctaaaagaggaaccgcagaagagtgtcagtgataatgaaaggatgatgaaccatatggaattcctgaattactaaaagcagacgagcaagattttcaaataaatgagatgccctatgattgagttcatctgttttcatttagcagaacaacaataagtgaacacataatgggatagaaaattatgacggtttttacatacatttacatatcacattccaaaacatttccagaaaggaaatatttgtaccaccttatgatggttaattttatgtgtcaacttgactgggtcatgagttatatatttgataaaacattattctaggtgtttccatgagggagtttttggatgagattaacatttatttatttattaatttgagtcagggtcttgctctgtcacccagtctgcagtgcagtggtgcaatctcagctcactgaagtatcaacttttaggacttaagtgatcctcccgcctcagcctcccaagtagcagggatgacagggataagccatccacacctggctaattttttttaatatttattttcagtacagatggggtctcaatatgttgcccaggctgatctgaaacccctaggctcaagcgatcctcctgcctcagcctctcaaagtgctgggaatacaagtatgagccaccgtgccctgctgagattaacatttaaatcaatagactgagtaaaacagagtacccttcataatgtgagtgggcctcattcaaggagctgaagaccacaggagagcaaaaggctgaccctcctccaagtaagagggagatcctcttgccctaaaatggcctacactggggcatcagctcttcttggttccacagcagcttccagtccttggattcaaactggacattggctctgcagattttggacttgcgagtctctgtaattgcttcagtcaactccttaaaatctgtctctctcctattggttctatttttctggagagccctgacaaatacacaccatgtaaccatattcttccatacagttgagccctcacagccacctgtaatactctgtgttctcctagtcagtaacttcagccattcttcacaactattgtagtttttcctgaacaattcttaagcattctactccatctcttcttactttcagcagcctcctatcatgtaggtaaaataaatgccatatgataagaaatcactaaactttaaaatccccaaacctccactctcctctatgatttcctcatttctttctgttcaaatacagaaaataacttgtctcttgcccaagagtaatccaaccagttgtgttctgtgtccaattccttcttccatgtttagatacttgctgggtttatcatttttttctctctcctctttgtttgtaatttctttttatatatcacaaccttttatgaaatctaagcgtgttcacttctctcctatcacaaaaataaacaaaaaacacaaaaagccctcttctttggcagcaccttctgctctgctcactatttttcccctcctgatagccatgttttttaggtcattatttgcaattgtactctggccctctttatctgaatgccaaaataaatgtttaaggtgccaaggcaagaattcaaaaaattacaaaaacaaaagataaaagcttcagacggagtagggacccctcttagctacttctgggccgctgaaacatggcaatttttaaaaaatcttgagtcccttcaagggaagttccaggcacctagctggccttgaaaagtaaatgcccattaatcaacaagcagataaagaaaatgtggtatatatgtaccacagaatactactcagccataaaaaggaatgaattaatgacattcacagcaacctggatggaggtggagaccattattcgaagtgaagtaactcaagaatggaaaaccaaacgtcgtatgttctcactcataaatggaagctaagctatgaggacgcaaagggataaaatgatacaatgaactttggggactcaaagggtgggagggaggagagggtaaaagagtacacaatgggtaatgtgtacactgctcaggtgatgggtgaaacagaatctcagatttcatcactgaagaacttattcatgtaaccagacaccacctgttcccccaaaacctattgaaatttcaaacaaataagcaacctgataaacaagaagataataacaacagtctccagcaagccagagttgcaaggtattttggtggtggcacctttattctttagggtcttagggccacaaaaattcctcaaccagactttctatgcctcattctttctagaacccactgcactctgaattatcccctcagttctgctgaaattgctcttactaatatcattaatagatactcatgtcagtatcatacttagtttcttattatcatcttccttgaaacattttcttcccttggcttctctgatgcttcagtgttctgtctttggggctgctggtctcttccattttgttctcaggcgtttctcctctcatggaataatctcagtccatgtgatctgattcccgctactccaatttcaagtccttttatttactgatggctcccaaaatgaacacttcagcctatatctctcttaaactgcaacctttatctctctcttaaacggcagatttatacacccaactattatatttctccttcaggatatttcaatggaagttcaaactcatcttctagaaaaatggctttctatgctaatctttgtctctgctctggctcccacgttctgtagctcagtagatggcactgatgtcttcactgaggttcacgactgaatcctcaacacaggacttaacctctcctgtcctataccatacaacaaataaaccatcagttcctacagattctacaatcctaaaatctctagaatcctaccaatttcacctgatagctaggctattgccttttaaataagtttgagtttcttgccttcttttttctcttttccaatcctttctttatgatgcaacctgaaacataaattaaatgtaaattacaatcgtttgctctttagcataagaatttcagtggctccttgtggccttcaggataatgtctaagctccttcatgtttcttagaacaaccagcttgccgtgacttgtttttactgcttcagtatatcctcttatctgtagatagggtttccattcttcacgtgtgcagttcctcttgtatttgagggcttttgccacattgttttgttttctttttgttttctcattcaactaaatcttgttttagatctcaacttagacatttaccccatatgaaaagcttctcctaaactctaaataggggtttaggaactcatatcacatgctgcttcagacagttattttatccaaaccacaatttttccatttgtaaaataaataggattatatcacctactctacagggttgttgtaaaaattaaaggagaaaatgtaaagtgttagcagagtgccatagctcagagtaaataaattaattaaatatcagtaaatattagctctgatgatctttatgtttattatgattactaagaaagattcttttatggattcttatccagtattaacaaagacactcaagttcctcgtgcataattgaaatgtaaatttctgatctactccaaactttcttgaaaaaaaaggaaaagcacaaaatgaatagatacatcaatttttaaatattgttactatcaaaccaaacatcttcccaaagaaaattattatgggctcatgatttttttttgtgatagagaatgaacagataaactctactgtctaaaatagtacagggtttgttgttagctttcagaaggatattttatattggatagatcttattgctgcttacatttcatcctcaaaataaaaggacacgtttagccacttcagaatctagatacagatttgcctgattctgtcagccaatctttctgccctgtatgccatattgcctctctagggagcagcttctgggtagggggaaggagtggctggaagcaatgtatgagacagttacaacaaattttcacccaacagggttctgtaaattgtatctttaagattaggagaggatttatttttcaataatagctcaaagcacagctcccactcattttctgcaattccaaaatccaaggaatcctgaaaaaacaacaagtgttctcctaggtttggtgtcaaagctcaattgaatacaaaactgacctgaactgacaataggacatttattactccttttaaccccatttagtgttgtgactattgattcatgttactacaaaaatcttaataggtttgactccagagtgctaccctgacatttctgttcttttacatgaaatactcaaattctgaaccatatccgtccccaaggatttggaataatatattgtggatgtgtcatttttttcacatcctgactgtcatggcagatatgtaataggtaatacttgtaggtttcaacttctaaagaaacagcccagcctagcttaagtaaaaggggggattcgtggaaggatactacaattgcatgtagaaatataaatgcacaaatctggtgattctttcttaatataatatccatcaggaagttttagccgtcagggaaaattgttggctaccttctctcagatgccactgcatgaagaaaacaaggccttcagcagctctaagctctggcacttacatcagataaaacacaggtctttctttcttagataagtttggtcatggaatgggaacaggcctgtggcatatgcccagctttggggtagtgtggcagagtttgttaatggcaaactccaacttaacctcacaggtggttgtggaggtggaacaaccaccgccccccgccccaccaaggaaattttagctagtagatgaaaaatcagatgtcctccaaaatatgactgaccataggaaagaaaaacatgcatagtattcatcaaccactctggtaaaactaggaacagataaacggtttttttcatttgtttgttttctacatatcaagatttacagttcttacattataactcaacataacatatcattacattttatggcaaaccaacctactgaaacctatttttttaatacttcaaatcagaatggtcaggcattttattgtataattgactcatactttactctttctaaaaataatctttctccacatccactgataaatgaataaatatgccatctgtaatgttaaaggtttgtttgagaaacaaattattttctgatgtgacactaatatggtatttcatcaattaatagtttcagtggctttgaaatatttcaagtctatgcctagctaatgaatttaatagaactaaatttggatattagtgcttcatcagtgttgatgaatatatttcaactgtaaaaagatgaaaggaagtaattcaaaaaacaaatgtaggcacttgaattacattttgatgataattatttctgctctttgtgagctaaaggaaacctaaccccaacattttatttgttaataaataattccgtatcagtagactgcagaaaaacttaatgtaatcacttagaaataatgaaacagtaataaccacgaaaaaaaaaaacatagaaatctgggaagagcctaagatttctttacttcatgatgttttctgcaactattccattccatactggtctgttgagctttcacaataccttctgtccaaccattatctgcccttcattacatgcaatgtgatattatcattgagtctaatattgaatgcatattatgctttccattcaacttgaaaactcatttaggtaaacatattacacttcatttatattccctcttcagtgcctattatgaaatgtacactaggcattaaacaagacttgaaaattgaattgttaaaccttgtgagagttaacagagaatcattggctaatcagtttcaggagacctagggttaattcgtttaacaatttatacatgagattttttgccatttatgataagctatcaaatttccaaaatatttcactcatctatattctaatgacatatctattaaatcaagtagaggaagtgtttacctagaaacaatgtcttttccagaattaagttggcccactatcaaacatcatagtaagtttacagtactattaccaatttatatgtgtgatataaatacagtgtaatattttattctttaacgtggactagggtgatattttctgaaataattgtttcctccactatattctttagctgctgtcaagaatttagacgtaaatcacatttctgattatgtttctttctcatttactgacttttagaatggtccagtgcaaactgaagaactcaaatttcttggcagaaaagattcttttcatcttctctcgctatgtttcctcatcatgttctctgattagtctattgtacctataatagcaatatcaaaaatttactcttctctaagtattctaattattttttcactggagaattccttttaaaatatttttctcatctaccaacctgtgctcaaatattaagttttaacatctgcaaatttcctctagctcacttgcaaaaaaaaaaaaaagaaaaacttaaaactgttcaaaagtccatttatcaataaccctttttaagcaaaaggtaaccatccacccaaatgtcattctttgaagatgtaccagccccttgcacattagttctcagatctattctctgactttccccgcatattttaggaaaccttgatcactgagttctggctaaagttagctactgtgagaaactgacaggaccctaaagactgggacacagacacagagttaatccacctcttccatttatgcttagagctgcttttctggaagcagctgtatctccccatggccccagctcaccctgggcaacccctttatctgcggttctggtcactgccatacagctttcttggagactgagtaacctcaccccaatctggcaaccccagctctgggttggggtaccaccacttctatcttctcaccctctaggcatagagctagcatcaactaattgatgttgttaatctaggaatgaccttaatagtgcctgcttgccttcagcaagcacctgtgcaactagtccccagaactcaagtccttcttttggactatgtggaatgagctctgctttttggcctagaccctgactctgacacattatcaatcggtacataaaaaggcaatttttaaactgtgattatatactttacgctatttaaataatattaaattgaatttgttaaaaattaataaaacgaaatcaagtagaagtgaaaatctcagtgaaactccactgaaaatcaaacatttatatccttattataagagatattattctcttagaatatccttgtgaagataggaatgaattgtaattaagacaagagacttcagtttaaaattatatgttttatttctttatttatttttggttgttagagacagggtctcactctgtcatcaaggctggagtgcagtggcacgacatagctcactataacctcaaactcctgggttcagggaatcttcccatctcagcctcctgagtaactgggactacaggcatgcaccacaatacctggctaattgtttaaattttttgtagagatgggacctatattgctcaggctaatcacaaacccctaggctcaagccatgctcccacattggcctgtcaaagcactgagattacaggaattagccactgcgcccaggcttactatatgttttaatcgtagatattacctgatccatagacaaaaaccttcgctctcttgtaggctcacttcctttccagtcaccttccatttcaattgcctcctttctcttttgtaaatttgtcaataatttgacatggcaaaaattgtaacttttttattctctcctgccaccagtttaacatcctttattataattctagatttaagtggagtcagtgataattgtcaccagtttaacagggtttcttatagcaattctacatttaactggagtcacagataatcactactccaataccaaggcaccatttgtgagttctttataaggctgcattgcattatatgttgaattgtcacgatgaggattgttatcagttaaattttaatatgcagtttgtttccgtttttcttaccagtggttaacaggtgacatataggttctttcatatttgagatggcctgactattgctctgtccatgaaatacttggtccaatagtttgggtatttgtcctcaacaaatctcatgttgaaaggtaacccacactgttggaggtaggatctggtggcaagtgtttgggcgcagatctctcatgacctgggcacagatctctcatgacttggtgctgcccttgtgacagtgagtgagttcttgtaaaatatgagagtttaaaagtatgtggcacctccctggtattgctcctcctctcaccggatgagacacctgctcctccttcaccttctgccatgagtaaaagctacctgaggcctcactagaagctgagcagatgccagaacaatgcttctacagcttatagaaccatttagagtcaattaaattccttttctttataatcacctaacttcaggtatttctttatagcaatgtaagaactgtctagcacacttgtgttatgatactctctagtaacatttctgcaaaacattgcagaattttatctattgtcttctggcattggatgttgctatgaaaaaactgatgtcaggctaatgcttttcttttgtagtttaagttctctccgaatggaactctacatatatatttgcatatatatggcacacacatgcacccacacagacacacacacacacgttgtgctcttttgttccgaagattctactctctttagttcaaattgtctttcattgtatctgtatttcactgactgaattctttaaatcacagacattatttattctatgctgaattgtcttgaaaaacccttatattggttggaattgtctaataatttaaatttttttaccattttattatttcaagcatttttctatacccaaagctcagttttttgttctctcaaattcgtttcttgctgtttctaatttattagttttgaaaagctattgtacatgtttcctgatgttggtgatagtttttcatctcattttaaaattttataatttgtgtttgagctctcgtctcattctattcaagcttcttaaacttgttatatagctcagaatatttatcaggcatttgctttagttccctgcattcttccatgctcagtttttcattgtcttttctattctatgttccttttctttactgtcgttatgtcttatgttttatattttggggtattactggcaattattgggacttttcagtcttcttgcttttgagatacagggatagggttaggactcttgtcactctactacagaatacttttatggttcttagttaactagtgtgtgtatgtgtatgtgtgtgtatctttattaatatcactattttatgttatttttgtaattgttggcatgttatttttattgtttgtcaggctttaggtattggaatgggaatttctgtatggtagctttatactgccctctctgcctggaattctcacttctataatttttaatgtggatatttttccattttgctacaaatttatcaagacttgaaccatttataattcacaattataggccataacccctgctatataacaggtatataatagattatcaatacatggttgatgtataaaataaaatgaatacataaacataacatgtagcctctagaaaagtagaaaattttcagttcaacaacgtttatgcatgaatgacagtaaatcaatcagaaacttaaaatatctctctctatagttggattaaatgaacactctcttgctgttttacagagtggtgagaagaaactatatccctcatgtgtatgtttaattgttatcatgatggctgcatggagtaattaaatcttaagtcttccttgtttaaaataaaatgtaaattcccttgggcaaaataaaattctagcttcattttgtgtgagataataatatcattttttaacattcagttttgctgacaaaagaaagataatatccaaggaactaaatatgtgatgtgggctaaatattgctaatatacagtgaaaacgttacagtataaaaagatttattttcttcttttgcttcacaatattactattactatcaatatttcccatttatatactttaacgacatctaattagtcaaagccattgaagtctgccacacttgaagttcccagaacataccatctacatcgtgaactaatgttttttatttcttaacctatttcccgtttgccccaagaatattcttgtctctaatcctaatgtaacatcatatacattcctgttacattgagattagagaaaagttctgttaagaaataactacaagaactgtttatattttgttttcacattgaaaatcagtcagatttgcttcagtctcaaagaacatgtttatgtaaaattaaatgagcactggccccaagctgcaatttttttttctaaatgggaaatgagttaaaattctcaaaacataattcaaagctgtattttgagggttaaaaacctacttatagcacttagcataataaatggtaataattcaaaatatgctatacgtttatataaccatcattactgttgtcataatttaattgcccccttacatcaggataaaatccaaactactgagctctctttgaaggactccctagatttgtacattcctaaatctcaggaatgaatctgataatatcctctgccaggcccattcacagtgacttgatttcccttttctatgtaagctatgtgtctctcacttctgggcccttgaatgtgttgtggttttactttgaatatattatttttctgtcttcatgcaagaggaagacaagaaagaagaaaaaatttttccatataggaaactttccttaccctcccctcacagcagagttctccatataaaatatgaataagaatagatatcacaatggatgagagagaacttctattcctagaagtagggcagactatatactctgacagactcttccatagaaaaaaaaatctaaaaatgccagacaaaaaatagaaaaagagtaatttaaaataaaactctagaaggtggtaactcgataaaatcagcagtcatttaaaatgtcattctgaatgtggaagaaaaccaacacaattttacaggtgagctttatcaaacattaaaggaacaaataattttaattttaaacaaacagtcctgggtatataaggaaacaacattctcccgagtcattttacaagactagtaaatttagtttgatatccgtacttaacaaagactgtacaaaacatggaaaacgtcaggtcagtcaccctcacaaacagatgcaaacatactaaaccaagtattagcaaatagattcaggtatgcataaaacatgagtaaatctatcttcaaaatgagaaactgatttcaacgttagaaaaaataaagtttatttcattaaaaagtttggaaagagcctttgttcatcttgaagattaaggaaagcactcttttaggaaaaaaaaaattcttaacgataaacagaattaaacttctgtaaactggtaagtctccagcaaacagaatacttagtggaaaaaagaagctagcatgtcactatgagggacaatacaaagttgtctgctataagcaattttatttaacactgtactaaatgttctagctagctcagtcaggtaagaaaaataagtacaggtttgtagtaactggaaaggaaggaactaccggtttttattattttcacagtatgattatggaaaaactacataatgacatctcccaatacatttttataacatcaggtctctatatatgaaatcaatatataaaaataatttgcattttattcagtagcaataatatctatgcaagtacttaacagggaaatcacaagaaaacctttgtatggatcattcccagctgattaaattataaaatatcatactacagttgtgacattcagtagacattctgatttctacttctttgcttcaatttttggcttacaattgatacaacgaatgaaattcacttatggttctacttcaccacgaattctactcaaagctgctattccaatgtctgttttgcctacacaagttttctgcctaaaacattgttcttatttacttaacaagtttttacttttgagatcaaattttcttcaaaacacctttgctttaggggcagagataaaaaggagttcttcgagtatttcgttattgaaacagaacctaccaaatgccattatttaagctgcagtttcagctgtatagcaaacaatgtggactgtaatttgtttcagtactagtttcttcaaatcttcaacaatatatttgttgataaaatgctagcttgtcaccatatagcttcttacactattattttaacgggaagaatgtatttcccaaaatggcattctgtttcttagttatttagaaagaaatctcaaaagtgtattttagtttttatcattacatttagttaaattttgtaaattacgaattgagcattaaacggctttaaatataacttaaaaattacagagatttatcttcattttatgaatgctgagttaaaagtcatctgaatacttatttcatatttcacttgctaatacctcaaagcatcaggtaaagctgagtttatattaatcaggtagttgtaaataaatatttcaagtagtcattatttgacatgttatatggtactcaatattttcaagtttttttttttttgagtacttaatgggtcattgttttttttacgtctcagtttgattgagagctcatactccatggaggtgaaatgagaactccactatttgatcctttgcttgcttttaaaagattagcattatctttaatctgtttattctttggagcaatccttgtgaaccttttgttcattttctgtgagttagttgtcttccaactgctcagtaagagtggtaggacaaagaaacaaccactgaacttgaagcataaaaaaaaagaaaaagaaagaaacaaccactggattagtcctagtaatggaactaggtaacatgtcagcctgactgtatgcacgcaagtgtaactcacagtcgcatccagcactggttgtatttggaattaaaaattcaaacaaaaacatttctccatgaacatttctccatgattgtcatgtattgtgacaatccccagatggtagggataatctcaacggggcagagtagagctggattgtatgattcctacaacaatcatctggcttgtctaggcaaacatttcaaaattaaatgaataaagaaataagtaaagaaaatgaatacacaatggaatactatttagccataaaaatgaaattatgtcatttgcagacacagggatacaactggaggtcattatgttaaagtgaaacaagccagacccagaaagaaagacaaatattggatgttctcactattatgtgggagctagaagagataatctcctggaggcagagagtagaatcacagacatcagaggcttgggaggatgtgtgggtgagtgggaggggagggaagagagattggttaataggtaaaaacatagaattagataaaaggaataagttttaatgttcaatatcaaactagggtgactggttaacaaaaatgtgtatttcaaagtagctagaaaagaagatttggaatgtttctaacagatagaaatgataaagagaaagatacactaagtaccctggtttgatcattacacattgtatgtttgtagcaaaataccacatataccccatatatatgtacaaatattatgtatcaattaaaaaatttaaataaaaaatatataaattgcttctatgcagcctaataggcatatactttccaaatctatattataggtctgcttttctaatgagttgtaagaaggcatctctttgtgagaccagatttcctcatcaacacttgtttgggtacattatcctctcaatatccaagtaatcaatagtttgtgctctgctgaataacaagtaatactggaatatagcaccaatttttatttccttcaatactgggggcatggatgacggccaaaaaatattactgctgtgtagtgttcattcttccatatcctgaatactctgacttgcaaacttttcaggtatagttgtacatgagtgggaaatgttttagaaattgccatttattatttcacaaatattcattagctataaatacaattaaccacaaatcagtacacagttcaggacaaaaattttagatttgaagtcatattgggcagattctggaattatggcttcaccacctctatctataagcaggtattctatgtcttccagcttgctccttcatctggaaaatgcttctcagtgtctgacccttagcagacattcactaaataaagctttcctttctttttcttttaaaaactcttcacagacactggaggtaaggtacatttttactccttgcccatccatttctctctcctactgactctgtggttgtcatttgtggttttttgatttctcatccagatggacatatttctggatgggtggttatgtggacactctggatggagatggaactcttccatgtgcctgaaggagcatcttcactttacactccatgtgctctagcaggatggagtttattaatgtatactgtggactgacggcattatgtcttcaggaattagaaaatatcatcagatgcaaagttactcaattaaagaaaacgtatctgcctacatattagactaaacgttaggaataaataaaatatttggtaaaaacaattccgtctataaaaagaaaagggattaaatctgtttgacggggtagctgatgttatgttttaaatatgagatatttaagatagagtaagaaattactaatatatatatatatatacagctttgacttagtttgggttatataaaatttctcttttctaacgatcacgattgaatattggcaaatttgtggtgtaaatgtcacagttctggtgatagtcttccttggaaaaagaaatttcaattatatgaaaaccttgaaaggaataaatctcaaaaatatttcttcgctcacaaaaatgtgggttacattccataatttgacagttcggaatgggttctatttccttgggcaaatgagacagcatcaagactaccttttgtgtttgttatccacccgttatatttccttagaataagtataatcatgtatcttccaaaatgggatgcttttgagagtaaaagaagaactactagttgtcaaggtggatttaaaaatgcaaaactggaactgtacagatcaaagtggctccatgataattttccttactaataacccaggtgcctctctacagtgctttgtttctaaaacactggaacaaaattgggttgattctaactttatcacactggattaacagagtcaggctccaactgattcacccaaggatcatttctctgttttatggaatgaatccagtatgcctagatcagaagactcattccttcatatgacatattagtttttgccctccctgatgcttcaacaacagaaatgtgactgtcagaattaactttaattaaatattaaaactagtaaaatctatttcttgctgcttccatttcaacaataaaatctattttaaaacagtgtactcatttaaatacagcagttgcatcttcctttattattgtatcagtaaatcatcagtaatttttaactgtgtcagagataccaaagccaaaataagcataaatatattttgttcaatgaatttaacaatttgcatatcatgttattttcatcatctatattgaattcttactacataatgttcttgttttctgtctacctattctgaccactttatagtcagtttcctttattgtttctgattcatttccctaatttttaaatattgggaggcctcaaaaattaaccttcaaaaaatctttcttttttttttctctccacactaagtccctgcagcatctagtacattttcatagcttcacgtaccacctaatgacctaatgacaatttcctggactccagaatcatatatccatctgcctctatgatacatccacttggaattgacatctggaaatttttaggtcccaactgagtcactgctattaaatctcccctatcaagttgaagatttataatctcacagatttatcctttctagtggtggttactgctggtctacactgctcaggctaaaatacatggtgtttgatttctctctctctttcatactctgtttccagtgtattagacaatcctattgactccaattttaaaatgtatccagagcactgttcaaaatagtcaaaacgtagaaacaatatattgtccatcaactgatgaaaagataaatgtcttgtatccaaacaatggaatatcattccgtcattaaaaggaattaattactgatatatgctgcaacatggatgaacctagaaacattattctaagcaaaggaagccagtcacaaaggccacatattttatatttggattaaattagcagaaagtcattgacctgagactgtcccatattttgagtttctaaggaatactccaaaatctatcttaggattatgtacatttctgcaaaaaaaaaacagccaaaagtcagccagggacaaatagcgggtcacagtcagtccatgcccaaataaggcaaacacctagctgtagctaatccgatgatttcattagtttgtttttgtgagcttgctgctcatgctgctgggtggagctctctcaacctctcttagttctgagtgctgtctgattcatgaattgttcattgttcaaataaatgctgttgaatataatttgtctaaagtttttcttttagctgtgtaattccatttatatgaaatgtccagaataggcaaattcagagaggcagacagcagattagtggtaccaggggaaggagaggaggagggtatgggacattactgcttaaagggcatggggttttcttttggaatgtgtaaagtgtcttgaaactagagagagatggatgtactaaacgtcactaaatgtcacattttagaatgattaattttatgctatgtgaattttacctcaataaacaaaagcaaaaaatgtgtgtccagaaataaatcacttcttattacctccaactgtaatcacccaatgggttcttcttcctcgctgcacaaataaaacaatttggtaagactgggatattgcagtagagaaagagtttaatgaatgcagagctagccaagtagaactagagttattactaaaaccaatctcctgtgaactcagaagctagagttttattacaattttgtgggcagagagctaggaaatgggtgctgctgatcagttgggatgaaatcatagcaacatggaaaacagttactgtgcattgtctgcctgtgggtggaaaccacaggactagttgagtcatgagtcatgtgtccaggttgggtcagtcaattgccagaatacaaaagtctgaaacaccacacctacatcttagcagacctcaagccccttccataattctattctcatggcctttcattagtcatacaaaggtggttttggtcccaagcaaaaagggcattagtctaagggagggactattattcttacttcaaatttaaactctaaacttaattctttccttggttagcttggtctacatccaggaatgagcaaggaaagccagctggtgaggctagatgcaaagtggagtcagccatgctagatttttcttaccattgtaatctttgcaaaggtggctacaaacccaggatcctgtttcaagatactctcttctctccactaaattacagtgataactttcgaacttatttcttagtaagactgatactataaaattatgagatcatttcactcttgagttcaaaactttccagtagcttttgtacctttcagaatgaatatcaacatctttatgtgactatcaagacccaggaagatcagccctctctgttgcttcactgatctcacctcttaactttgcccctgacctctgatatcttatttcctctcctccagtcagaaaggttgaccacctttctactccttcaaatatgagacaataaaccatctcaggggatttgcagctgctgtttccactgcctagaattcttgctctgcccagatacattcatttttaatccatagcttccttctgaaataatcttttcagtaaggctactccaggaagaatcacaacccctgttctcctgcccacacaaccgtttccctatttgactttatctctcaacatttgtcaataatgtgttataaatttttatgtatttatcttattgcttgtacacctttctctataataatgctccatgcatttaaaaaaagtccacagatttttacctctttttatctctgatgtaaataacatcacattgataacattacattgacatctccgatgtaaaaaacacatctatcacattgatagatgtccaggtgttatttaaaaattaataattatgaggcatttaaaatatattgcaatactgaacaaaattatttaaggagaccagacttatggattattaaatctagcaaaaaattacttttacttttaaatgctggttttgtaaattttgctctaaatcatatgaaaagatattctaatacatacagctaactcattctgtgcctcacaatcctgttttcatagcagtgtcagcagaaaagaactgattgctgtagattttgttgaaactcatttccaatttctgattaaattgcttttattgaacttaattgtaatgtatatatgaattagctgagaacaataacatggccagacttgatcaaaaattcttcagaagaccatgctaaaatataaattgcatggactcaaagcatgtgcattaagacaaacattagatcgaaaaaccactgttttaagattttctaaattcagggttgatttaatgcaactccgaagcagactatggaggaaatttataaggaaaactgattttaattaagagtttaaatggtctcaagataaacagtatgtgttccggaccttttgagttggaagaaagggttttgaatctcgttttatcccagataaggaacgatccactcttccagctttctaaattattgtacacattttataaaggaccagtcatagaaatccaaattatataagcatgacagatggctatgtctttgaacattataaactttatttaaaatatgcaaaaatactacttggaatgccataagcagtgcacaggcatctcataagactgcaggacggggagactgattgaggtccacaaatcatcaaatctcatttgtatcatatttgtaaactactacttcatcaaatcctatactggactagcctatattaaaaaaatctgatattataccttctgtctgagggctgtggtactcatataaaggcttaggaagagaaagaactcagatcatctacagactgtagaatcgacagaaaaggctggtagtgtgctctgtcgacggtgcttgtctgggagtccctcagctgcctttcagtgacaacatttcagtgacaggactataaacatgccattgtgttttcaataaagctagttattagccttcagaggagcatgacaaatacaatagatttgaggtttcgatgaaactatagctaaaggatttagatttttaaaacatgttgtacatgttctctagtcaatttattaaaagttggagatataatttttcattcaacattagtttgcactcatccaaatgtaattttctcttctcagcaatttagtagtgccttatggaactggccatgtaatgtgttatgcatgaggagttgacactgttataaaatccatattctgtatctttttataagaaataaacatttacttgcagttaagggactgaagcagaaaaagcagccaggccaataatcaaaacacaaatatttctttatcaattatttgaggggattacaacaggcaaatgaaccagatatgtaaaaacatatctatttttcacagtatcaagtttcttcttcttagggctcatcgctgtttgtcaaaaatgtgtttaacaaaagagatgtgtttaacaacaacagcaacaaactatgtttaaacaaaactatatctttctctttgctccacttgaggctttgttcttttcagagttcaaaagcaaaatgaagttgacggtcaaaattgaatgaaatgtgctcaaatactgaggaagtcataaaaaaaattttgttgcagacttcctgtgcttggaatggcttcgaaaaacattgaaggcaactgacattatatttattacagcaatattctgctcaaaatttacatagttatttgtcaattctatattaaaacttaaattacacaactgagaatgaagccttgtttgggatgcccctaacacaaagacggtaataggtgtcatctcttggatcggctataatctactgatagataatggcattttggtgtgccaattcctgagatttttgaagttaagtctgaactcagggggaaagaggatcctaatccatgtaacatgccttccaagggcagaagatagaagcaacctcccagttctaatgttggaagtccaaggcagccatgcacttaagcatactgtcccctgtataaatagtcaatgctcaagaaagttaatgtttttcttccaatttcttccactgggaaattaattaaaggtatctcctttcataggtggtattgagataataaatacattcaaaatattgttttgaaatagtcactctaacatgtctctaattttctgaagtcctacatttgtcccatatatttaccctattatttgccttcaacatgggtagaactcctatttgttaaactgttcatgtattctcccagggcaatacatttcagaatgtggccacaatgtagtattccttcctacttgccaaacttttgtggtatctgaaatgtaaaacaagaactcttaacctaaagacatataaagatgtattttaattgttatgaagcagaataatatagtggttaacagtatttaagaccatttaatagccacaaagttccaggcttcagtttctttatctatgaaatagagaaaatatcacaggtgatgcgactgttacgtacattaagtaaaataagctttactaagcaatttgcacatacctggtacaaagtgagttcttaaatattatttttttaatcaaaaagtaaattagttgagcatatttgcaccatctgagaatacaaatcaagttacctaacccatatataccactctctcactagcattctttttttttttctagactactcctgctagaagatggtgtgactggccttccaagttcaggctacaagttcctcaggactcatcacatctcctgcaccataaaagcttccagcattctctttccacctggcctctctccactctagtctttctggaactatcttcccaacaaatttgatatattttcaaaaacttgactgccttggggaaatcatagtctaagaagcacttaattcttgtatagcctgcttcctacccaagggacataagatgctgagaccttctcagtagagtgaaggataagttaattatttttgctggtaatcactatttttggcttttttccccctcccttgactatatagtcttgtttcccctccttatatgcctcttctctaatgtcatgctcctccattcatctacatctattacaactctacgttatagcatagtcatttgattctcctctttccccacacccactgggtttataaagaaaagtatagggggtagtgggagttatgattagtgtctgctgggaggggagtagtaacttcttctagagatctttgcagacacaatctatacaactatttcttgtttcttttcatttcatttcaaagctgaatttcattttggtttagctttgatcccacccaaatctcatcttgaattgtagttcccataatctccatgtgtcatgggaggaacctggtgcgaagtgattggatcatggggacaatttcccccatgctgttttcatgatagtgaatgagttctcgcaagatctggtagctttacaaaaggcttccaccttcgcttggcactcattctctctcccaccgccctgtgagtaggtggcttctgccatgattgtaaacttcctgagacctccccagccatgtggaactgtgagtcaattaaccgtgagtcactcttttatatataaattacccagtcttgggtagttcttcatagcagtgtgagaatggactaatacacattttacaggtatttgtattttcattactcactaatctcatgtaagattagaatggatataactctgttccttagggtagaccttctcgaagtatttgtagtagagaatcagtttttcccctaacctattatagactaatattttattaaaatcgaaaaataaataactaaaagaataaaataaaaacagacatgcaaagtaatagttgcaaatttttttaaaacaatacaggaaaaagaaaatgacaaaatctgtatatgttgtagtttttactatctcatcagtagctagttaccatagtttatcctataaagttatagctacatttcaattgtcttctgttgaaataaattggttctggaattttaatacttttgggttacaggtgacaaaacagctttaagacattgtgtaacatgacagtctgctactcactccaacatcaactgaccttgtggggtctacaatatacaaattggtcatgctctgtccagcaaatccaatgaactaaatagttttcctcaatttctgcacttatttcatcagggaccagtgacaaattttacataatacatcactgtctgtagattcagtttatacagtgctactgaatagcttcttttttttttttttttttttgatagcttttagcagggccaaattttatgaccaggccttggattttttatatctaagaatggaaccataactccaagttacttcaaattttacacttactaaatttggcaaattcacctctgcagtgcccataacccctctccaaaaggaagggtagtgaggaaaatacaggaaaaatttatcaaactatgtgaattttcggtagtatatcctaaaacactgttaaatcaaaacaataaattatcccaaataactaaaaatgcacaaaataatccaaggaatttgataaaaaacagcccggttttattttttaagtactataagatgccatttttttaagaattggacgttcaaaaacgaatttttaagtattagaagttcaaaaagtttaaacttttacatttcaaggtgaaagacaaactatcaaaggccaggcgcagtggctcacacctgtaatcccagcaatttgggaggccgaggtgggtaggtcacctgaggtgaggagttcgagaccagcctggccaacatggtgaaaccccatctctacaaaaaatacaaaaaattagcttggcgtggtggtgggcgcctgtaatcccagctactcaggaggctgaggcacaagaaccacttgaacccaggaggcggaggttgcagtcagctgagatcacaccattgcactccagcctgggcgacaagagtgaaactccatctcaaaaaaaaagaaaagaaaagaaaagaacaacatctctgtttatacatgaaattgtaagtaaaaacataaagcagagaggtatgagattcatagagactatatcagacaaaaatataaggaaagcagtaattgaaataaacgtatttataaggccccaaaccaaaaagtaaaagaaaagataaccactagagaataacagcatgttatttctaaacaggcaaagatacaggctaggaatggtggctcacatctgcaatccaagcactttgaaagaccaaggggggaggatggcttgagcccaggagttcaagacgatcctaggcaacatagtgagaccccgtctctacacaaaataaaaaaccatctgggcatcatggcatgcatctgtaatcccagcaactggagaggttgaggtgggaggatcgtttgagcttgggaggttggggttgcagtcagccaatgtctcaaccactgtactacagcctgggtgacagagtgagatcctgcctcgaaaaaagggtaaagagagtatcagtgtaccacttctaaaaagctcaacttaagatacctttttctacatgtaggcttatgctatacaaatgacattctgcagtggttgctgtgattccattttcaatctccctccatggcagctgaaatctctttgcagtgaatggtttagggaaggtcaaatgacttagttctttttaataggaagtgaggagggtttgctataaaagaattcctcagaaacattccttgcctatgagacacagaataactgacctctgttgtttccaggacattggcattgctgtatacaatgtctggaactgcttaatttccaccaagctagcactgaagctgagcaatgaaagtaaaactaacagaattatgacaaccaggagagccagagagcttatgtactgtacctggagtctcccctatctttagacttcttgtagaaggaggtaataaattttcttatcattaagcatatttgaatcacgcatccccatcccttgaagacgaaggtacccaatatgatatctttgcttgagactgatgatttgccaggtacccttcaagtttatgggctcactcacatgaagtattgtgatttatttacatgctaatttactagtaatcagctattcctcagaaaaaggcatgcttgcagaactgaattggacataccaatcttagactattatgagattgtttaaatttcaagagacctgagtgctaatctttctttacctgtaaatatgtaacttagagaagatcaatgaaattaactgaatcaattacttttttgaagttctacaatttacgatgtattttgttttgtctttaagtattttctgctttcaatactgcaaataccagatcaattgcaaattgcaaataccacatcagcttcattagaagacagactatcatataaaattgtaaagcatcgatagctatctgcctgatacttcattctcgtaattcaatttttgtatttggtcagaatcaagaatgtagtttcaggttgcaataggataaaaatggtgcatacagaggtagagcttgcttttagtcaataaacattctttattattttgatcagctttaatctacattaatattacacctaataatgggagactttaacaccccactgtcaacattagacagatcaacgagacagaaacttaacaaggatatccaggatttgaactcaggtctgcaccaagtggacctaatagacatctacagaactctccaccccaaatcaacagaatatacatgcttctcagcaccacaccccacttattccaaaattgaccacttatttagaagtaaagcactcctcagcaaatgtaaaagaacagaaattataacacactgtctctcagaccacagtgcaatcaaactagaactcaggattaagaaattcactcaaaaccgctcaactacatggaaactgaacaacctgctcctgaatgactactgggtacataatgaaatgaaggcagaaataaagatgttctttgaaaccaatgagaacaaagacacaacataccagaatctctgagacacattcaaagcagtgtttagagggaaatttatagcactaaatgcccacaagagaaagcaggaaagatctaaaattgacaccctaacatcacaatgaaaagaactagagaagcaagggcaaatacattcaaaagctagcagaaggcaagaaataactaagatcagagcagaagtgatggaaatagagacacaaaaaacccttcaaaaaatcagtgaatccaggagctggtattttgaaaagatcaacaaaattgatagacggctagcaagacaaagaagaaaagggagaagaatcaaatagatgcaataaaaaatgatacaggggatatcaccactgatcccacagaaatacaaactaccatcagagaatactataaacacctctacgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaacgaaatccatgaccagatggattcacagctgaattctaccagaggtacaaggaggagctggtaccattccttctgaaactattcccatcaatagaaaaagagagaatcctccctaactcattttatgaggccagcatcaccctgataccaaagcctggcagagacacaacaaaaaaagagaattttagaccaatatccctgatgaacatcgatgcaaaaatcctctataaaatactggcaaaccgaatccagaagcacatcaaaaagcttatccaccatgatcaagttggcttcatccctgggatgcaaggctggttcagcatacgcaaatcaataaacgtaatccagcatataaacagaaccaaagacaaaaaccatatgattatctcaatagatgcagaaaaggtctttgacaaaattgaacaacgcttcaggctaaaaactctcaataaattaggtattgatgagacgtatctcaaaataataagagctatctatgacaaacccacagccaatatcatactgaatggacaaaaactggaagcatgttctttacaaactggcacaagacagggacgccctctctcaccacttctattcaacatagtgttgcaagttctggccagggcaatcaggcaggagaaggaaataaagggtgttcaattagcaaaagaggaagtcaacctgtccctgtttccagatgacatgattgtatatctagaaaaccccattgtctcagcaccaaaatctccttaagctgataagcaacttcagcaaagtctcaagatacaaaatcaatgtgcaaaaatcacaggcattcttacataacaataacagacaaacagagagccaaatcatgagtgaactcccattcacaattgcttcaaagagaataaaatacgtaggaatccaacttacaagggacatgaaggacctcttcaaggagaactacaaaccactgctcaatgaaataaaagaggatacaaacaaatggaagaacattccatggataggaataatcaatatcgtgaaaatggccatactgcccaaggtaatttatagattcaatgccatccccatcaagctaccaatgaatttcttcacagaattggaaaaaactactttaaagttcatatggaaccaaaaaacagcccacattgccaagacaatcctaagccgaaagaacaaagctggaggcatcacgctacctgacttcaaactatactacaaggctacagtcaccaaaacagcatggtactggtagcaaaacagagatatggaccaaaggaacagaacagagccctcagaagtaatgccccatatcgacaaccatctgatctttgacaaacctgacaaaaacaagaaatggggaaaggattccctgtttaataaatggtgctgggaaacctggctagccatatgtagaaagctgaaactggatcccttccttgtaccttatacaaaaattaattcaagatggattaaagacttacttgttagacctgaaaccataaaaaccctagaagaaaacctaggcaataccattcaggacataggcattggcaaggacttcatgtctaaaacaccaaaagcaatggcaacaagagccaaaattgacaaatgggatctaattaaactcaagagcttctgcacagcaaaagaaactaccatcagagtgaacaggcaacctacagaatgggagaaaatttttgcaacctactcatctgacaaaaggctaatatctagaatctacaatgaactcaaacaaatttacaagaaaaaaacaaccccatcaaaaagtgggcaaaggatatgaacagacacttctgaaaagaagacatttatgcagccaaaaaacacatgaaaaaatgctcatcatcactggccaccagagaaatgcaaatcaaaaccacaatgagataccatctcacaccagttagaatggtgatcattaaaaagtcaggaaacaacagctgctggagaggatgtggagaaataggaacacttttacactgttgctgggaccgtaaactagttcaaccattgtggaagtcagtgtggcgattcctcagggaccttgaactagaaattccatttgactcagccatcccattactgggtatatacccaaaggattataaatcatgctgctataaagatacatgcacatgtatgtttactgtggcactatttacaatagcaaagacttagaaccaacccaaatgtccaacaatgatagactggattaagaaaatgtggcacatatataccatgaaatgctatgcagccataaaaaatgatgagttcatgtcctttgtagggacatagatgaacctggaaaccatcattctcagcaaactatcacaaggacagaaaaccaaacactgcatgttctcactcataggtgggaactgaacaatgagaacacatggacacaggaaggggaacatcacacaccagggcctgttgtggggtggggggagggggagggatagcattaggagatcttcctaatgttaaatgacgagttaatgggtgcagcacaccaatatggcacatgtatacatatgtaactcacctgcacgtcatacacacgtaccctaaaacttaaagtataataataaataaaaaaataaaaatattatacctaattagtgactgtcaagtaatgtgtatagattagagaattacctccagaatctgactttcttaggatacactaggtaagttactgaatttctgaactaaaatggatgctatagcccacttgaaactataactgagtgtttacagcaacaatgaaacagaccaagattatctggaatgctttgaaatacaaatgactttgtatctgggtcagatagcttattctgttcaacccagttttaacggaattcacttagagttcaatcctataatgctatactgcatatatcaaaatcatatcttttagttaatactctggcatgtcaatcacacatttagcaagattctaatctctatgcaaacataagatcaggattttatgggcagaaatgaattttaatacaaagtttgttaaaactttatcgtattttttttctcctttggtttatctgacagtgagggttaacttttgagactatttaaaattggaattatccatgaagatataagcctgctgagaagagataacatctacttctctgttccaaacagaaaatgattcttagcactcaataaatgttaaattaggaataataaatgcacataaagtctgaatgaaaaatgttgctgaatgcgtatctatttattgattcaatctccttagtacttccttgttgaagaatgctttataaacttacaccaagattataccagaaagataaaattatagaaaaggtggaagattatacaaaggaaaggaaatacagcccctgaatgtgcaaagcaggaaactgcttttggtaaaattttatgtgtatcctaaaactacacagtaaatttgttagcaaatttgaaaagaatctctagtaagtttaaactcacttattatagataagtactataaaatggctcaattcagcagaagtcttttacacaaaacaaatgaaattattaagactaacttcgaagcgggtatataaaagcaaccgggagaaagttcccaggagcctttttcagtagattaaacatatgtcatggtcacggagctttaaagcagaactttacttctactggagaaatcaaatcagtgacactgaaggtcactcctaatcagaaaaaaaagaaaagaaaaaacatgagtgagacataagacaggctggtgatccaaacaatttaactgggaaagcaagataacaaaaggaaataaaagaatctcttgtagaagagaactatcctgagctgaataaatctatgtgattactcattatcaacaaaattatatttgaaatggactaatatctttaaatatcttggtgacagttttagtttcaggaacaaaaaaaacctaggtatacccaatttgaaaaatcaaaatagtttgaaataaaaatattgcacactaattaaaaaaaccagaatgacttcaaaattctttctttcataaaaaaaagttgaagaaaatattgttcagaagtaaaagcacttgcatctggtttgttttctcctttccaagagcagataagattgcagttttacacctgcctaaatgttgttcaagcgagttgtgataaaataaaatattcatatatataaagatatagatgacagagatatagatatctcccttaaagtgatgctagtggaaatgcaatgcacacagcactgctggtctgggacatgacaagtatagaaaccgagtataaattgagaatatgcattcagacctttaatagcattgccatgacatccaagcacacaattgtatgttttaacaaaaatgagtgcaatgaaatggaaaatagaaataaatttactctttactgcagaggaactctaccataaaagatagagtgggtcttataatgcaactctaaagacattccaaatatgcaaaaatatgagggagatatatgttgactgaggacctcgtattaaaacaaatgatataacattgagaattctgtcagaatagtataattataagaacttgaaaatccaaataactttaactcaaataaaaaacagctttctcccacccacctaccaatctctctctctttcaagaaatctgaaaaggtcagccatccagggctggaagagagattcctcagtcatcacagatcaggtctcgctgtgtctttcttctttattatccttagaataaggcctccattcctccattcttaaggaggatgatgggaagggcaaaatgttgcctgcctcccagctgagtcagcccctttaaaaataactttctggaatcattacctcgaagattttcttagccagatgtgtcttgatttatgggcttatgttcagataaactcatcataaattcaaaataccattaagtagaaaatgcattaaatatacctgtatattgaatcgaatcgattctcaccccagcttcctgttttcagcctcacctttgtccctacttacagaagtacctggtgaattctaattctagtgcctctttatctgctggtgcaaattagcttgtttcttggctctcttacttgctttattaaaacctcttgttcatctactttccaactctcagaagtctgctgcaatcccattcaatgtttcgtgtgtgtgtgtgtgtgtgtgtgtgtgtgtgtgtgtgacagagacagatacagagagagctgtttcaggagaaagtggaagtaaaaccatttcctatatagtccttaacaattctttcacaattctgcagctaacttatattcatagcttaggtcacactttaagacatttttgtttttagataggcacgccctggcctcccattctgacctagactcccacatactatttttttgtctcacagaaatctgctccttccgttccttacacttaaccatagttattaatattttattctgttttgtttagcctttataagctgtaaacttggtggtaggagaattccagctgagatttggagactgcaggttcctctccatcccagcccgaaggaggtggttaatactgttttatttatttaatattgagaagaatcaactaaatgagagtggttacagaaacttttaggaatgaaaagataaaacaaatcagcagacacttttctctgcctacactaatcaaatgtctataaattaagatatgtgcaacgaagaagtataaaattattcagacatgtatttaaagtattatttctttattgtgccttgaaaattataatacttgttttcatttcttcaccaaacatacaatgtaagttgggtgcggtggctcatgcctgtaatcccagcactttgggaggccaaggcaggtggatcacccgaggtcaggagttgtagaccagcctggccaacatagtgaaaccctgtctctacgaaaaataaaaaaattagccgggaatggtggcacacacctgtaatcccagctactctggaggctgaagcaggaaaatcaattgaacccaggaggcggaggttgcagtgagccgagatcctgccattgcactccagcctgggtgacaagtgtgaaacaccgtcttaaaaaaaaaaatacaatgtatgcacatagtaaaattttagcaaacccaacagtacaaaatgtagagtgcaatgtaaaagtcctgcttttcaatacatctctatccctagaaacagattctgtttagagtttcttaatcagttttgcaggactttctgtttacacactatgactgcctctccctgtggtctcattggcactattctcttaggtatttttggacttaatcctagaattagaaggattttttgataagtagcatgaaagtagaaaaggtccttgactggaagtaaaaagcaagagtctctcccaattttctgtgtcctgagtctactggcggacataggaatcatgctaccttttcccaccccagccccaaatatctcagtgtttgttaaaacgatttcagcagattttgtatttccttccttccttctttacttcctcctccccttcaacctttccctcctcttcatcctctcccccccttcctcctcctcttcttcctcttctctttcttcaataaatacgttaaccattttttaagaaagtcatagtttaatagtttggcatggaaggacagcacgagaatctgacaatgtactttctgtaaaaggacttcatatcgacgcatacagggctctgatctggtatgtaaaacttacatttctatgaaaattgatactcttgcagaatatgacatccaagcacacaactgtatgttttaacaaaatactgcaagcactcccttattcactccagctggtttctcattaggtcatgtgcccactatgtccattggtaatgagctcagcacaggccaaggagttgcctaggagtggcagtccttacggcctaaactgcctttcaagtttacctaagacccaagagcactttagtttatgtggcaagtcttgttggaactcaagttccaaccactgcgatggctgactaccctcttggtagcgctggtccaaatgcaccctccatgagtgggtaactcatagaagaaatgtctaagcagcaaagcattcaagaggtgacttgggtgctgttcaaggcattcagttttaaaaggcaaacagagcatataagtttggaaaatttgcagcctgtaaatatgatagaaaagaaaatcccattttatgaggagaaattcaaggtggctgcagaaattagcataagtaatgacaagccaaatgttaatccctaagacaatggggaaaatatctccagggcatgtaagaggtcttcaccgcagcccctcccatcacaggcctggaggtttaggaggaaaacatggcttcttggactaggcccagggtccctatgctgtgtgcagcctacagacttcatgccctgcatcgttgccgctccagatgtggctcaaaggggccaagaaagacattgggctgtggcttcagagggtacaagcctcaagccttggcagctttcaggtggtgttgagcctgagtgcacacagaaatcaagaattggggtttgggaacctacaagtagatttcagaggcgtatgaaaatgcctggatgtccaggcagaagtttgctgcaggggcaaggccctcatggagaacctctgctagggcagtatagaagggaaatgtggggtacaagcccccacacagagtccctacaggggcaccacttagtggagctgtgagaagagggccactgtcctccagacccagaatggtggatccactgaaagcttgcaccatgcacctggaaaagctgcagacactcaatgccagcccatgaaagcacccagcaaggaggctgtaccctgaaaagccataggggcagagctgcccaagaccatgggaacccacctcttgcatcagtgtgacttggatttgaggtttggactcacaggagatcatagtggagccttaagatttgacttttctactggatttcagacttgcatggggcctgtagcccctttgttttggtaaatttctcccatttggaacagctgtatgctgtacccctatacccctattgtatctaggaagtaactaacttgcttttaattttacaggctcaaaggcagaaggggcttgccttgtctcaaatgagactttggactgtggacttctgagttaatactgagttttggggcaccgatgggaagtcatgattggttttgcaatgtgaggacatgagatttgggaggggtcaaggcagaatgatatggtttgtctgtgtccccacaaaaatcttatcttgaattcccatgtgttgtaagagggaggtaactgaaccaattgaaagacctgggggcaggtctttcccatgctgttctcatgatagtaaataagtctcacaaaatctgatggtgttataaggggggtttccctgcacaagctgtcttctcttgtctgccaccatgtgagatgtgcctttcaccttctgtcatgattgtgacgcctccccagccatgtggaattttaagtccattaaatctctttcttttgtaaactgtccagtctcaggtatgtctttatcaaaatcatgaaagcagagtaataaagacgtgagggttacatgtgcacataattagaaatacaattgaaaattcaaaagataacaaaataacattttagtaaaataagtaatattttagcataaacttcaaaataataagaataatctgtgtctcttttttccagaaaaaatcttaatgaagtactagtctttaaataatcaaggaacagacaaattttataaaaagaagataattataccaatattcataatttatgtaacattttttattttctttacttctaactcaaatttatattttcaaaaattacactttaaaatgataaacaagttaaggttgtaaaaatctgtagactgtgtggttagttgtgactgactttaatttttgactttctatctggaagattttgggaacttgtgaagcttttgggggctactatagatcttcaagatgatgcactagtgcttatagcacaataaaggcctgtattagactgtcaggaaaggggagttaccattgttattattgttattgttttggttgttatgatgattattattaggttagttagggccccagaaattaggaaaaggaggggtaatgaggagaagacatgaaagagtagaaaatcctttcatggagaagagtgttgtaaaagaactacacttgaagccataaaaatttaactctaatttgagagccaacagtttgaattataataaatgttattttgagaatataaacatgatctctaatgcatatgctctttcaaagtagatacagagatgattagtagttctataatcatcagttactttgatctatatatctactgtatcaaggcagaatagtggccccctatagacatctatgccctaatccttacaaggaaaaagaactttgcagatgtaattaagactatgaccttgagatggaaaaagtatcctggattatttcagtgggcccaattaaataacataagtccttaaaagcaaaagatgggagccaaagtatcaactagagagatgtacataaggactcaatccatcacttggaaaatggaggcttggaagacagaggaagcaggccaaagcaggagggacctctagaaaccaggaaaagcccttggccaacagccatccagaaaacaagacttcctctgtgcaagaaactgaattctgccaacaacaaaaagattaaattaacagattctcttctggagcctccagaaagaaatgcaaacttgccagcaccttcattttagttcactaagacctatgtctgacttctgattaacagaagcataggacagtgaactgtgtggtttaaattgctaagtttgtggtaatttgttatggaagaaatagaaaagtaatacatctatgattggaaaaaattacatagatacctaaacactgctgtactttaataccatattaaaatcactgatccagaacttcaggttatatttattggaggacaaatcttggcagtgttaatatgcttataccaaaataaaaattgtactggacacgtttcaacatttggcatacaaaaatgctaaaatgtttataagcaataatgcaaaaagttatagcatcttcacaatttattctatgaaaccataattgtcattcttttaaaataatcaaacactttttaagatttaatgtacatatgtctttaaaggttgacagttgaacagttatggaaggcactaaattttatagagaatataatattttgaaatataccatttcttaaaaccacattcagattaataaatgactgaattttcaaagatcagatggttgtagatatgcggcattattgctcagggctctgttctgttccattggtctatatctcttttggtaccagtaccatgctgttttggttactgtagccatgcggtatagtttgaagtcaggtagtgtgatgcctccagctttgttcttttggcttaggattgacttggcgatgtgggctcttttttggttctatatgaactttaaagtagttttttccaattcagtgaagaaagtcattagtagcttgatggggatttcactgaatctataaattaccttgggcagttggccattttcacgatattgattattcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggcgctctgtttgtctgttattgctgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagtgagggcatccctgtcttgtgccagttttcaaagggaatgcttccagtttttgcccattcagtgtgatattggctgtgggtttgccatagatagctcttattattttgaaatacgtcccatcaatacctaatttattgagtttttagcatgaagcatcgttgaattttgtcaaaggccttttctgcatctattgagataatcatgtggtttttgtctttggttctgtttatatgctcgattacatttattgatttatgtatgttaaaccagccttgcatcccagggatgaagccaacttgatcatggtggataagctttttgatgtgcttctggattcggtttgccagtattttattgaggatttttgcatcagtgttcatcaaggataatggtctaaaattctctttttttgttgtgtctctgccaggctttggtatcaggatgatgctggcctcataaaatgagttagggagaatccctctttttctattgattggaatagtttcagaaggaatggtactccttgcacctctggtagaattcggctgtaaatccatctggtcgtggactttttttggttggtaagctactgattattgccacaatttcagagcctgttattggtctattcagagattcaaattcttcctggtttagtcttgggagggtgtatgtgtcgaggaatttatccatttcttctagattttctagtttatttgcatagaggtgtttgtagtattctctgatggtagtttgtatttctgtgggatcagtggtgatatcccctgtatcattttttattgcatctatttgattaaacctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagatctaaaaccataaaaactctagaagaaaacctacgcaaaccattcaggacatagacatgggcaaggacttcatgtctataacaccaaaagcaatggcaacaaaagccaaaattgactaatggcatctaattaaactcaagagcttctgcacagcaaaagaaactaccatcagagtgaacaggcaacctacaaaatgagagaaacttttcgcaacctactcctctgagaaagggctaatatacagaatctacaatgaactcaaacaaatttacaaggaagaatcaaacaaccccatcaaaaagttggcaaaggatatgaacagacacttctcaaaagaagacatttatgcagccaaaagacacatgaaaaaatgctcatcatcactggccaccagagaaatgcaaatcaaaaccacaatgagataccatctcacaccagttagaatggcgatcattaaaaagtcaggaaacaacagctgctgcagaggatgtggagaaacaggaacacttttacactgttggtgggactgtaaactagttcaacccttgtggaagtcagtgtggcaattcctcagggatctagaactagaaataccatttgacccaaccatcccattactgggtatatacccaaaggattataaaacatgctgctataaagacacatgcacacgtatgtttattgcggcactattcacaatagcaaagacttggaaccaacccaaatgtccaacaacaatagactggattaagaaaatgtggcacatatacaccacggaataccatgcggccataaaattatgatgagttcatgtcctttgtagggacatggatgaaactggaaacaatcattctcagcaaactatcataaggacaaaaaaccaaacactgcatgttctcactcataggtgggaattgaacaatgagaacacatggacacaggaaggggaacatcacattatcacactctagggactgttgtggggtggggggaggggggagggatggcattaggagatatacctaatgctaaatgatgagttaatgggtgcagcacaccaacgtggcacatgtatacatatgtaataaacctgcacgttgtgcacatgtaccctaagacttaaagtataataataataaaattttaaaaaaataaaaataaaagaataaatgactgaattttctcctgatccagttaatttccaaatttaagtgcatatatatatatgtatatataaatatatatgcacacaaacacacacacacacatacatatatgaagtaagatgaaattcatgtgaatcatttggcttcattttagacatttaaagcaagagttattatcattgaagaatttagtgcttcttaactaaaatttcaaagactcaaagaataaactctaattttactaacaaattgtgttttttaagaaaatgtttaaaatttaacctaaaaattaagcataacaaaaaaattataaatatttccaaagtattttcatgtcatcaaaatattttggctgggctctgtggcttacacctgtaacatcagcactttgggaggccaaggtgggaggataacttgagcctaggagttgaagaccagattgggcaagatagtgagattttgtctctacaaaaaataaataaaaaaattagccaggcatggtggtgagcacctgttatcccagctgctgaagaggctgagttgggaggattgcttgagcctgggaattaggttgcagtgaagtgtgattgcaccactgcactccagtcttgacaatagagtgaaaccctgtcctctcaaccaccaaaagaaaaagaaaaaagaatctggagtttaaatgtatcttaaaagtcaccaggtctaacattttccttctacaatgcctgcaatagatggtctctaacctctgactgaatacctccagcaaaggtcaagtgttatgcaaatgtatatgttgttttttaatcattgtaattatttgaaagtacaaactaatacgcatcaaaacctgatgattggctctacattcattttttaaaatctatgcaaatatgcgaatatgctactaaagagttaattttggccaagtccaaatcacccatctgatttccaaatactgatgagggagaacataatgtaacaacttctttttgactctgtccatttccagacactaagctaggcttttaccatattttaattcattaaatagtcttgcaaatcattagatgaaatcaatcagtaaattctttcatgaaatgttagtggacttccagaatcaatgcctcccgaagaattgagaccttaattgttactggtttactggcaggatctggctgataatatttttccaagcagtcctaaacttcagtcttattgttcatcatttcacattgcttacttatgattcagatattactgattggcaaattttgttttattttatagacaatcgtccctataaagtatataaaagtaaacgctacatgaaagggtacaattagatgtttttatgatgatttattttgttggaagaaagcttttgaagcatctgttaaccagactttcttggttaacattacaagatggcagagagatcacaggtactctccctattcaatctccactgaactggcacaactatttaaatccctaacaaagcacaagttacactgagtaaacatcggtatcgatgagctttttaaagacaggcagtgggtgacttatgttgatgtattcatcaacacaatagtcaccaggctgaacacatgcatgaaagaacgtgcctcagagcaagaagtcttttttctctgtaaagcacagacaagtttctaggtcagagccaagtcagtaaacacacacaacagaatagcttgcaacagtaaaggagagtagtactgaaatcttccttaacaagtgaaaaacaccacagacatagtggcaaaacagaccccaacacagtaatcatcttcctgttcttacggattctgacagtgagttaaaaatttggagagtgttaccttgtctctgctctgcaatatctggggccttagctgaaaagattctaaatttgaagctaactcaatgactggggtaactcaaaaaatagaagggattccacagtcaggggctggcattatgcaaagcctcacttacatgactgatggttgataccagctatcaactgggagctcagttgttactgctggctgtaacacctatacataggctctccatgtggttacgtgggcttcctcacagcatggtggtgaagttccaagaatgagtgtcccaagaagaaacagattgcactccagcctcggcaacaagagccaaactccgcctcaaaaaaaaaaagaacttgtacaacttcttatgacctagcctaagaagtcatatctgccacccagattcaagacaaggaatcacagaatccatttttagtgaaaagagttaaaatcacattatatgaagaatgggagatattgttattgttgtatttataaaataaagtctgctacaggtaatttattaaagaactatgtaagattagctgtcagtttaagtttccctctactccagccacacagcaaaatctgctgaaaaaatgaaaggaagtttgttctgtccagaagcaaaaggagcattcaagtcaaaatattcagctcattaacccggatctcacactcagacctctctttgaggagaatgaatgagtgtgagatcagatctacacactcaaagtggaaacctattccagaggatttgtaataatcagcctgaaactctattcctaaatatagttatcagacatttggggaaaatacaataccatgaagagagaaatcaaaataaaaagagatgaggaatgacttaatagagaactgagaatttaaaaaatgaaagagaacttgaagaaaaaaaggaaaatgtgaaattccagagtcaagttaatatggcatatattaaacagaaataagatgcaatgaacaagcagtggtccaaaaacaagatggaataattcaaaattttaaaataacttataaaagtaacaaatataaaaaataatttgaataagacgacatacataggtctaagataataaggatgttttctaaggtcatacagctaaaaactctggttggtgaagcagatttaaatgcaagtctaatggaatcaacccaaatgcccatcaatgatagactggattatgaaaatgtgggacatatacatcatggaatactatgcagccataaaaaggaatgagatcatgttctttgcagggacatggatgaagctgtaagccatcatcctcagcaaactaacaccagaacagaaaaacaaacaccacatgttctcactcgtaagtgggagctgcacaatgggaacacgtggacatggggtggtggaacaaaacacaccagggcctgtcagaggttggggggctggagagcatcaggataaatagctaatatatgtggggcttaatacctaggtggtgggttgataggtgcagcaagccaccatgacacaagttacctgcataacaatcttgcatgttctgcccatgtatcctgaaacctcaaatagaataaaatttaaaaaataaaaaattcaaaaaaataagaatgcaagtctaactgtacccctttacctacatatactgggatgaaatttaaatcaaatttatatattgtgtatattagtgttatatgtatactttacagtacattaaaagcatatgtattacatacaaaaaaggcaggaaattcatgctttataagaactgctgtataatttcaccattttaaattatctctccatttggtagggctacaactttgcttttcttatgtattattggtttcaactatgaattagttttcctttgtcatctgttaagaatacaaccttcatttatatttttctcactgcatagtgaaattatctcctttataagtttctgtacgacattgtccacaattatactactgacaaataattatcaacacataatgctgagcactaaagttactgtgaagaatgcatatgggagaagctgtctcagagcttgtcctacgtattctgacttctttgttcttttcatattaaaatacagttcaaattgtgatactgttatatgaaactgtcaaattcactttctgaaacgaaaatattttttgtaaacattgaatatatacaaaatctttggcaattatcatttttatgttttgcctctcttctagcttttatgttttaagaacactttatgccttaactgcaattatattaattataaaataagttttgaagatgactttctattgtttcatcttattttatctccatgttgtatgtggattatttgtgctttttttttacctttaagagatcagtgaatactgacattccagatatttttcatacatacatgcttttgagatgtttctagaagcatttaaatattgacaagttccccttctcaacttatggtggacccattttcaaccacaaccttactctcttacaactatctgtaggttgacattaaccttcacattttgtttatgtgactttaaagttcatagtaacttttatatccattctcagttgattttcataccagtcatttaagatgggcagagctgagtatccctgtttaagaagtgagtgagaaggttagagatgtgagataaattcttcagatttgtgcttttagttgaactccaacatgatatgtgactataatattattctctatatgagccagtgttcttaatttcagacatttcacatttatttttaaataaaaaataggcttaatagggaacatgacttattcacagaattgtttgtaaggtgcaggaacagaatctaggcagcactggggtaccaaggtaactgctgattccagcacacttaaaaagcaacaaaatccgaaactgtcaacatggctactggggccagagccataccacgtctcaagacaaagttcaggaaagtggatacttgcctttctctcagtgtaactcagctctgaaccaaagctttgttccagtggaaactaaatcacctttggatcccagctttgggtgctagaataaatactgaccaagacaatctacactactgacccttggctactccacacttacacacaggtttcttctcatgtttaaactcccaactgcaacaacagcatgctcccacataaacagcacagtaagacctcagacaaattaaagtgtgctcattgtttccatgaaagggaagacccaaagtcatatcagttattacatttaactctaggtaatgttaattctcttctcttccagtttcgatgccatctttatttttgtaaattatagaccaattataaaaggtaaccacgacaaaaaaattcagtataaagtactacagaaatgaaaaagaagtatatgattaataattaggtactactaagtatgatcatgcaagaagaatatgaggagctattactgttctcatttctgcaactgttcaccagggtttcatcagtatttataatgttattccccctgatccaatcgatattcgctttttattctgccttcacctcagtgggccaggtttcatcccttatgaggtgatcaagtctatattcctgaggtctgatctctgtggatatgtctgcataggtttctttgttttctcctaatttgtgttccttgacagaagatgctcaggattccagagcttcaatgtcctttcctcactgtgtggaaagcactatatttcaccttgatcatcagaatctagcaccctggccatcatcttgccattggctacagtgcaagtggtattatggagtacttgagaaacaaaaacccacaactgtgtcgtgagcccctgggctggctgtgagatagagttgggacaaagctccacttgtcaactgatgcctgtaagacacaaccctgcctggaagacaacaatggtgttatgtacccccaagtaccagcatcatctcagagccagtggtcaacaccctccaaatatcagcgggcacgctgactctcacaaaaggctcttggtgtcttaaggaaaagataggaggaaaatctataataaaaactaatgatgtttccacaagagtctttttcagaagtacccacatttccattcactcaaaaagatgggtggaggctatgcaatgactctgatgtaagaattgggtgagggctcctgacttcccaaggtggtaactcagtgttaattttgactttttttcccattacacctagagtttgtacagttaaaaagaatcagaattcagtgagcttcccatcttttgagttctacagacattatgatgaattggcctataacaacgattttcagaggtctaatcatttcgttcggcaccagagctgttaactattacaactactcccactttgcctgttgcgctgctactacctttctgaagtcagggagcttgtcccaatggatcgtctccttcctgcatcgctggtttacaaaggacagtcactgaagtgcactgaaggatgctaacgtttctgacaccagtgtatctctcagtgtctggtggatgagaacaacctctagggataaggtctgtagcagaaaggagggatggcaataaatgactgtcacacataataaatctcttccaacatacttacttctctatgtctttagatgcctcctttcacaatactaagaatttctggatcctccaaatcctttatcacagtgtacgcctgagataagtttcagttagccagcaaagcaaacaatctgaaatatcttctagctccctgagctaggaatttaaatcccatgggatccagaatctcaggaagaagtggtcagggtacagcattgagactagacgctaaagagggtagcaatttattccatcattgttttataaaacatagagcattaaataatttaacatacgtcttaacctagatggaaggcccaaagagtcaattgtattccttcatataaacaatgaaaatatccctaaccctaagagatacggtttgaggcacaaagaaaaatgagatagagattatatctgcttatttttcccagcacttccaaatatcacctttgaaatgagaatctgggaggaaaatcccaacaaccaaaacaattgtgaaatacattatctctctctatatatttgtctgttagcaggcagcagtaagtctgacaattttataatttttatttattcaaaaatctttttatagaaaagcattgaaattgtagacttaaatgggatacaaaaagtccattcacttattcatttttatttaacaaatgtttattataggcctactacgcaccaaacaatacattaactcacaatgatctatagtccttatagacacatttgataacacagtcaatgcataaataatataaaattacaaacataaaagtaaaaattgattagcatacagactaatagaaggaagcctaacttaggagatactcaagaaagctttctctggggaaatgtcatttaatttgagaattaaatgttaggatgagtaaggtttagccaagtcatgagttagagttgtggaaagggtaatttgattctttttttaaaaaaaattctagttttgcacgcgcacacacacacaatgttttatcagaggtttattgtctatagtgagagaaaagaataaacaaaagtggaattaggttgttaaggagaaaggagataaaactgaggtgtcatttaagtgaccataataataaaaacatcattctcaaaacaactgtttatttcatttgaaagctgtgtgtgtgctacggaagacagtgcagaataattctgcctgaacaaacaacatatcatatgaaataaaaaaacagtacccataacagaaaaaaaagggcttaattttggttcagacctcagcagcaccaacctttctatttcagtattcactcagtacattgcattataaacaaaggtgacatgtcctcttcttacttgtgatctctctgctattttctgatggatcagattcctagtagtttgtagtagtgtatcttgcaaaaataaaagcatggcaataacacttgctattctaataattctataaacagaattgcttagaaaattcataataaaatgcaaaacgagtactttaattccatatttctacctcacaaatattaaatctacgagcatagccttgacaccataatctatgccctctgaaaataaagaggtcataggcctttcttgctagtatatagttttactcaaattgtgtaataaagaattatagtaagaagtttcaagtttttaattttgaagcatatagtgtattatcataaatcctttcttgaatttccctgcagttgggaatgtattatacgtataaagtgtacacctagcaatgccttgtttaaactttacataataaataccaatgttatttcaaatttgatttttcatttgctttaaatctccggatattatgtaaccatcaaatttgtcgagattgaaaagctgtttgtatagctagatgcatgattacacacataaaactgtagaatttattcatgatgatcctaagtgatcatctttatagctgtttggttacaataaaatagccattaaaaattatacctgaggtgagtaaaatgttcagggtttccaaaagtctctgctcttttctgaacaacttttgctccttccatagaattcaatagtacatatgcaaataaaccattatggcgtgctgctgcgttaggaatttatatactactatttcctttcaattcatgtagtacttatctccaaaaactggaaccattaactttttttcttttaaaaaatcttttttttttatcattaatttgagatctttctagcttttcaaggtcagtgtttagtgctataaactgtctttctaacactgttttcactgcatcccagtgattttggtatgctatgtctctgttttcatttatttcaatgaatttttttttctaagtgcctatcatgtatagcagatacagtgctagctgcaaaaccacttaattgcaacttgactcatacaggaatctttctagagaaaatttacaaagatttaaactgttcttgctctagccagtgcagctaagcatcagaaactttatgatgggactcacttgtgatcttactatccccccattctacttctaaaattatgatatttttgagatctagtctgtaccttctgtacagtttaaatactaagtaatttagttttccctgagatttcactttggaaactttcctacaattcagtttctttataacactaagcattgctttactcccattagtcctatcctggaagcttccatcacggtcaatggtgtcatggtagaggcatttccatttgccagaatttctaaatttcacttgtctgtgtgattggctctacattattgcctctgatcctctcctattgaactttaattgtctcatgtttcatctccattatggtatttccatatcaaatatcctaatttttattgacattagtcttcacattctatctctcacccaaccttctggcaacactctctgcaggtgatctttttttaatctctctattctatctctgatcatctttatcaaaaaaaattctgccattagttctaaagagaaatgtgtttatttctttagtactagttaataaaatacagctctaactttgtgcataattttcttaaggtacatatcaaatcttatgagatgtggtcacagcaatacataaataagaatcgataggatttattaatagaaatggagaaaaaatactgataaagaagcattgttgtaagttgaattgcatcttctcaaaaaagatatgttaaacttctaaatcccagtaccttacaatatgacctcatttggaaataagtcactgcagatgtaatttgataagatgagatcccactgaaatgcggtaggtctgtaaccaaatatgactggtgtcttacaagaagatgcccgtgtgaagacagagtcagacaggatgaacatcatttaacaatgaagtcagggattggggttatgcacctccaggccaatgaatgccaaagactggcagtaaagcaacaggagctaagaagacacaaggattctcctccaaactgtgagataataaatttctgatgttttaagccacacagtttgtatacttttttacggttgccctaggaaacaaatacagccctcaaccagagaaattagaaaaaaaaatccaaacgatatggaaataaatgaaaaaaataaaggtcattaactttaagatgaatataaatgcaagtcaacaaagagcatattgataataaacatcaaaaattggttctgaaagggtaatacagatgtgtacactattagaaatttaatctaaaaacagtaaataaagaataatagaaaaggaaataatatcaattgctaagtaaggacttttttaataaagaaggaaaataatatgtagcttggcaattagtataatgaggtctacatataacatttggggtccgtttcaggtttttaaaaattctagtttgtataatttccaaaacgcaataaagtgtatctatgagaaacatacaaaaattaacactttatgttcaacaactattaatagaaatgtttccattaagtcaagaatcaaccaatccaaaacaataagaaaagaataaaataaagaaaaagctgtttttatttgcagagatcatgatatcctacataaaaatcaacatacatcactgtaaactaagtattattaagaagaaactttagcaagattactcaatatatcacgacaatgacataatgcattgctaaacactatccataagcaattaaaatgtaatgaatccaaaatatctcattcacaaagcaaatttataaaacacaaataatcgaaattataattgtatgacatagctagtaatttactaaatataattgaaaaatgataatatttaatctcaattaatggaaacctctaccaagatactggatggaaaaataacatcaacccttgaacagcacagtttcatctgtgcagttccacttatatataagttttcttcaacctctgccacccctgaggcaacaagaccaaccactcctcttcctccttctcctcaacctactcagcatgaagacaacaaggatgaccacctttgtgaaaacccacttgtagataatcaatagaaaagatattttctcttatgactttcttgaagtttcttttctctttctttgatgtaagaatacaatatataatacatatacaaaataggtgttcaccatccacaatatcattcccaaaagaccaaaataggcattaatcaattgtttctgttatgaacttctggtcaacagtacgttattagtagttaagtttttggggagtcaaaagttatatgcagatttttgacctaacagggggttggtgtccctaattcccacattgtttaaaggtcaactgtacatttttgaagtgtcatattttcctcataaatttataaattcagcaaaaattcaaaaaaagtatgaaatttgacaactaacttaagttactggaaagagagaaagcatggagaattaagtttatgttctgctttgtaacctaacaagttacaagcattttcaagcacatgaaactttcaagcacatgaaaaaatctgctacaataactcacggctggtgagggtctaaatttacagtctttttggaagaaacaacaatattcatttaagtattacaatgtgtatcccataggaattaacagttcattttattttggcaagtctaaggaaataaaagagaaacgtacaagggaggtcactgcaatattatatgtctgagtgaaaaactgaaaatgattgaactatccatcaataggaactggttaaataaacttacatataaacaaatgcactttaacagttaaaaggaatgacatagaatgataaacactgctattgtttgaatatgtcataaattcatgttagacacttaattcccagtgcaacagtattgggatgtggagcctaacaagaggtgattagatcatgaaacctctaccctcatgaacacattaatgttgttatcacagagtggatttattatcatgatagtggacttattctaaaagtgagtatagctccctcttgatcttgttctctcttgcccttctgccttctgccatgggatgatgtaacacaaaggccctcaccagatgccagcaccatactctttgactgcccagcctgcagaactgtaagccaaataaacttctattgtttataaattacccagtctcaggtattctgttataacagcacaacatgaactaagacaagcactaatatgaaaagtatctaagacattgtcaagagaagaaagcaaacagcacaataaatatattttattagaactatattttacatgaggatgttttcgtgtctattcttatacttaagtgcactaatgaaggattcaaataataatagattgctcataaaatttttccatgttggagggtaaaagggtggagaggaaggagttgaaaagtaattttcacctttttctctgtatccttatttattttttaaaattgttttattaatgacatgaaataactttaagagaaagcaataaggcagactagtgttttaaagttatatttctaccatgatgtattcttaatacttcaattcacatacttaacctctttatcagctttagagatttttaacttgtcaaaagaatataaaaacaacttagaagaaattgctttattattagcgtgatcctccctcacttcttgcccacgaaaattattccctgtgcattgagtgtgcacaggactgtgcgtgagcactccacagttcatttctttatttaatgtcaactttcagccctgaacacgcctaagtataggtataaagtaatagaaaataaaccctaagtgaaaggcattagaaattacagatttaggatattcttttcaccgagaaattggcattgtacataactagcggcttttcagtttctgaaatatatttggcttacctggatttcagttcaatcagttatacctgcctaatatccttcattttccttattgcagaaattggttgctcaataatgagcaataactatgcacatgaaattaaagaagtcatcacttagagttagataaatagtagaactaataaaactaatgaaaaaagattcttttaaatctgctagtgaattacttgatatgtcaaactcaattttaaagcctagtgaaagtgaatttgaagagctgatcaaagtcagtctgaagttgtttagcgtaactgaaaggagaacatgctatttaagaacattctttaaaatttgttggaaatttagatatagtctaagagtaactcagggcttcttcggttgtatgcaatggtaaacactttagctgggaataagtacttgtattccaagccactttcattctacaaaatgggtgaagaagaaactccagtcacccacccctttctgtccctcatcttacatcctggccaactctagtcaccccaagtccactacatgtaattttatgccctccctcctctttatgtcattcccatagattcaattgatcccttcccccaaataagttaaagtcgtaacctccagtacctcataatgtgatctcatttggaaacagtctttacatagatgttcattaaggtgagattattaggttggactgtaatatgactgctgtccttataaaagggagaaatgtggacacagggacagaaacacacagaggaaaaacaatgtgaatacacacggggagaagactgcagcgatgcatctacaagccaaggatcaccaagtgttgccagcaagacagtagctagaaaaggcaagtaatgatttccccctagagttgccagagggagcatgaccctgctgacatcttgatttaggacttctagcctccagaactgtggttcagtaaatttctgttgttttaacccacctcattgttggtactttaaggcagctctaacaaactaagacatccatatccatgagaagttccagacatctcagtcttacctaagccactatcctctaatcctcatgagactcttcacatccattattctgcccctctattcacccctcccaagcgctggaagattccactgtgcactgtggacttattggtccattgtcagcaaaatctctttaccctgaatctcttctccatacattgagttgattttctggatctaacagaaaccaagctcttctgaggacactgctttccttacaacccctccaatttccctctcacactccttgtacttacctttgagtgtgtaggtgaatggtaaaaccactatgctcctcactgtcagtcccagattgttttccctcttgcctaactaaaacttccattaggactctatgtcaatagactctgttacgtgacatgtactgtcatgactattcatttctgctgttacccactctttcttaggtcaatccatcacttttctgtgatttggctcctgactccctgatttctatttcttcatttcaaaaatgaagaatatacattctcatgatcctccaatcaacatgggttctcagtttcctgaacttctctattccaaaggtattttatcagtttgtttttctcagtttgttttctgcagtacaccaactcctacaccaggctcatcaacccatgaatcctcccatctttatactgtctctcctccacatgttgcccctctgccctctttatatttaagacaaatttccatgagggcaaacttattatcactacctagcatgcaacctcaattctcctgcctctttctcactaccacattcacttggagaaaaaaacataatcctgataaattcctattctttgcctacagagtctgtacctttgcagttaaatgtggctgaagaaaaactagaaacaatgtctgtggtttcactttgaattcatgacaattaatttcaagggggcctgtaatgcttgcttttatgcaagcatggtatacttcctagtccaatcactcctcctgtattctgtattacagtttacacttctcttatttcttcaaaccttgattatcttttgccccaccttccttctaagctgataacctcgatttcttcattgagaaaaatgaagtgaccacaagtaaaatttcaaagaatgccaccaccacatatgccctcactccaagtatctgtatatacatccctgccatctgtttctgggaatcaactacatgtcttctgcctaaagtcagccccttcaggggtaattgatcctatttcttattgcttgcttatactacagaatttctcccttctctcaggtataaccacacattttttcctttctcccaaatcagtcttatgtgtacatcaacttgatgatattttctattataaaaacacaataaaccaaaatgtaaaaaagctcttaactccacttcttgccagtcactgtgcaatttctctgtgcccctttacagaaaaatcctcaaaagagtattccatactcactgtctcctctttccattgtcttccctctctttccattctctttaatttctctgcaatcattatgaattgaattgtgtccttctacaaatccatatgttgaagtcttaaccctcagtatctcagaatgtgaccttatttggaaacatggctgttgaagatgtagttacttaagatgaggttatcctggagtagagtgagtccctaatccaatatgactcttgttcttataaaaagtggaaatttggagagagacgcacacacacacacacacacacacacacacacactcttcaagcaccttgtcaagataaaagtatatagatcagggtactgcttctacaagtcacagaataccaaagattgcggaaaaaccattaggacttccattaagaccctaagtcaataaactctgttacatgacatgtaccgtcatgactactcatttcccatgactactcatttcttctgttacccactcattcttaggtcaatccatcactttcgtatgatttggctcctaattccctgctttatatttcttcatttctaaaattaaatcctttcactttcatagacacccgcatgatccatcaatcaacttgcattctcagtttcttgaacttcactattccacagatattttatctttgccttcacgtagcaactcactgacataatcaccctctagacctagtcattaccaacaacatccttagcttctctgttaccttaattgcaggaacagattcttcctcatagcccttgaaaggaaccaaccctgctaacaccttgatttcccatttctcacttccagagttgtgaggcaatcatcttctgttgtttatgccactttgttcatgtttcttggctaaagcagtcttaccaaaccaataggccaatcaagcatttagtctaccacttaagtgcaactggtctaacctatgttcctatgatcttcacattgctaaagcctaagtaattatcagtccagatttgtgcttgattggtcagcatcatttgactgtcttcatctgacttctcaggtacaacacctgccaaattttgcttctgtcactctgagaggtccctctcggtctcctttacttggttctatttctccacctcttaacttaggagggctttcagggctgaatttctggccctcttcattacttaaatgtactcacctatgatgtcattgtaaataccatctatctgctgaggcctctcaaatttacatccccatcctaaaactattccctgaaattcagacttgtacacctaagctctccttaaaattctgcatttggatatcaacagacgtctcaaccctaacatgttcaaaatgtaacctgtgatcttctctcatgattgtcctcccacggtctttcccttcagctgatgacactctgtcctgcctgttgtttagtccagaaaccttggtgaaatcttcaacccttctctttctttcacaaaccctatgtaatccttcagatgatccagttgcaactagttacaaaatatatccataattctcaactttcccaacctcctccactaccacccttatctgagtcatcatgccacatgacacttcccctgaattactgctgtagtcccctgcatgctcttggcatacatgactgccctttgtcttagttcatttgtgctgctatcacaaaataccacagaatgggtaatttatatagaacacaaatttgtttcaaattaattctggaagctgagaagtctaagttcaaggtgcaggcatctggtgtatggtgaatgcctgcttgatgtggcctcacatggaagaaagtagaagggcaaaaggggacaaactccctccatcaagcccttttataacagcattaatctattcatgagggcagaatcctcatgacctaaacacttcccaaaaggcctcgcctcccaacactgttgcattggggattaagtttccaacacatgaattctgggggacagattaagaacatagcatcctctatggtctattcaaagcacagcagctaagatgtccttcagaaatgtaaatcagaccatggctcccctctgctcaaaatcctgcagtgattccatatttgcttcataggaaaagccaaagtcctaaacatgtacactagggcactcagcttcccgttagtgtccaactacatcccttgcctcttcttccctgccttctcctctagcacaggacattcttgccactccacaagtaagacaggcactcagtcacttcaggacctttgcactgactgctccttcaccttttaattcccttatccaagaaatctacttggctatctctttcaccattttatatatctttgcccaaatgttactttcacatagattactcagagcactgcatttaaaatagaaatagttggagtgtaaattagttcaaccactgtagaagacagtgtggtgattcctcaaggatctggaaccagaaataccatttgacccagcaatcccattactgggtatataccaaaaggattataaatcattctactctaaagacacatgcacacgtatgtttattgcggcactattcacaacagcaaagacttggaacaaacccaaatgcccatcgatgaaagactggataaagaaaacatggcacatattcaccatggaatactatgcagccaaaaaaaggatgagttcatgtcctttgcagggacatggatgaagatggaaaccatcattctcagcaaactaacacaggaacagaaaaccaaatgccacatgttctcattcataagtgggaggtaaacaatgagaacacatggacacagggaggggaacatcttacacaggggcctgtcggggttgggggttaggggagggatagcgttaggagaagtacctaatgtaggcgatgggttgatgcgtgcagcaaaccaccatggcatgtgtatacctatgtaacaaacctgcacgttctacacatgtatcccagaacttaaactataataataataataacaataataataataataataaacaggaatctctactccatcccagcatgtctgactctaactttgccttattcttttccattctaacaattatatgatttattttcttatttagtatttcctttctacccagttttcgctagaatgtaggctgaaacaagtcaagactatttattatattcacagatgcaaccaagacaggtatgctcaaaaaacatttgctagctgatgaaaacaaccagtccacctaccaacatgtcttattaattcaaataattcattccaaattttcttcaatgtttaatgtacaagtcatgccatctgtaaatagcagatttgttcttctaatatttatatactttatcaatagtctttgtttttatactctaggaaatcaacagaatgtgacaccacaggttgattaagaataccaccgtggaagacagtgtggcgattcccgaaggatgtaaaactagaaataccatttgacccagcaatcccattactgggtatatacccaaaggattataaatcattctactataaagacacacacacacgtatgtttattgaagcactattcacaatagcaaagacttggaacaaacccaaatgtccatcaataatagactggattaagaaaatgtggcacatatacaccagagaatactatgcagccataaaaaaggatgagtgcattcctttgcagggacatggatgaagctggaaaccatcatactcagcaaacagtaacaggaacagaaaaccaaacactgcatgttctcactcataagtgggagctgaacaatgagaacacatggacacagcgaagggaacatcacacactggggaatatcgaggggtggagggctaggggagggacagcattaggagaaatacctaatgtaggtgacgggttgatgggtgcaggaaaccaccatggcatgtgtatacctatgtaacaaacctgcacgttctgcacatgtaacccataacttaaagtataataaaaaataaaaataaaaaaataaaatgaaataaaacaaaaaagaatactagtgcagatacatgtttttgtatataaaagatcttacaatatgcaatatagggggaatctagttaccacgtattaacataaagtatgacagtttttattttaaaaatcataggtaaatatatacagacactcacaaatgtgtacatacacccatatatagcacttactgtgtctgatactctcagaattactcaaagcatgtattattaggcatactttccagataagaaatctaagtcccaagtttgtacagggggtatgcagaaaagtaagaattaaaatcctatgtctatccttccaaaactccctacgctctattgcattcaacactggaatttgaaatggatcatgaaaatttttcaattccccagtacacgacagaataaatctgatcttttgggttttttattgtaaatataaaattcacttagcaataattcaacagatgaatgcacatgcttcttcttgtgtctaggtaaatcctcattaatccaagtcagaagattattcctgggttaaatctgtggaaaaattcagcaattggaaatgtagactactcaatctttaatttgcaagggtttttggtgacagattgaattgatgaagtcatgaaagacactcaaaagaatgaggataattgattagaacaacttgatggaaacttggtttcaagttatctaccaaaacatgcctttatatccttttatagttagaaaatttagatgagcacagccttccagaataaagactgtatgtgttttccagacttccctgtgattcagtgggggccctgtcactaacttctggctaatgagatagagtctaaaatgagctctgcaacttctggaatgggttttttaagagagtgcatataactgcatataacttctacctttctgtctttcttgctggaacctggatgcttttttttttttttttttttttttttttgtcctaaagaaaccatttgggaccctgtgcaactcttggctctctgatcctgaataatttatttagcttctctgtgtttcagtatccaaatttataaaagtaaataatacaatgtatcttctgggagtgctaagagttgaaagtaacatggaaaaattttagcaaagtagccagtcctcagaaacatttattattttgatagcctgaaagagggagtagaggtaaatatccttttctattcttcatattctaaaaacactcatatagaattttatgatatactaatagatacttaaaatgtgaaaaggaggaggtctcatttctctacccccgcaatataagtaagggacattcatacacacgactttgatcagactccagaaaaaacaggcctccactgcattctccctaatatctaacattcatttctaaggagggttaatgcctctaactaaactcttcccatcggcagaaatttcctctgagcacagagtctcaacaagcatacacattttcagcgtgaactgtttaactgtaacaagaccgtctttataattctggaaaatgtttaagttcctaccacgctaagaaacatacgtatacacacacacacacacacgtaactcatctatgcacatgaattatcaatgacatctgacttttacttgggctataaataatctcaccaagaagtagtcaaactcttaacagtgtatatgctacttatttaatttcttgaatataaatatttccaaataatagaaaccttattgaacgtatactttttgagatttataacaaaaaagaaacattgatgtcaacgttgctttacattcattatatttaaatgactgctacttttacactaccacacttactgtatgctaagtattttcaatttcaaatacatagtgagaaacatttcccagtgggaatgcatttccacagttttatatcaattatacataattttatttcttcctggatatgatatactttgtttcatttttataagtaattgttatataccccagaccagttatatattcttcttaagtaacaggaaatgagtttattcacaacttgatgaattacagaatgcctgtgcttttgtaaaagtcttaaagagcttactcattccaaggtaatacttcctttaaaactctaattggtacaactattagattaatacatgattttcctaaatattaacagatttgatcatcagctacttgatcttccaagttctgcaggcattaaaagatggaaaagtacactgacagtatctgtccccatctcaggtgataccctgccagtctcaactgacatttatggtaagccaaagaaaaatatacatgtgtagatatacttcgaagcctttaaatacttaaataaatagggtgaaagtttttacatactacctcaaattttgcagcaatttttcaagaaaaagtgaccccaaaacaacatagctctaaagtatttatgtataattctataaacataaaagaataaacaataataatagtaattgatatattactaggtggcctgtctccataatacaagattcacataatttagacatgtaataactctacgaagaaagttctgtgattttccacagagctaagaagtggcaaagctgagagctttttctgacagtgaaatatgtattttagctagcaactgtattcccaagaagttacacatttgcagcctaggaaacaaagttgatcatttgtttgcttagttaattttatttaaatttcagtacagtaccaggggtggggtgggatggagtttattatgttttgctttagatgcacaagaggattaaaaatgacgttatctttgagaaccaggcattgtgttaggggacagagatggagatgaagacaatcatgtattttctcattataaaatcctcttagtttttttttgtgatcaaattaatataattacaaaagcagtaatcttaaagagactgtgactatgtgaggattatttggataagatgtggtttcaagagtataaaatttcaagctaaattacaggatttaagttaatgtatgatattttaagtaaagttttaactatttaaatttgaatatctaaaaccttaatgccatcacattattataacctgaatctcattagctatttttaaataaaatgattactgtcctttaaaattgtttttaattttcttcaacgaaataagatgcattttgatttaaatgtcttggtacatgctcaaatatttatatgacattcacattatataaaaaaattgaaaaaataaaagtatacagtaaaaccagaaagctaaagtagactcagaaagtaatgaacttctgtttcatgaacttttccattgttgaaaagaattgctatttctttgctgagatgtagtatacaaaccttatgttactataaatgtaacattgtaagttacctcagtaagtgaccctcaggaagactaccaatttacagtattattatatctgagagagttaagtctgtgacggccacaaaattatttctagcagtaaacaaattaaacttgtatttttaaactatcacaaagctggcaaatacctaaatagaagcactttttataccagttactggatttctttactactgaaaataatcaagcatattgtagaaaatctagaaaatgcagcaaaatgtcaaaataaaattattaaacatctataatcccctgacctacagatacactttttggtattttggtgaaatagaacattgcaaagtggaccatgtatattttaaacttgttcatacacattttctcatgagcatttcctcaaggaagtcgatttaccttaatattttatcttaataagttgtaaatttaaatttctcaatgtttgtaatttaaaatatacattaaacctcaggtcatttccattactctgttctgtgtctatatattttattaatttatgttacatgaattacaaagtcattatcttgatattaattctccaaatgacgaaaatttattataatcgttacatgacattacatgtgcataattattcaaatacacatgatttttaatttttatttgggaggtaaatcctgaaaatgactttataacaccacatatccagtagaaatttcatggataatgctatatatatgcacgattatatcacttagatataattctttattttataatcccacttccttgttcatcctacttttgttaggagttgtatgtattaatatgtgcaataataatttatgtgtaagctttaactgacttaggagacaattttgttatcccctacatccttaaatattccaacccagccaaacaacagtgattattctcgcaaatgaacaaaacatcatggtctaaagtcaacatagcaaaataaataacctgaaaatgttcccacagtaaataccttaaaatcaaagtgataatataacaaacgatcttttctcaatgcacaactgaactctctggaaaataagggaagccacctgactctcaaatcaagaggagactaacagaatagagtgagaagcatgtagctggattctctgggaagtaagagtcttagttgagatttttggcataaagtcaggtcctttgaccctgggttgggaggcgggtcggaggaggtaaggtagagagaagaatctcctgcaaatgaaagccgcttgtgctttctgagagccccaggtgagagaggaacacaaaaactgactccttttaactgaagtaaaaatttatctgctatagtgggaacattctctaacagatcttggtgcgttcccatacataacctccccaggtataaagctacggaaacgacaacaacaacaacaacaaacccttaaactccaagctaatatatacatgaagaaacacggtaggtaaaacagtctgcagaagtaacaagaaaattagctatttgagtacttcggttaatggaatcttaatagacattttttaataaaaatgtgaaaggaataatatgaaaaaagtcaggtaactttgaaagaaaaaatgcaattttggaaatataatatccagtaacttattatgaaaggacactaaaaacagttgaagaaggaattcatgcattcaacggtgaatctgaagacaccacaaagaaagcagtaaagggagataaatgtacgggaaatggggcctgggcgcggtggctcacgcctgtaatcccagcactttggaaggccaaggcgggcagatcacaaaatcaggagttccagactagcctggccaatatggtgaaaccctgtctctactaaaaacacacaaaattagccgggcgtggcggcgtgcgcctgtagtctcagctactcacagcctgaggcaggagaatcacttcaaaccgggaggcggaagttgcagtgagccaagaccgcgccactgcactccagcctgggcgacagagcaagacgaaaggaggaaaggaggaaaggaggaagggaggaagggacggagggaagagaggaagggaagggaggaaaggaagggaggaagggagggaggaagggagggaggaaggaaagaacggaaatgctgacgtctgagagaaaagcatgagagaaagtgtgataacatcataccaatatctaattagaattctaaaagtaaaggaagagaatagcagagaggcgatgtattagtccattcttacactgctattaagaaatacccaagactcggtaatttattttaaaaaaaaaaaagaggtttaactgactcaccgttctgcatggctggggaggcctcaggaacttaaaatcatggcggaaagcccctcttcacagagtggcaggagaaagaaagagcggagaggatggggaaaccctttataaaaccatcacatctcgtgagaactcactcactgttacaagaacagcatagggaaaaccgcccccatgatccagttatctccacctgatcttactcttgccatgtgggaattattacaattcaagctgaaatttgggtggggatgcagagctaaactatatcagacaatatttgaagaggttaattttccatgacataaattttccaagacataaatcttcatattcaaaaagcacagtatttccttaacatgataaaaagaaatctcacgtggatgcatgtattaaactacagaacttcaaaaacaagagaatctatttgaaacaagcttagagaaaagacattagcaacatagaaatgacagtgatgctaacaagtagactggtcaatggcttaaaaaagaagccaaaagacatttgagaaatgtcttctggtgttgagaggaaacacctggtttcctctggcattctaacagcagctaagacactattcaagagttagaaaaaaatacaggtgttttgatgagaagactgaaagttattagcactaatatttccttgaaaagactttcttcaagaataaggatatttaaccctaaaggaaaggagtatgaaaaatataaaccatggttaaaactaaacaagcattgattgtatgaaacaatttaaaaagggactatctttagtcgttttacaaaagttagaactttaataatggagccagaaattaagaataagagaggaaatatgaacagatttaaagctacctaagatcttaggaaggaggttagagatactgagtagttaaatggggatattatgaatttaagaatttaaaaataaagggaaatataagacaaaacagcaaaatattttgaaagtgttatttaataaaaatagagaaaacatcatcaaataatttggaataaaatggatataattactaattgttgatacattcgtttttaaaaattacattgcaataacattaataactaagttttatatggcccttatgatgttccaaacatttttctaagcatgacacatatattacttcatttagtagttaatcattaaagacagtatgtattgtgttacaccattaaattagaaaaatatttatttcactcttttctagaaagatacaagttagtaaaacaatgtcaagaaataaaaacaacctgaataaatccatatatattaaatacatttagttttgagaggctgagagtggaagaagataatcttgcaggatggttaaagacgatatctggagaaaaataaggtacctctgtttcatacccttaataaattcctgtttaataaattagggtctgcatgtgtatacagtcaagcatagctggaaattataaatccaaatacagaataatgactaattatttaaagggacggaataagggctgccttaggctgtgaaggatgtgttctgcatcgtccgcgagcatgatttcccttagagttcagggtatgtgagcactgcacacacaatctgaaaaatcacacacaaaggccccagagagcaaaaccgtgatgttttatcccaaaaatatgcataatttgaaataaatggagatgaattttaacttcagcacatgggtgttgaatataaaattctctatttattttacatgcttgatatactatatgaattttaaatataaaacaatatacagatgcagtgtctttgacagaaagatgatgtacccactagcaatgttagaagtgtgacttttcatttttaaagatgtgacactcttaatcaagaacttctaaaatgtaaataacactgaaatgctctattaatgaagcaaataaataagagttcattcttaagcctttatttaagctattaattttattattccaccataaacagtacccctaagtttccctgtagttaaattcaaaggattgactatttgatctttcacatactatttaaaataaactttgtatagttttatgatttgcagttctaaacttctgacttcacttgagctatacaaatataggattcatttcttaagcaatagtcttaaattatattagcattatatgttactaagcaaattaaccagatatatcaattccttttgtaaacatcttaccaataaaacaaatagaaatttgataattcattttgggaatatattctaatcaatattcttatcatattctgagaactcagcatgacactttcgattacaaatcttatagttctaactgatatattttctattaggtcattctgtttaacctcaaatgccattaagttcctttgtaaagaggaataaaagttattttatcttaaagtgaactgaaaactgatggaaaaagttgttcttttatcaaactataatctattgtttcagctacagagaaattatacacagaaaagagtataaagaactccataaattattatgacaaaaagaaatgccaaagcaatagctttaaaagtgttttttctatgccctggcaagcagtaaattgataaaactaataaaaattgaaagtgagacagaaaaaagtgtccaatagtgtaggaattctgaatttcctctattttatatctgaagtatcaaaaatgcatcatttgcaactaataactcaagtagtataattaagaaaacattaagaaatataattaataaaattaggtaaaggaaactatgaattatactaatttcatcaatgatcatgataggaaatttataaatattacattaaaatatggtagttaagtattatatgaacataagcaaaaaagtttagcttaaaagggaagttctaaaaaatattacaattctccctaattattaaaagaaataaattaaaaagacacaaaggaaataaaataaatcatataactattaaagagtgtaaacaacacaaacggatgccaaaagaaagactaaatttgataattattgtaaattggctaaatttgcccactaaaagataaatataattaaattgaatgccgaagcaaaacccaatactttcatgtaaataaaataaagtagttccaaaggcaggaatagaaaggagggtataatataaacaaaaataccacaaaataataatacgagtaaataaaatactaatacaaacaaaatgaaagcaggggtcacattctaaataaaaaacaaattgagtgcctgcttgtgaagtgtgacagaattggcactttgttatgatgatacaatagctattaatatctatgctccaataactgagcataaattgtcataaaccaaaacaacatgtaaatcagttcctacaaataaaaaaagagatacaaatattctgaagatgtacacaacacacaaaaaggaaatataagtagtttttaaatataaatctttcaaaattttaaatacccatacaatttgactcagaaatttcatttccagaaatgtatcatactaacatgcttgtatttgttcacaaaggacattcactgcagcattgttatagtggcaaacagttagagacaatctagtgcaggattagataagtaaaatttggaattttcatataatgtgacattattaagctttaaaataagagttgcatatactaacaaataacaagctctagaagcggggggaggtagtcaggcagatagatagatagatagatagatagatagatagatagaaaaagatagatgatagataaagatagatgatagatagatatagatagatagatagatagatagatagatagatagatagatgatagaaaaaagatgttagattgataaatagataaagatagatgatagatgatagataggagatagatagtggacatagatgatagataatagatgatatataatagctagatgatatagatgatagataatagctagctagctagtttttaaataaaagtgcaagatgtggatgataaactcatgcttaatatattttattttctgggcacatagaaggctatgattttcaggaaggccatattacccagcctttttcctgcagcagcatcatgtgaccagttatagccaaaaggttgtgagcataagagacttatgctccttaattgcttctgattgacttaactgaagcatttaattgctcctgaatgacaccctctcccactcttttgctctgcaggggaggagggagacaaaaagaacgttggagactggcaacccagctccctgagtgacagaatagagcagaccactggggtactctcactcctggctgtcaacccaggctggttataaactgcaatcaagaaataactgtttgacattgacattccaggaataatttcttagtgcagcttactctagagtatctcactatggtacagaactatatatgaagtgcaatcgtttgtataacagaggaatacgttttataaacatatatgtatgtttttataaacatgtatgtatgtttttataaacatttatgtatgacctgagaacagtgtcaacagtgtcaatagaaagggaaacagaaagctagaaaacagaggacacaagggtccatatatgaattctttctgtttcaattatttttaacaacgtcatatatatgtgtattatatatgtttcttgcatgtgtatatatatatatatagatgcactacacacacgtgcactcacgcgcccacacacacacacacacgtttcttcccaaaagagaaaaagcaggagaatctattcatctgtttactggataaaattagtatgaattataaaagagcaatgtatctgtgtctgcgtgtggttcacccaagtgctgaatgtaaaattactactaaggactacgctattgatattcaaactggggagaagtttgaggtttcacaggatgcatcacagcttcctggtttgtatccaatgacaggaaactttcatgtgacactgcagccattagagaattttttgatcaaaattattgtcaagcctttttcatagccagagaatccaaaatattggctcttggaaacaatacatgaaaagtaaatataggcttgtaatattaaagcaaaaatgatggagaaggtatagcaaagagtaagtccgtaagtattgagctcacagctatttattattttactgattatattaggaatacaaacatccttaacatgaccaagagttgacatcacagtgaattgcagggaaaaatgaaaaatcaacaaacagtaatacaaaaagtaatcaatcctggtgaagaaaatgagagttgagaattacattgtgcaatcaatgaagatcaggaaaatctgacaaatatgaaaagataaatgtagataaagccagaacaaagacaggttttcttcataaaaatatcactacctgaaatgtaattatacaactatttgtgtgtgtatacatacatacgtatttacacatttcctcaatgaaatataaggtccaaaacttcaggactggagtttgtaattttcctagaacagcatctgacacataaaagccactcaattaaaactttcagattaaataaacaaaagatcattaccttaatggttttctccagttacttggtaaatgaattagaagcttaaaatagacccactcgactactgagcaattaaacttactgattgtacataaatgcccataagtgcaaaatattatagattataatactaaaattatataaaaatatacatgtatatatgcatacacatatgtatatgtatgagtgtgtgtgtgtgcatatatgtgacttcctaggaaaagttttatattccatttctcagtaatcaggtcactgattcattcttcagtggtttgaatcatctcaatatgttttctagttatttgatttattaattctgtaatttatagaactttataggatttgaatggaccacttctgagcacgagaattaacgttgtgggtccccaaagggatacaaacagattttaagaatttgacatatgctctaatacatccaagaggagactaaaagtcatgacttggccaaggtaaaagataggtccaataattgtttctttaattttgtgtagaatttgaaaaattagaaagatgaagtcacgctgagatcctaagaaaatgaaagatcctaagttatgagaaagactcccagttgaacttgagatgttacctatatgataaattactaccttacccaaatatatacataactaatataaatatgtctaaaaatatttgcagtgaaaaccactggctccctaccactcacactacgataaaaaccaccattttataagttctgtttatgctcacaaatttttttcatgcttctttcttacatatgaagggatagtcgatgatcacctgatagctcaagaatatctttattacaaaacaaaggcacaaaatgaaaaaatagtgaaaacaaactggaagaaatgaaatccatacaagaagagaaaatgtaaacattattgaatttaatgtgttcatagaaaaacatttcctctctaagcttatgcagccatgaagtcaagacaaggtacagaaagccatagtttgtagtttgttacaaagaataattagaggaccaaaagcagcattcagatatttaaaataaaataccaataagcacacaaataatgtaagtttggggcaataaaacaaaaattctcatgaagttgaattcatatacccatatttagttaagagaagagagacaaattctggatccaaaaagcaagtgaaaattagacaaagggtgggaaaagaaccctgtggtggttcccacctcctttccctcttcttcagcctgtagatactgtagagtttatttatctacaagttataatactctagtgtgtcagctatgatctcctcagttcccagaattcaaaattattagctttgggtgacaacttagagatacctacaccctcaaattttggaaactgaatgattgatacgggagctaaaaattaggcagttagtgagggtaagagagtcatcggtaaggtttcccttttaataaaatgcagcccccaaatcctttcttttctaacaaagggcagcctgaaaaatcaagctgcagacatagaaaagcaagctagaagctggcacaggtgaatgccaacagctgtgccaatagaaaagggatacctggaagtcagatatgttcaacatggaggctccttctttctttttctttgctgccacatgtgcagtaaagaagcaggcaacaagccaggtgtgatagctcacgcctgtaataacagcactttgggaggccgaggcaggtggatcacctgaggtcagcagttcgagaccagcctgaacaatatggagaaaacccgtttctactgaaaacacaaaattagtcaggcagggtgacacagcctgtagtcccagctactcaggaggctgaggcaggagaatcgcttgaacccaggaggctgaggttgcgatgatcacagattgtgccattgcactctggcctgggcaacaagagggcaactctgtctcaaaaaaaaaaaaaaaagccgacatggccactggccaaggaaagaacccatcagcataataaaagataagggtgggatgaccagcttcttcttgcattatgtaaatgacgtaatgggtccaaccaatcttttggaccctatgttaatcagacaccacctcctcaagcttgtctataaaaccccatgtatttcaccagggaaccagaagacccacttgggagcctctctctctctctgcaggagagagagcttttctctttttctcacctattaaacctccactcttaacgtcactccttgtgggtccacatctttgattttcttcgtgtgaggcaagaaacctcaggtattaccctagatgaatgatgccgcttcatgaagagtgccctaaacagcgtgacagccaaaactccaaatggtccccacttcaaatatgtcagctaggtttggtgaagtgaaagaaggggcagtttggtcaagtgtttgctgacttattctggtggctaaatatttacactgtcaactgtagaagctgccaaactatatttgaattaggagctgaggtatttaggagaaattactaagatggagtagggtgattttagtcaaattaattaacttatgtcattccaagtttcctgaagcaaaatgcatttaaacattaccatcacagcactttaataaggcttagcattttaatgaggtaacatatgtgagaacttctagaataaagtctgaaacataataaaagcccgcaatcacaatgtctcctctcttttctagttttcctgatcctagtatatactaacttatcaaagtccttcaagcacatgcccagaacaaaactagatgcaattttccaactgaaatcacatccttggtccaaaatagatacaatatttattatatgtaatatatataatttttaatacattctaagactttcaatggctcctgtactatttgtttgtaatgatcatgtaactgttaagtcttttccaactgggctgaatgcagaccaggtacttctctccagctgtggttgtctcacttaagagaatcacaacatggctctcattaagacactcaaatattttcagattaaaaaatgatcataagtacagagaattgaataccagaaataaagagatgtagatgggctttctataatccaaaaaaaaataacttgttggatgcacttgtaaaaactgaatgacagtttaaatttttggttgacttcccttctctcgatgtgtgttggactctctgatgacttaatagaatttatatgtgcagagatagagtagcaaggcaaaacagtaaaaataggatgacatatcagtataacaaccctgtcatatagttaatatcaagaaaagtatctgattttatattcaatatacttcctggcacatgaatgacatgtcatgaatatagaaaataatcgtttgtttgatatatcttaaattgaaaagttgtgtggcaaaacttgaacattaaactttttcagaaaagttatatttttcagccagctcaattttaatttttttaaaagtttataagcatgtttttttattaccctttcacatcttctgtaagatgcagtgtacccatgcatccaccaaacactacctgatcaaaaacagtaaatttcttcgttttcatttgctagtagcctttcaattaggagttgcttctctaaaagaaaataattacttggtcatttataccatctatcttctccatgaaaatgtttcagagtatgtaatggaattgtaattatacatcagtcatctttaattatttataatttttagccttaaaagcttgccattttaaaagtgacttaatacaagatttatgttatatttaaggactcattagaaaagtcctttctctgtttcctaaaactcagataatcaacatttctatttttttctgtttttatgcttacaacacatctaggtgctaagctactccttgaaaaaaaaaactgcaaaacttgggaagctgaagaaaattaaaaaatatatataagagaacaaagagatgacaagctaatttacttcccaataacaaagaatgtgagagttacactgaacaaattaaaaacattaaaatttcactatgatctttctattcacctatattaaaggatacatttatttatataaattaatcatgtaagtttgaagtcttcaaggactcagatacaaagagaatcaggaatttggcaaattgacatcttcctatagaaatcatagagaaaactttttctaaattactttaaaaaatattctgtggtgtctatgattcgcttcctattttatgttttgcagtatttttattaatgtgtaaaaactgaagataaaaaagagaaatgtagggctattttatttcttaacgatagaaagagagaattcagaaataagggaacaggggaaaatgttaccagagtcttgggaaagatgaaggaatggataaaatatcactttttaataacagaaggacaggacagaaatggctggtggagccaggcctgagtctcctgccttgtgtttctgtgctcggatgtgaggttaccttaaaggggcttcagttcaccaatctgtttattggcgagagtcttaaagaaaccatccaagccacaaagtacgcaaattacctttcttagctataaggaagcaaaatgcttataaaactttcctaagtgtttttccatttacagtattcacatttcttctcatttctcaagtacaagagaagatgaatgttaacccaatgggaactcacaagacctatggaatctctctcttactcccccacccctccccataaaactgctaagtcttggtgcttccttagatccaatcctacaaatcatgtaggattttaaatgggtactcagtagaggctcttcacctctcctcactgaaaagatttaaactaaatttaattatctgcgccctgcctagaatattcatcaactagatctttgtattatgtctggcttctcaaacttcagatccattaacaaatagtaactttgttttccctgattattatatcaaacataacacgcaccagtcatcctctatcccaggacattgctttatgttttttggtacgcttaagactttcttaacttttatttctttattatctatttggcccgatgttgatgtcttttcctactggaacagtggactaagatcaggaactttgtctctaaagtttactgtgtacctggattcccaggaacagtgcttgaaaaatagtatacactcagacactattttcaaatggtattggatgaatggaggaaattagaagtaaagtcatttcactttttggaagaagttaggtgttacgatcctgagagctgtaaagtccaactgtgtttagatcctgactcaatatttaccctctgggtaggcttcagttttctaaaatccaaacagaaggaaaagaaatgtcactgtggtataggattatggtgaattcaagttaagtagttgtcattgcacatagcacaaaacacctcaacaaatattttactattaaccacacacaaaaaataattttatgaataagttaatatatgaagtatattctagattgtcagtaaaatcaaaagcaaaataattgagattattatttcattcactaaagacattagaaatcacacattgtaaattaattatataaaaggcaaagcatatctaaaaaaaatcaatcaatctgtattgcccttgaatttcagaaaacaaaagaataatgcaaaacaaagctgggaatccagccaaccatctaaatacagcatttatcatttacttgtgaaattacactgtaaaggctcagtaaagaaagcgagattatgcatattcatacgatgcttcagtggagatgataaatgaaacatagccacaaaatcattcattgaatatgacatgattacatttctttccatgctcacccaacaaccaagattacaatgtaaaatttctatatatttttaggagaataaaagatctaaatttctgaatgaaggcaaaatcagcatatacattttatgcattgtcaaatattatatgattacaatgtgcattctgtttttttaagaagaccagaacaaaacacaaactccttacaagaagataagaggttatcctgattcactaaaggtttcaagaatttcgctttgacattgtttaataataaaaaataagtatctcttcttatatttttagtgagtttaaagtttagtgagttttatttattttctctcttagtctttaagcatgttttgtttacctttttaagcagcttttaaacagtagaatagcattattttaataaatcatcaaacttcttttgttcaaaaaacatgttagtatactctatcaaagccatgaggctttgatgatacattatagtaataactcatcaaaagacaacagtttgatcatgctgtacattaagtacatcaccaaaactcatctttccaatagcaaaataaaacagcacctagcacaaactcctttttggttagatgacttttctttaacactagaaattcatgttcatatgtacacacatacacacacacaaacatctgttcctaactagggatggatttatgcatagtactgaaaaggaattcaacttaataggaaaacaaattcaggtggatggatttgacaagaataaggaaaccaagaggaaaatgaaaggtcacttaaatatatgattgtatatggttttacaaataataaaaataatttatgacaactgtagaaagatgcaaaagtatagacaatcacaaaggagaagataagtcatccatatcaccactagacataaacaccaaaacattatgatatatcactcaagtcttttcctctcccaaagtattttctatgaattattctagaatatatatgatatgtatatatgatagatatatatgtgtgcatatatatgatatatgtgtacatatatatttgtgatatatatttatgatatattatgatagatataggtatagatattttatgcagagtctcactctgtcacccaggctgcagtgcagtggcacaatctcatctcactgcaacctccgcctcctgggttctagtgattctcctgcttccgcctcctgagtagctgggattacaggagtgcgcctccatgctcgagtaatttttgtattcttggtagagacagggtttcaccgacatgttggccaggctggtctcaagctccttgcttgagatcggcctgctcagcctcccaaagtgctgggattacactaccagctgattgctatatatgagcttcattcttttatatacttgtataacgttttaagaatttgattttcaattaaattttttaacttttctatatgaattatattattctgttattgttgaatttctgtaatggactatagacatttcattctatttttttattctactataagttatattcaatttttttttattattacacttaagttctgggatacatgtgcagcaggtgcagttttgttacataggtatacacgtgctgtggtgttttgctgcacccgtcaacacgccatctacgttcggtatttctcctaatgctgtccctcccctagtcctccaccccccaataggccccagtgtgtgatgttttcctctctgtgcccatgtgttctcattgttcagcttccacttacgaatgagaacatgcggtgtttggttttctgttcctgtgttagtttgctgagaatgatttctagcttcatccatgtccttgcaaaggaagtgaactcatcctttttcatggctgcatagtattccatgatgtatatgtgccacatttttctttatccagtctatcattgatgaagaaaacgtatctctttatttctctaatcattcattttaatatctaaatgattcttataggccctcaactttatgtaaaatatagttattagctattacttgttgattgtttatcatgcaccagaatgctgctattttgtgagtaggtcacttgattttccctagaaatttattaaatatatattacttttgtttctacttatcatcagagaaagtaacttgtcaaaatattaaataaggaaactgaggttcaaatttcattcttcaaactcctcactacaggttcttaaccactatatcctaatgctataaatcatacttcttgccaggcgtggtggacctgcctgtaatcccagctcctctagaggctgagatttgaggattgctcaagcccaggagctcaaggccagcctgagcaccacagggagatccatctcttttaaaaaacatatttcttcgagtctacaatttcattgttcaccttaaaaatatgtcacgcacatggactaagttcacacattgcccccccacctccactgaacactcaatgagacacactgtgaatttttctctgacttcccaaacatacttgatcattcctttttcatgcttccacatcacttgttacctaagtctgtgagaatttggcacgatgttttataactagtggctgtcctgcctgctgtctaatgatacgtttagtcctgtgtactcctctgcattctaagtgcctgccatgataatttatcataatagtttatgggtgagtcttacgaaatgaacaaataaatggttgaatatattgtataagaaacactgcaactacacatccaagaacggtcttgaataggcctgtattataaaataactatgttttgtaagtacttaatccatttaattaaaggacattcagattgaacccaatttatatcgctaattatttgttgtagatagcataggaatgccattatttctatgcttggggagattctttttggtgttgaggttgttgaaaatgtgttagaatgtggagaagtaaagtgaaacagagtatcgaaacattcagatcgctgagctgtcagggtctcgttggagacggtcctaggaaaggctgtcaatatcagtaggagtaaagaagaagaatcaagtgcctaattccaaaaccaaaaagtcttgattttcatttcacacaccattaactgcaggcagtggctcccctgagggtagaaaaagtaaagtaccttgacacaggtggaggtattgtagggctctggatggggaacagaagctttctgtcttctacgaaatctcactagggaagaccatttccaattaacactacaggctttgctgtatcgaccagaatgtttataattataacatgtagatgtatataaccagcatatatggtgttcataattataatatctataatttagagaacacataacccaaaatcgttttcactgaaattactacatattaaggtagaaggtcttattcaaaaattaacttgtataaaaatgtaaacaaagaacggttaaagaattgctcattattcacctcaacttcagataatatcccattcaaaaagcgctccaaatctgatgcacactataatcatgggtaataaaccagactggctgtgtttaagttcaccacataaatgataagctactgaaaacaataattctattatgttactatataaattttactttgttgaaattattatcccatagtcatgagatcaatgagatctcaaattttcagtttacaacaagaaaaaagaatgcaattaacatacagccaataaataaactgtatcatatttttgcctgccacaacaaataatattttatatccatgttattaacatatatatatatatatatataactaataatagcctgattggcaaataaaaagtactgctacttaaaatgttttcaaattaattagtaattctgcaatttagaaagtagtcagtagtaaactatgaatagaataatttcatatgcaattgaagattataaatgttcttacatatgtaaagcttccacatttttgttgatcatcactgccttttccttatgatatacagttttataaaatcttggttagttgtgacataggaacccaaatgctcttcctttaaattgttatgtcatataaagcactttttagtaaaccttttatagtttattatagtcttctgacataaaccatgcatatttttgcatggtttatttttaatacaaattttaacaaataattatgtttgttatttaaaagtagaaaattataatggatgaaaagcagtaccccttgtagtcttagcacagagtgataaataccactttgttttttactgaattgttaaatttaaaatataattaaatcaagaatttttcacaatgtcaggaacattgatttcgaaatgagcacgtattttcaaagtgtaattgaagttcccaaaattctcactttcatttactgtttgattgtagattgtcatttataactttggtttttaaaattttaaaataccatattcgatttcattttttcgtatttatttatttatttattatactttaagttctgagatacatgtacagaacgtgcaggtttgttcatatttaatctcttaattattaaagcaataaatacttatttggaaaaataaagaaaaccttaagaagcaaattgaaatttctgattgctatttgatattcaaaactttgactaaaaaataattctaagtttttaatagcaacgtctccatttctatattccaaaggacaaagagaataacgcagcaaaaattactgaatgaaaattgagatactaaaagtaacaaatgcaaacctatagatataacacatgtaaaggtaaacatttgaatgggaaatacaatatttaaatccgtctgtatagtgttttctctattgagtcactatggtttgcttttaacgcatgtctgaatatgttcaatcagccttttgctaaacgtccaagggggaagaaataatcttttataggcattgcctcatggtagataattctgacttccctaatctacctaggtgtatttatatattttgacttcccttatctacctgggtacattcctacaaaacagaaaaatgccaagtgatatcttggaatatcaacttatttctaaatatgtcaacaatcaaatgagcagcatttgttcattaaagactgatagacacgtgcatacattatgcatacatacatgtatgtatacatacattatacattccttacaacctccctcagtaaatcattcagagacttaattctttgttaaaaactttttttttctttttacaaactgaaagtttgtatattttaattttggcattgttctttatttattttccaaaaatatttatcttctatacattaagacaagggttggttatagataaaatcacaaggaagcaatcttatcttgaatcttgttcaaccacatctttgatttacttttttccctcctattcaaaaagtcttcaaagcctttttctcacagcccatgcattaatgtgaaacacagggacgggtatccattgttgaggctctgctagctgggaagagctatgccaggtgtcttagcacatctcagtgagcctcaaaacaactttttaagcttcaatttacaaactaaaataaataaataaataaataaagctcaaagcatcttagcagccaaagtcacacagataattagtaaatactgaaacttatatttgaaccctgctctctgagactccagatctgtgcttataataatcactctatcacagtgatcttttagttattttcaaggtgttaatgttttattatgaaatattttagacagacaagaagcataaatataatatggcatatatcgctgcttttatctatcaccttaaaaaacaaatcctcactttcttcctgcaaagggatccactattttgaatctgctgcttcttgttccaatgcaactatagacctctgtttggttctcaaataatgagtttttattttccatggtttaaactttatgcaatatacatgtacgctacatagtatgcatttgtctacaacttttccacctcaaacatgctgattatggtaactctagctcattcatttccacagttgctaaatattctacagctggataatgccacagtttaactattcctctatacattacaattatgtagtttgtcttattttctattacaaaaaattctgctaggaattttatttttacttctgtttttaacaactttactggggtttaaccgatataccaaaagactgaacatgtttaatggatacaatttgatgactttggacatatgcattactcatgatattcgaggtaataaatatatcatcaggtctaaagtttacttgtgtccccccctttttttgttttttggtatggtaagaatgcctatcatgacatctattcttttaatgaatttctaactgcacaatatcatgttgttcactataggtgctacattgtacaacagatctctagattctgttgtttatctcacataactgaaactttacacgcatcaacaactccccatttgctcctcatccaggcccttggcagccagcattctattatctgctttcatgagaatgaccagttgagataactcatatgaatagaatcatacaatatttgtctttctgagactggcttatttttacataacggactgtccttctggttcatccacattgtcacaaatggcagagatctcttttaaggctaaactatattctattgtatgtattatatgctgccttttaatccagtcatctttggatagacacgtgggctgctttcatacactggatattatgaacaatgcagcaatgaatatagcagtgcagacagctcttcaaaattttgatttcagttttttaaatacatatactcagaagtgggatttccagattatatggtatttcttcttatttgataatttcaacatttattttagattcaaggggtaaaatgtgcaggtttgttgcgtggttatattgtgtgatgctgaggtttggggtaggaatgttcccaccacccagatagtgaacatagcacccaatagatagtttttcaaccctttgcccccacctcccctccccagtagttcccactggactatatagtatttttatctttaatttttttgaggacttttcatactgtttcccatagtagctgcataattttaaattcccaccaatagtgtacaagcgttcaaacttcgccacatcctcattaaacgtgtcatcttttgtttgaaactagtcatcccatacagctgtgaggtgatatctcattgtggttttgactcgtatttccctgatgatcagtgatactgagcaccttttcatatacctaatgcccacgtgtatgccctctttggagaaatgtctatttaactcttttgcccatttgtagtcatgttattcttttttttttttttttggctgttaaattgtaggagtttcttacatagtttgaatattaacccatcatcagataagtggtttgcaaatactttctcccattacataggctcctttttactctgctacttctttgctttgctatgcagaagctttttagtttgaggtagtccgatttctctgtttttgctttgttgcctgtgctttttgtatcatatccaggaaatcattgtcaaacccagtatcataaagcttttcccttatgtttcctcctgagttttatgattttagatcttatctttaagtctttaatccactttgatttttctaaatcgtgtaaggtagtagcccaatttcattctttcgtatgtagatacctagtattctcaaaaccgtttgttgaagagactgtcatttccccattgcatattcttgataccctgttgataagtaataagtgatttttctctagctgcttgcaaaattctctgtgcccttgacttttgacaatttgattataatatgtgtcttcttttggtgtcaatatctttagattcatctgatttgggatagtttgagcttaacgaatctaggtgtccatttctctccccagatttgagatgttttcagccattatttctttaaatgagctttctgcccttttccctcttcttattctggaactttcataatgtgcttatttgttgtcctaatgatgtcccagagggcccgtgggctttctccactcttccccttttttttctttttgttcctctaacttgataattccaaattacttgtcttcaggtttggagattatttcttctccttgatcaggtctcctgctgaatatctatatttttcagctcagttattgtatgtactcttcagctccagagtttctgtttctttaagataattatttagaattttttgtcagtcagttcataggtctccatttccttaaggtctgttaccagagatttactgtgggttttttttttttgttttttgttttttgttttttttgtagtgtcatgtttccctgattctttgttttacttcagatttcagtagctatttgtgcatttgaagtatatccactttgtccagcctttacaggccttgctttggtagggaaagacctcctcaattaaccctgctagtgtatctggaagtttccaaaatcttttatatgtatttgcacactttacccttctccctacctgctggggagaaatctcaagattgtgcatcttctcctaatccctcagatccatgccaggtgccgaaagccacaggctcctttttccttgggcagctcaataaaatgttgggacattgagtataagttacacttctttccctcctgcctaaacaagaagttttagaattatgtaccttctcccaatcctactgaactaagccagcttctgaggtctacacatccagctgagagctccatgtgctggctgctaagatccatgccatctgctaagatctgtgccatcagcttgagagctgcatatgctatggatatatgccccatcagataagatccactctgtcaattgagattcaagtcagctgctgagagccacaatggctgttaacatctgcaccagctgctgagagccacttaccccttttctttgttcttagcttcccccaggcattctaactatgctagattcccttagcactctgagtgtgataagacaaaagcaggtcttttgagcggtgccccaaaagcctgcggatgttagatgcccactgattccctttccctgatgggagaaatcacaggttgagggaatctccctcagtactagggtgtgctggcttgagggagtgggtgattagaaactgctcttcttatcattttaatgtgattattcttggttttgtgcgatcccggagcattgtaacctcttatctggattcctgagttctcataaagctattttggtccatatgtggcaccaaatcagtctatttgtttttatgagaagataaagaaatatggaccttgacacacacacacacaaaaacatatattccacttgtttcctcaattgtattgggtttggcagtaaccttctaactcagaacgaaggtagccacttcagcctaaagacacagaaaatgatgttcatccagttgaaaaagcaagaagtgtacatgaatgtttaccaaattcctcagtcactcataagtttcagaatggcatcagacgtcagttcaattggaaataattctacatctgtttttcatatactagtaactcaaagagtcagtcataagcacctcctccagaatgctaaatgtataggtgagtttctgaattattttctaaaatatacattctagtaattaaaaaaccccaaagtaatcgtatgatgctgctgaagctacagaacattatggaatgttattgtcttcatattcattcagtcgtttaactaaatatgttatacaaagtgattataatgtttatagataccagatattgcactttttatatttagaatcatttattgaaatctcgtgttatttgatgattcaacaaatgtcttgcacataatcaattacaatctcagctcccatatcatgtctattattggttttatagagtagatgtcacaatttagcacttgttttaaatttatatctgaaattttctgcactcaagacatccagcattctacaagaaaattcaatttgaataatagtagcttgcaaatgcatttttttctgcatcactaaaaggtaaataacatcatttgacttcaattaaataatgtgacactaaaatccttgtaagcaaaaatataacaatggaaatacattagcatggaaatttataggcaaaccataaattaggctttagaatgtactgcaatgagtgtcagctgctgcaattttattccttaaaatgcaaaacaaactttacttgctaaattcatgacagaaaggaattacgaaaaattacttttctttactatatccaattccagtgtactttcaattagataagagtttgattcacacgaggatccagaaaatacataatgcctgaaaaacagatacatttatagccacagggcattgttatatgagaatgaagtaattagatctctaaattactccattgtttaattcaattcaattaaatatatcctctaaatatctctggtattttcagcaattttccttatcattataagaaacagaaagtcaagaaaaagttataattctgggcaggcccaatcttatttttttagagactttaggtggggttgggagagaggtctatcccttcctcagaatctgtgcttctattttagaatcctgtacagttctgaggcagataccttacagtacaagagtcatttatcctgacaggcactgtccttcttctcatcatcatgaccctgaggaccgggatgagcttgaatgagtccaagttctacatggggttctgagatcttccttgaggtcaccagttgttctgcttgcttaaatcactctttttttttttttcttgagatagagtctcactgttgcccaggctggagtgcagtggcgtgatctcggctcactgcaacctccgcctcctgggttcaagcgattctcctgcctcaacctctagagtggctagaatcacaggtgcacaccaccacactcagctaatatttttttttttttttttgacagaggttcgctcttgtcacccagactggagtacagtagtgcgatgttggctcactgcaacctccgcctcccgggttcaagtgattctcctgcctcagcctcccaagtagttgaaattgcaggtgttcaccacaagtcctggctaatttttgtatttttagtagagatggggtttcatcatgttagccaggctggtctcgaactcctgacctgaagtgatccgcctgcctcttcctctcaaagtgctgggattacaggcatgagccaccacacccacccttaaatgactcttgtaaccatttcccctctggaatatcgctggccttttggcttctctgctggaagctgaggacatgtcacttgtgctttgaaatccccatctccaatgtcaccatctcccttcatgtcaagctgggaaaactttctagtttcagtgaaatccttctgcctttgtgtttatggttaagatattttatctatgtctcaatcttctcatgtctctagagtttaaaaagacttgcaagagccttctgcattctaccttgtttcaaaactcactcaaaacaagcacaagtctgaccatttactcatatgaaatggcaggattgggaagtgggaggggagggggagaatacacagattttaaaacatgataatgcctcaaaatataccacccaaaacacctaacttgcacggttgtagtaatacttagaatttctgcatgtaaaatttgttgcatattctagagtttttctgtaatgatagttactatttttattatcatataggaccctataaaattactcccatgatttagatttctgatattcctgcaacaattatgtgaacaaattatatataacagatggaagatattgaatggagtcccaaggactagccagagacagagctcaaagttaagcccctgatactttgaaaattcaaagaacatttaaattctaaaaactacaaatcaaatttagacctaaacaatgagcatggtttctgacacatatatccaataagcaatcttcctacatttctactgacattttcttaacatcttcagttctcaggtttaaccccaaaagacatgttgataatttggcaaagatagcatacatgtggtgcctaacattttcaaggatacagtttatttgagagtggctaccgtgaggctgattcgagggctactactataagagaacaaagaggcaatatgaattagatcaaggtagtaatagtgaggaaagaaagaattggatgaattctattttacatagatgccttcatgattaatcggctcaggtcctacactaggtaacagaaatttaaaaactagaatacaacctctagtttccagaatcagtggctaagtagatagtgaaggcatttcctaagataggaagaactggaacttcagaaggtcgcagagaatttttttctagtttgattaatgatatgcttaccagttatttccatttacatgtttcaatgacatttcaagttcaccatatctttaatcactgtctatacattatcaatatgccaataattcccaaataaatatatcaagcctagacttttcttgagatttcactttgttcttagtcttgatacaggctctggaattgttagcatatagacaataataaaatttatatcagtggataaaattgtctaaggagagtgtagagtaaataggtagagaaaaaagaaatttaaaaaaatcctggaaaacagtaattataagatgtcagcaatatgtcgctgtagagctgacaagcattgactgctttcctttttccagaactgggctaagaatattttatacgttatttcatgtaacccctatagcagggatatctgtaataatgccatgcggacacagaatatattctaatacttaataagaaatgatgtgtgaaatcagcaggaaacttcaaacaatcacctctgtattattctctgtattattttctttagatttgagtagaggcacaaaggaagaaaaactggttaaatatttgctctctttttagaagttttttatgtgttctggaagtcagaaatttttacaagtataaaaaatcctgggggtcaggccaagtgacattcaagttgataacagcgcttttcaggttttaaatgtcagtacttttaagccagtcctaatctttcttgaatcaaataaatgaataataaatgtctgcaagatttttccatgcatacccttattgaaatcatgcattcatttaacagtactatgcatttataaagctggctattgatcagagggggtattgtgatcattcttctttctctgcattctatcaaaggtgcttaagatgttttggtaattcctttacatgtctgtcttacccatcaggctatgggctcattgatggttggcgcatattttacttatcttctatatcaagaagttagaaatgaacataaaatatattataaacttatattaaaatatattataaacttaataagttacgctttgaacatttcacatttataaaactacatttttaataatttgtgaagggctaaaacacaaagattgtcagtagatactttctttgaggccatggttaacggcagaaaaaacatgggtctgggaggtaaatacaagtttgaatgctcactatatattagcttcctcatttttcacttttatccttttcatcttaatcaccctagtccatttctataaccacttgctcacaaaggacctcagcttccttgcctatccctctgtccttggtacttaactggtaagactctagctctagataaaccaaatagctctctcctccatgccttaatccatgaaacatgctagagggaaatcacccaaccaggctccctagtttgaactctgaattaataatcaaaaacctcaaaggtacgctcaagatttgcaggaactttactatttttatctagcaaacttgagatgccattcactaatattatttcacaacatcttctctctcttcaaactgagaaaaatcatcagatgctaaatacattttcttcacatcattaaatttgtaatgagccagcacatgaaaaccttacaaatggtcttcagcgggacatgctgtaagaataataattcaacttaaaaaatgtcagtttatccatctacattcacttaaaaatttcaggcctgctaatacctgcagatcttctaggtaaatcttactacatacatcagtagggtgcaggaatttaagttagcttatgttttcattgcaagtcttggaatcatggccctgatcttctagctagtgtggtctaccaactctgtgttctatcttccacccacattatgcttcaagtacttcaactggattatttcatctatgtattaaaagaaagtttattgagtgtcatctatgtgcaaagcaccattatagaagctggtgtaacagcagcgaaaatacaaagttcccatactcatgaagacgatattcttgtaggaagagttagaaaaaacaaacacacatataaatgggtaatagagtgataagtgttatgaagaggaataaagcaacgtgggaaataacaaggtccatgcaattaatatttcattttataagattggtagagaagactttttaaataaaataatatttaagcagagtctcaaaagtttttcaccatgtgcatgtgagaaaaacacatgaggaggggacagcaagcacaatggtcctgaattggtgcaggagagaaacaaaaagccagtacgactaggtacagagtgatcaaaaagaagattgttgaggctgagtgcagtggttcacacctgtaataccagcactttgagaggccaaagcagccacatggcttgagcccaggagttctaaaccagcccatctctcaataaaaaaatttttaaaacattatccaggaatggtggcacatctgtaaagtcccagctactccagaggctgaggtgggaggatcacctgagaccagggagtttgaggctgcagtgagctgtgatcgcaccactgcactccagcctgggcgacagagtgagtccctgtctcaacaaagaagaagaaggacaataaggagaaggagaataaggagaaggagaagaagagaaagaggaagaggaggaggaggaagaggaggaggaggatggtggggaagaagaagaagagaaagaggaagaggaggaggaggaagaggaggaggaggatggtggggaagaggaagaggaagaagaaggaggaggaggagaaggagaagaaaaagaagttgaataaggaagaggaggaggaggcaaaggagaaaaagaagaaagagaaggagaagaagaaagggtagggagaagaagagtgcaaagttgtgagtttaaaggactttgtgtccattgtaaggattttcttactatttttttccagaggagcaaaataatctggtgtgtttttaaaacactagtgattaccagatagaaaaccaaagcaataattcaagcaccagattatagtggcttggctgggattggtaaaagtgaggtcataaaataggttagatcctgaacatgctttggtccttcatctcctgggaccctaaccctcatataactgggcaggttgactttccttctaccttctgacactcctcatctcctcaactcttccactctgtactctggaatttcaattccatcaatagcaaaatctgttgtggcctcaaattcttttgtgaaagcttcctttgctttcttgtccaaaaaagtccaaatcttccctaaaacattgctcctgctgcaggcacaggtagtggctgttttctctcccatgcccctcacaacaccaaggttagaagacatggttcacatcctcactgttcctcatattctcttccagatgattcttgctctcaaatcccacaaacacccacttttgtttattgtgtcatcagaccctactacacactattcctccttacaacactcatctatcacttcttagaacactcatttcattctctttggctcctgaccaaagtctctttcctcaacactacctctgtcacatgttttactgatttctatactaatgtacatgatccttttaatccttcttcctaggccctaccatggcaaagacaaagaaatggcaactaaaacccattctgtccttccatgaataaaatttcaagctaaatgaagaccgcatgtcacagaatctttctccaattttttattaaggtatagtcatattactagttctcactaacaaaatgtgatcaaagctgatctgtgccactttaggatcaaggcttttaaaagttagttggcctcctctatgccctcttcactctcctgcctataggatgtaagaaaaataagggtttgaaaaaatttaaaaggtaggtggagtctgggttcctgaatcatttattggcagaaaattggccaccaactagaaacgcagtttggtaacagagacgtgaggtatttttttggttgtgtttacagccacagcctagcatatctaactaataagacatctctcatccgacaactcgcctaggaccccacctcatccaccatttccatggttacacccaagacctgacattgccaatagctgcacactttctgtgagcaatatttcaaatattcctttttgatgccagttgcattgttttagctccttcccgttagtggttacttaccaaattttcaaaacactattccattgatgctcacattattttatggttcctcatatccataataccctgatttctgatttctcttcttacataggttaaatataatagaaaaggatatacaggcatatcttggaaatattgtgggtacagttccagaccaccacaattcagcaaagatcacaataaagtgagtcacacaaattttctggtttcccaatgcttacagtatgcgtacaacatactgtaagtgtgcaatagtattatttctaaaaaaaaaaaaaaaaagtaccttaattttaaaatactttgttgctaaaaaatacaaacaatgacataagacttcactgagtaataatctttttgctagtggatgctcttgcctcagtgttgatggctactgactgatcaggatgatgtttgctgaaggttggggtggttgtgtcaatctttaaaaatgagacaacaatgaagtttgccacatctattgactctttctttcaaggaaaatctctcaggccaggtgtggtggctcacgcctgtaagcccagcactttgggaggtcgaggcgggtggatcacgaggtcaggagttcgagaccagcgtggccaatatggtgaaaccctgtctgtactaaaaatgtaaacgttagtcaggtgtggtggcatgcgcctgtagtcccagctacttgggaggctgaggcttaagaattgcttgagcccaggaggtggaggttgccataagctgagatcaggccactgcactccagcctgggggacagagtgagactctgtcaaaaaaaaaaaaaaaagaaagaaagaaagaaacagagaaagaaacaaagaaagaaagaaagagaaagaaaaacttctctgtagcatttaacactgttggatagcatttacccacagtacttctgtcaagactgaagtcagtcctctcaacccttgccattgctttatcaactacatttattgaatatttgtttgttgtcatctcaacaatgtctacagcatcttcatcgtgagtagattccctctcaagaaaccactttctttgttcatctataggaagcaactcctcatccattcaagttttgtcatgaggttacagcaactcagtcgcatcatcaggctgcacttctaattctagttctcttgctatttccatcacatctgcagttatttcctccgctgaagtcttgaacctcacaaagtcatccactgagggttggaatcaacttcttccaaactcctattaatgttgatattttaatctcctcccatgaatcaccaatgttcttaatggtttctagaatggtaaattcttttcaaaagcctttcaatttactctgaccaaatccatcagaatcaccatatatatggcagctatatccttacaaagtgtatttcaaaaataaaaagacttgaaagttgaaattactctttcatccatgagctacataatagatattgtgttgtcacttacataacagcacacatttccttgtacatctccatctgagctcttgggttaccaggtgcattgttaatgagcagtaatattttgaaaggaagttttttttttccatagtggtcataaaatagtcagtataccatgccgtaaacagatgtgctgacatctaggctttgttgctccatttattgagcacaggcagaatatctgatttagcttaattcctaagggcgatacgattttcagaatcataaataagcattggcttcagcttataatcaccagctgcactagcccctaacaagagagtcaggctgtcctttgaagtttggaagacataggcttccaaagtttgagaagtttggagaagcataggcttctcctctgtagcaatgaaagtcctagattgcatcttcttccaagagaagactgttttgtctacattgaaattctgttggtgactgtagccactttcatcaatgatcttagctagatcttctggataacttgctgcagcttcttcatcagcacttactccttaaccttgcacctttatgttatagacatgtcttctttccttaaagcttatgaaccaacctcagctagcttccaacttttttactgcagcttcctcacctctctcagccttcatagaatttaagagttagggccttgctctggattaggcttgggcttaagaaaatgaagtgactgttttgatctatccagaccactgaaactttctcaatatcagcaataaggctactttgctttattatcattcctgtgttcactggaatagcacttctaattttcttcaagaactttttctttgcattcacagcttggctaaccaactcatacaagagttgtagcttagccttcaacatgcctttctcactaagcttaatcatttctaactcttgatttaaagtgaggtatgtgtgactttttctttcacttgaacccttagagcctatattgtatggttattcattggcctaattttattattggtgtgtgtcagggaatagggaggcctaaagtgagggagagagctgaggaaatggccagttggtggagcagtcagaactcacacatttactaagtttgctgtcttatatgggtacagttcatggttccccaaaacaattacaacagtagcattaaaattgctgatcacaggccaacatacagataaaataataatgaaaaagtttgaaatattgtgagaattaccaaaatgtgacaaagagacacaaagtgaccacacgctggcggaaaaaaaaatggtgctgatagaattgctcaacacagggttgcaataaaccttcaatgtgtaaaaaacgcaggccaggcgtggtggctcatacctgtaatcccagctctttgggaggctgaggcgggcggatcacttgaggtcaggaatagctgagatcagcctggccaacacggcaaaatcacatgtctactaaaaatacaaaaattagctgggcatggtgttgcaagcctgtaattccagctacctgggaggctgaggcatgagaatcacttgaacccgggaggcggaggatgcagtgagccgacattgtgccactgcacaacagcctgggtgacagagcgaggccctctctcaaaaaacgagcaaagaaacaaacaaataaacaaaaaacttcaagatctgtgaagcactatagagtgaagtacaatgaaaccaggtctgcctgtactccaaatcccttgtccctgtcacttgatcagttacttgcttaaaccacaaccctgattaaatttggtcccctccaatattgtatctctgtactgatagagctgaatggggatgggaaaaaagcagagaaccatgataactggtttctcctaaattccctgacactaacttcagttaaacccataatggtgacacaaagtttttctatatttcttaaatcatctgttctctcactgccttttaccttcaaacgtacaccaccaaaaactcattctctgtatgagctggtgttgtgttttgtgtcactgaaaatactgagaccaccccaaaaatcctccataagatcactaccacttagagtttcagcatctgtgcacacatactttgccttcttttttctacctatggataaatttcatcttgtactagccaaggtcaagatgtctgcactagaattcattcctctcccgcttacactcaggaatattcttctagcaattctcccttttttcatgtctgaaatttttgtctctagtaactcactctccacaataaatactacttctcttatcttagaatgttacatttaccccattcctccttcacttactatgtaaatttttatagcaaaatgtgtacaaagcatttcatgtgcacaaagaaaaatgtatacaaagttttatttgttgtctctcattgtcttcccccagtgtgctattcaccccaatcacagttttgcctcccactgcagctgtgcccatcaacaaaaccccttgacatcactaaatctagtggtcattctttgccatctgcttgcttgacacaacagcatgatagagtaattgtgattcttggaaccattttctcctctaggctctcaggactctattcatcgtggtcttgtccaacttctctttcttgtctctcagtgttctttcctggttcctcttccttcccctcacttccatttggtgtgtcccagtgtttagtctttagactcttttatttcttgtctatactcttgggtgactacctcaatcaatttcatggctttgaaaaacatacacaatctttcacttattacaatttatatattctctgaactctaggctcatctattcagctatttgctctcttaatttgcatgtctcacagccatcttaagctttacatgttcaagattaattcctaatattatcttccaccaaaaatccactgttgctgagcatggtgacacatgcctgtagtttcagctacttgggaggacgaggcaggaaaattgtttgagcccaggagtttagggctgcagtaagacttttacaaacagagtgactctgtttctgaaaaacaaatcaaataaaatcatagtgttcttcttataatcttaactgtctcaataaaaggcaaatgagtttttccaaatgtgaaagccaactactttggagagtcccttaactacttttatttacactacagctgtaaacctccagcaaatcttgccagctctacttttgacatatacccagaatccaactgcttctcacttcttactgctactactgctgggccctggcccccctcaccttctatacagattcttgttgtacctttgggttggtcttctctagatgctgcctttgaccattaacaagcttccaggattaacttttttaaatctttggcagaatgttaccttttttgcttaaaatcctatagggatttttatctcacttagtgcagaagtcagttttttgttttgttttgttttgctacaagacactatttgacctccaaattttgccattaactctttgaactcctctcctattgctcatgttctgatcctgagctctttatttcagccacacaatttctggaaggcctaggcaaatccctgcttcagagcccttgcagcaggagttacattttcctgccatctttactcaaatgtgagtgaggcttttattggctatccttgtctccttttcttgtatattcattataggcagaataaaagatggccatatcctaatcccccaaacctgtgaatatgttaggttacacggcaaagggaaattaaagttgtaaatagaattaaggttgctagttagtcgactttacaacaaggacatcatcctggattatccccgtgggctccacagagttccaagagtacttcgaagtagaagagcaaggcagaagagaagagccagagtgaaacgtgactacggaagaaacacacagagacaggcagctttgctagtgttgaagatgcaggaagaaagccatgagccaacatgaatgtggatggtccatagaagcaagaaaaggccaaaaaaagaacttacccctagagcaacctgatgggaatgcagccctgccaatatcctgattttagcccagtgtgacccattacacactgggtctatatgaccttacacaaccaaaaggtagtaagtttctgtggttttaaactcttaaatgtgtggcaatttgttacagcggcaataaaaagctaacacctacctaaagtttaaccaacttcttcaacattcctttcgcctctccgctgttttatttttgccatagcattaatttcttactaatgtacattatggtttgttcatttttcttattaatgctgtgtctcattggaatgcaagttccgtgaaggctgtaagaacagatatttttgccttttttgctgatcgctgtatccccatcacccacaagtgtgcctagagcatgataaatatttattaaaattgttgaatgaatacattgaatatatatatatatatatatatagatatatatagatatatatatatatatgcgtgtgtgtgtgtgtgtgtgtgtgctgattggttatatttaatttagattctctccattgctttatcttgtgcttgttaaggacctttcttatttacttactgagttattcagtaattacaacttctgccctccagtaaatcatcttgcagacctgagttctcactttcttaactccagtttacttgatccttctccctataattccatacaacatttgaagcaaaaaatgccctaaaagcactttttaaaacacctgctcactcagaaagtatatcaggaacagaggcatttagtgattgttgatatgcacttgttaaacattgctgagtggtcagcactgtgaacataatggattaccttgtaaaatcttttatgatatatttaatcttaatttgtttttgatgaataacaacaaaacatattaatcttataattagcaataaatgaaaaacataagtttatatattaattttgtaaagtaatgactatatatgttgcagagacaagaaggtcatacatatacagatgcctttatatgtttttaccctagaaaacttaaaaagatttatccattttcctacctagattttattttgcttttgatcacttttcttaccttaatttatatttcaatatggtatttcatcttcaatattatacttttaaaagtactagcttctaaggaaaataaaatcgaatttactcttgaaatcacttttcatatgtataatgtgatatctactttactcatattatgttagatagtacgcaatagtttggagtggctgattgccctgttcatactattccaagcaatatctaaagacaaacgcactgaacaaactgagttaaactttatctgctgaaatttgcagcttatttagtggcttatgagaagaaacacacacacagattgaatagaaaaggatttttccccattaaaacatccttatgtattctgattgtgattacatggaggtcatttttcaaaatgccaaatggtttcttatcagaataagaatgacacaagctgtggtctgacttacgtgacattgaatctcaaaatgagtcagtaaagtaaattaaaaagtgagagttttgcagcaagttagcactccctcctgaatcctgccttgtagagtgtcatgatatattgaactatcaagagcatattatacaaaacacacacacagttagtatttgctccagaattacgttattgtaaaatcaatgagttgacatcatgtatgaaattttccatgcaaggcttcagggaaaattttttgtggtcaaactcagcattagtccatcccattgggtaattacagcattcaaaactcatgccgattattacggccatttatgttcataataacatctgtcaatcttccagctatatttatcttatgaaggtaatagtgctgtctcacgtagaaatgaagaatatgttaattaaagcaaattgaaattcttatttcccgtaatttgaatgactacccaaagaaatggaaaataagtgattaaaataaaaacagatatctaagatcttaaaataaagtttgctctaatttttagatcattttaattagttctcaaatagagtccaaacaaaatagcataccacttcctttactatggttttgcaaatacagttgtgataattggtcaacattgtttggcaaaggacaatttcatctgaaagtttatgagtttggcttgtattagttctgtaaagattggctttaattccaaaaatcacctataagccattgaccaaatgctttctgttttgttttgcaatatgagtaataatactcatcataggggttttaaaaagcatccttagaaaccagttaccttcatccaaagttgtatttaaatctacaggtgaagaaacctaaagtaggatggtaaacttcatccacgacccaaactggcaaataaagataacccaaaatattttttgtcagccagcacaatgttttgtagtagttgttatgcctgtttctgttttttccatgatgtgaggatgaaatgaacagagtctgaaaacatctctgtttagaagcttcattccactttggataataattccctctaataacttttttttttaactttctgccttccttaccaattggctattcaatatcatatggtacagtttacttcagagccagaacttttcctcaaattgttattataatttttacaactaaaatgcaaaacatctatttgtgttattattaatccagatttaatgtattcatttattaaagaatactaaacaacctgagcacataaataaaatacactttttaaaggagagtgaaaaacaatcctttcatcatgatttttatcttctgtattcaatggtttgacctggcagtttgtctgtttgtttgtttattcttcaaccaatttaaaaaagaaaaactatcctgagaaggacatctatatgctatgagctaattatcgctggtgcttttctaatcagatgacgtagccaagtcaagtaaatgttcttgaatttgttaatctatagaactagattgtaatactatatgtttcacaggatttttgttaaaattaagtggaataatttgagaaatgttatacccaacatctggcaaacagtaggctgagtaggttcagggagcaggtcagttttgttaatctatcgattaccttcatgcttaggacaatgcctgggacactgcaggaactcaattataattgttcattggatcagtgaatatatgaataaaacctactttctatttttgacatctaatcagggtttattagtgcaaagacacagaattggggatggagataagtcaatgaaaatgaaagaagagtcattatatagaaatatcaagaacagtaaacatccaggtagttaaagtaatatttgtttggaggacatacataatttaaagagaaattctgtctttaaacattaggtttatgtattactaaaaatagtaattatctatctttaaaaaatgttgactgcctaaccttctagaacatagagggagaactgcaattttgttttcatttttagtttgtatgtgttaacaaaatactactgctaaaatgtccttctccactgactttaactgatatccagtaaatgtgtaataccagcaattggagtcaaacctagatttaaaagtgacatatgattagaaaaagggaagtagagatacacattaaatataataatctgtcacctaatacatagaaaaaataaaaaatacttttcatggtaagaaaaggaccacttctcagacaatgctccttcccttatacttaaaaacatcagcagtgatagacgatcttaagaggctgtctgtattcactttctagtcatcctgaaggccttttgtatgtttcttaaaatagttaatgaagaatagccttgaaaaatattttagcaatatccacggtcataagttcagaaatcaattgtatctaatgaaaaaaacctgacaagctcgcttaatattcaatatatgagcttgttttcccactggctcacatttaaggcatgtaaaatgtgcttttcagggaatgatatatttgtggagtaaagatgatacactttgcaaatattcttcgagacagatcattcaaatgtatgtcctgtttagaactttgctgcaacctgagtgtgtggatgctgttaaggactgaatatctgtgtccccctaaaatcatatgttgaaatcttaaccctcattgtaatgatattaggaggtggggcctttggaagatgattaggtcatgaaggcagagcctcataagtggaattaacaaccttataaaagaaaccccagagagctctcttgcctctttgcttgcatgctgagtacacagcaagaagacggcctctatgaaacagaaagtggacccctaccagacaatgaatctgctgacaccttgctcttggacttcccagcctccagaactgtgagaaataaatacttgttgcttaacccagccaacttatggtatttctgttacagcagccaaactgactgagacagatgctgagctagtcattccaatttttgatcacacaaaaaacctaaagcacatttccacgcctgttaaaatagttccagaagttatgatgatcatttccaagaaaaactagtccagactatttaagtctatatggtatttctaaagagagcatgttaaacattaatcatttttttgaagttactttcttctttttcagaattgagctggtctttatttaaatcatttatctatttattaccactaaaactaaattgacttaccttttgagaaacagaagcagggcccagagagatttctttccttgttttgctttcactaccaattttcttttgctactaaagtgtgctgttcaccttcaagagcagagggagtaagttttatggactcttgcactcctttatatatggcggcaacctgagtaaatacagtaaagatgcaactagaaacctcgcactttggaagatgactttagtttacagaatctgactatctatagctcttaaaactcttggcagtaaaaatttatagcatcaggaacaattttctgtaccccagcactgagtcctgcttcaggaagaacattcttccatctgtatgaaaaattgttgctaagagaaaatatttttataccgatacatgtcttgtgtttttgctccttatctgatattctagattttctcttaaaagacattttcctttctgttacttgggatttatctagatctcagttaaatcacttatagctaaaggcacttttagagatttataaggttaaggattttcgatgatgtagatattgtattcagtttctaaaagttactgtccctataagtcaagtatattaagtcaaacttttaaaacaacctggtatttatattaaataatacatcagaataaattctgaagattttgaaatagactatatatttacattctgtattttgtagttgaatgtatcttgtttggttctggagcaaagtgagacataatcttccctacattaagcataaatggcattctaaattcagagcaaacttatacatgtactagtagcagtcaaggaaatattcccaaccatattacacaaaaatttgtataagcttcaagattaattatggatttctgatatacaaagcatgatgtatttttgagtaagaacacagatggaagttccattttagctcagttttacatttttcaaatttactttctctctgatagctaacttaacttttcaacaaacaagcactgatcgtaaacatgaaaatagctgggaaaattgattacactgatctctgtggaactaacaaagactctctctttgaccaaactccagccaggctcctctgggcctcctgttccactaggctttaactttggcccataaagacttcaacaaacactaacatcatttctaacacctccaggccacatccttaagatgaccctaggccgccttatagcacttgtttgagaaaattcaaggctgccaaaaatttttctatttgtttcatccaacacctgaggacagagcttctgtctcccagtctctctgggatgataaatatctcctataatctccagctagcaagcacagctggcctgaccacagtcacactaactaaccctttgtattttttcacatccttgactctaccaaactcatgctcacctcctttcctgtttactcccttgttctctctttagaatttcctgtacctctgtacaaatcaaagttgagttcagtccacaatggaccctttttttctattgcaataattattactgattgaaatgagtccttaccattttcactagtgtctggctttatcattggcaaaataatttctttatgtaggatccagcacaatgggagaaatgagacaaatagctacccacaaagataatgtttttcaatactgattgtatctagatgccatgaaacaattggcgtcacttatgggttcaccctttccaaccctggcaatccattttacattgccctggctctgtctgattattgacagggagcttttcaaactcctgagcctctgtttgtgtttcagatggagtttaagttaattcagccttcctaactttccacaaaaaatatcatagccttatgtttacacaaacctacacacagagacatgtatgtacacacacatacactttcatgaaatactttacgaattaagatgaccagcactcctagccttcctatgggcaaagtccagaagaaatctctcatattgcatataacagcaacaatattaatggataatgcatatttttcaggagaggacagaaaatctgtgaatcattaagaaagcaatgttacgtccaggcgcggtggctcacgcctgtaatcccagcactttgagaggccgaggcgggcagatcacgaggtcaggagatcgggaccatcctggctgacacggtgaaaccccatctgtactgaaaacacacaaaaaattagccgggtgtagtggcgcctgtagttccagctactcgggaggctgacgcaggagaatggcgtgaacccgggaggcggagcttgcagtgagcagagatcacgccactgcactacagcctgggtgacagagcgagactctgtgtcaaaaaaaaaaaaaaaaaaagaaaagaaacaaaaaaacaaaaaaaaaacagctatgttagaaacattgtggtttggcaccacaatacattgattaagaataacagatgttgtcaagaagtttatttttacccttatatttataagattaattcaatgccaattgaaattactagtgggatttacttttcaatttaaaaaaaatgatgtcacagtttatttacaacactggttcttgaacaggaactatttacccccaggagacactgaacgacgtctagagacatttttagttgtcacaaccatggttattcctaatggtatcaggctggtagaggccagagatcctactaaacattctctactaaatagtgcctacaagaaagaattatctggtccaaaatgttaacagttgccaaggttgaggaatcttgattagaatatgaaggtcattaaaatgacaacacattttttaacaaagagtaaaaacatgatgctcaaatctaaaaatattatattgttctaataattgagtggtattgatgtaagaattgacagaaaattcattgaatagtattgataaaactgaaactaatacgttgtaaactaatgtaatctggtccaatgtttctagtttgactgcaagcaccagaaaccttttaaaaaacaatgcatctagggcatgatcaaacgaaaataacaaagatgtaaataataacttgtgaacagcaatactaatagtattaacataataaaagcagaggatgtccctaaataaccatacaaaattcaaggggagcatagtcttaaaagtttaaaaataaatgaaatgcaccttgcatctatttatacctccttattttcagtaattcctgatcctctcactttcttgtcctcatggcaaacagtaagtataatgaaggaccaggtgccatgtctgcccaggctcttccccagagagtgctatctttacttaatcacttaccctctgtacatcctcccatctccctgtctacctctaatccattaatgttggaccatttgctaactcttcatgtattaagaccttccacaaaaagctttttattttatttatttatttatctgtatttgacagataataactgtgtgtatttataaggtaaaacattatattttgattcatgtatacattgtagaaagtttcaactgttgggaaaagtggagtgtttggagaagctgaggcagggcttgcgtgtcgacataatataaaagagtcttggaacatgtccggggtccagggtctaaaatcccttgtggcctctggaacaccaagctctgcgctaaacagttggaaggctaccctgacacaccataatctaagcccagggcataaaatcccttgcggcttggatagaatccagggctcgtagttctggaatgtgtctagacttgctggctccccgctctttgctctcccaggattgactgtgtcttgagttaaaagaacctgctctccattatctcaagtagcagagcaaatgctaaaccatcacagctgtaaatcatgtgcttaatgctatgtgcccttttgacctccacattctcaccacctgtttctctgttggattaccaatagattgggctcccagagctcgcggactttgcagctttcatgattgtgatggccccctggtcccacctttctctctcaaaccgtcttttatcaatcttttgactccaccgaacttcatcgcccccacgacctggtgttgggtctgatcaccccaacattcagccaagcaaattaacatatctattacctcatcctcttaccattattttttgtagtgagaatgttaaaaatttatttttccggcaattttgaaatacgcaatacattattaactgtggtcaccatgcagtgcaatagattattgcactaaaaattattcatccagtctaaatgaacattcgtatcctctgatcaatatctcccttgtccctatcccttctcctcccccgcacttcccaacttctggtaatcaccttcctactctctgtttcaaggagattgacatatttagattccacatataagtagattatatagtggttgtccttttgtcttactccacttagcataatgttctccagtttcatctgtgttatcacaaatgagagaatttccttttttaaggctgtataatatttcattgtttaaaatggaatgccacatttttaaaatttatttatctgttgatggacacttaagttgcttccataccttaactattgttaataattctgaaataaacatgtgagtacaggtatctgttccacataccaatttcaagtcttttggatatataccctgtagtgggattgctgaatcatatagtaattctatttttagttttttggggaaactccaaactattttccaaaacggctgtactaatttacattcccaatgacaatgtacaagggattccttttctcccttgttaacacatgttaccattattttttttattacagccattctaacaggagtgagatggtatttccatggttttagtttgcatttctctgatgactacagatgttgagcatttttcatattcctgttggccatttgtatctcttctcttcaatatgtatgggccaagcccagtggctcacacctgtaatcccagcactttgggaggccaaggcgggtggattgcttgagctcagaggttcaagactaacctgagcaacatggcaaaaccccaactctaccaaaaaataaatacaaaaaattagccaggcatgaatggtggcatgcacctgtggccccagctactcaggagactgaggtgagaggatggatcacttgagcccaggaggcagaggttgcagtgaaccaagatcacagcactgcactccagcttgggcaacagagtgagatcccatctaaaaaaaaaaaaaaaaagaaagaaaaaaaagaaaagaacaaagaataaagagaaaatgtcttttcagattttgcctattttttaatagtttgtagacatgactagagacactttcttggcaaaggcagtactagaattggacctaaagtggttagaaattttagagacagttttttgggaaagggtgtaccatgtagaagattcatgtttgccatataaaatgggtttgttaaatgaccagtggtggaatttggggaggaaggagttgtacttgtgatgtatagtaaaaaaaatttcaaatggttaattaaaacaaggtcactttgaacgatctagcatatgttgatattttctttcttcatttgaagccttgcttaggaatttggatgttgaaaccatttaagatgtgagtaagcttgacctgatagaacacaccaaatagttacttgttacacagaaatttcataatgtcaataggtgaatctgtcagaaaaagaaatgaaagaatctttaagttgcttttagattgatttattgccacgtttaaaccagttttaccagagagaattgtttttgcctcatcagtgtgactgaatcagtgggctggaaaataaaatttctgagctccatttttactatgtgccagcaaggaatttgaacaagaaactttgtctaactccttttatacatacaaaaaattaaattgtaaaatgtctagctttctgtagtgattaatgtttcactaactgaccaaatctactggttaaaacatagagctgtaattcattgaaaacttcataaagattacatgtcattttataactgcagtttaagtttcatttattttgctttattttaggcattatagaaacatggcaaatggagtaccatttcaatatgttttagtttaccaaggaatgcatcatgcattttgtcattgaagccttgtagaatacctgtaaactcagcagccatctcttctaaatgtctttaataaactcactctgctactctctggaaggtgaaaagtctgatccaaactctaaattctgattctcctacaaacctcttaagtgaattgatgactgtgttttcacttgaatgatatattaaaatgagaagcttcaccagaaggtaattcccttaatttcccgtgatctacctgaattccacacatcctctgccccattctcctctgaatcccatctgcccctgacttctcctcttagccttcatcattaatgtatttgtccatgaatggctgtttctcactactattcatacatattctttcacattaaaacatatttaaaaatacacttttctccaacctaccaccccatgacactcaaacttgcctaaaacattgtcctgactcacacctttgttttaccccactcatttctggaggtcaaactacaaagtgatgaacaaaaccaagcacagtggcggtacaggtccaagcactaagatctcagtatgtggacacacactgaatgctggaagactaccatgttgtttttcacatcttcaatcacagaacgcagagtgagctacctgaacaggcttcagaattttaacctcatctctcctccctttatgccatgagataataccccttattgcaaatcatcacccttcaggaatacagaaatgtacatataagtatttaaagaaatgatagaagaagaaaatggataagtgggtaagtagaaagacaggctctgaatccacagttcttgcacattatttctccaatgacaccttcactcccattttttaaaaaactgctcagaataacagtaatatcttactgtaaaaagcagctgtataaataaattacaataattatattccataactgtaatcttattattacagaaagtattgtaaataaactatacatacagccataatattacagagcaaacactgtgttattgaaatgttagatataatgcgcttctcaatacaaactaaaatgtatttcaatactgtagcacttattaagaattatggaagctcagtagatgaaatactgttttaatataccatttaaaatgttaatagtatttcattttaaaccatggaatcattacttatgagcataataatcagaattatctccagaaatgtattttagacaagttttaatgatgtgttttaaaaaatttactgaatatagaacaactttgttctcagcactttcaataatttactagtgatgtaatttttcaagtttgtttactcataataaattcaagtacatacgcaagaaatgcatttatacgaaaatcacatgatacaagaaaaagaagaacgtgacaaatgtttgaaattgtgattctaacctaatacaaaacatcacaaaccctttgcactttacaaaaacacagatcatagttttatgagctatgcaaccataaaaatgtcagtaatattagaaagttttttcccgtgtactgcatatgttttaatagttaatttttttacacaatctatatctctgagtttttatttgtggacacatagcttccaaacaatggggattgcattccatcaaattagaacatttagtttattttcaatatgtttgatgaatctacatgtgtggaaatatttttatcaatttaattgaggtataatttatgtccagcaaattgagttctcttaattggcaattcagttaattttaacacttgatgcactggggaaggcactgctataatcaagctacagaacattttctttgcccgcaaagcctcctcccacttctttgcaggacctctgtgcctccatcaccctgatccaatatagtaagttttgtatctggttcagtgattttgagacagacgaatgttgttttctgattcagtattacatttcatcttattgattagtattattctattgttaaaatctacaaaatatttttatccattcttttgatggacatttgggctgctaccaaattttggctattacaaataaagcttccatgaatattcttgtagaaatccatctttagacataaactttcatttaatgcatttatattaatagaagtgcagttcttacctcaaaaagtatgtgtataattgactgtgtaagaaattgctaaagcacttccagagttttagtaatcttttatacaatcaccagcaatcattgagagttctatttgtaacttttcacacatttactgttgtcaatgtttctaattttagtcctagtgggtgttaaatgacatgtaactatgactttaatttacattttctgataactcacatgcttttttttttggccatttgtgtatcttcctttgtgaaaatgctaactcaaagtctaaaataatcgctcattttatattgacttgtatgatagtttgggccttccaaaaagcaaatgctaaaatgagattagacatgcaagagatttattggggaaacaactgtgaaaaaaaaatagagccaaagaaagcagggcgatctttagaccacaatgctggtctgacacctttgaagaaaaggaaaggggaaggaaagtgaactgggtaggaagaatgtcagaccactgcagcgccatatggaaaagactcagaagagttgatggggaatcctgaaaccaaagtaatccactaaggagtcccccatctcatgggaacaggcctgcattagcacagctggtgtgctccatcacgggtagacacagcagtgaccagcattgcctcagggaaaatgtgagacagcaacaggggcctgcagtcagttgcaccttctcagcaagagattacagcccccacttcccactccaccccacaaaccttctttctgcaggttctagcaatactcctgtgtggtgcaagtgcctctccctccctctctgagggaaaatgtagaagaggaaagttggtggaactaactgctgacctgtttgaaaatttatgctcagggccacactgctactccttctatttctcctccattatccattttaaagtcttatcctcgctctcaccttggcaggtcttactggcttatctggtgtgacccaaaccattttctctgcagtatctgagccctggaaatcacactcttatcaggccagtattgctatatgtatttagtacccagagccacctagtacatcacctgggttcagcacatctacagacccctgcgctcactgattggaagcagtgttacgtcttcttgtctaccagagtcaattgcctctgatttatggtgactcctcttctcacctgctggtttctctgatttatagtgactcctcttctcatctgctggttcctggtcacaaaaagtccaaagagccctggcagttgccataacttgtggcccagtggaattctttatttgactctggcaagagtgtgccacactgggaaccacgaccttcagttcaatggaaatcggagttgtgggaatgcataacacaaaccatctcagtcttagagactgattgtatatcacttttcattccttggtgtccttttttattgaggacaatgaaccatataaatctttaatttaaagcatgtaatgcacccggaaggataacacccattctttcagagtgttgtctctaaactggcattttaactgtgcttttagaaggctgtgtcagagctctgtggggccagctgcttcaggataatgcattatgtattacaaccattgcatttcatgatcatggactacttgaagtcttaggccgtgcagtaaagaagagaaagcaataataggcataaaaattaaaaagaaagatgtaaaagtgtctgtatagaatgaatatgctatcttcttagtagaatacgttaaataatctgttaaagaaaccaattgaaactattaagttagtttagcagagcaacagggcataacagcaatatacaaaaatcgattgtaattctatatagtgataataaacaaatggcaatttaaattaaaattacaacataatcacatgaaaaaacatgaaatacttaaaatatgcaacaaaatatgtgcaatgatatcagccagcacagtattgacataaggctatacatatagaacaacggaacaggatggaagcagtgatatgcaaaaaattaacttgaaagggatcataggcctgttcagaaaacctaaaactataaatcttccataagaaaacacaggagaagagaattgtcctcagcttaggcaaagatttattaggcaaaaaaagcattaagttaaaaagttaaaaagcattaatcataaaagaaaaaaattataaattacactcattcaaaatttaaagctcctgcttttgaaagattctaaacatgaaaaagcaaaagatatatcagagaaaatatatgtaattatctgttaaaaagctctaatccagaataaagacttctttctaactcattaacatgacaaataatttaagaaagaactggagacagaaaaaagcagagataaccaagaaagatatataaatggcaaaaaaaaaaaaaaaatcacacaaaaccctgatcaacgtcattagttgaaatacaagttgaaacctcagtgagataccactacacatgctacagaatgattaaaattaaaaagactggtcaaggcaaacattgataaggatgacttctggtgggaatgcaaaatggcacagtcactttggaaactattttgttaattccttggatagttaaacatatacttgtcaaatgatttaccaataccacttttagacatttacccaagaaaaatgaacacacatatgctccctaatgcatgtgaatgttcacagaactagaaagtcatgtgggcataccacaactggtctatcacacatgaataagcaaaaaaaaatgacacatccatacaatgtaatactgcttagcaatgaaaaggaagggaatattgatacgcacaatatcaataactttttgtgaaagaagcctgacacaagagacattgcattgtataattccacttatataaaattctagaaaaagtaaaactatagtgaagaaagttcatcaattattgcaagagatgggagtaggacattgactaatgggatgtgcagaaactgaggggtgatggtaatttcccacatctttgattctgaggatatttaactgacgatatatatgtcacaaatcatctaaacatatacataaaatcggtgaatatttctatgtatgtcaaaccacatgaatggtgatttaaaacaaaagcacattatcaacattgtcataatgaacctccagagggcttcagtttagttagaactaatgaaagcatacaaaataccttccaaaattactgcctaaggacaggtgaccagagcacttgtccagcagctttcagcccttgtgtggtttgttacttaatcttgtccatcatagctacataggttcttgggacaaggccctggagcagaaagaagaaagacatctgctgtccagggaggctagattcttgtcttcatgcttgtcctaattaaaaaatattattttctttcttcctgttcagaaagttggcccttacctagatgaagtcagagtcttggtttatagccaaaataaaagaggcttaaaaatcaggagttttgccacaatgagatatcatctcacaccagttagaatggcgattagtaaagtcaggaaacaatagatgctgacgaggctgtgaagaaataggaacgcttttaccctgttgatgggaatgtaaattagctcaaccactgtggaagaccgtatggcaattcctcaaggatctagaaccagaagtaccactttacccagcaatcccattactgggcatatacccaaaggaatataaatcattctactataaagacacatgcacacatatgtttattgcagcaatatttacaatagcaaagacatggaaccaacccaaatgcccatcaatgatagactggataaagaaaatatggtacatatacaccattcaatactatgcaaccataaaagggaatgagataatgtcctctgctgggatatgcacgaaacaggaaaccatcatcctcacaaactaagggaggaacagaaaactaaatacctcatgttctcactcataagtgggagcttaacaatgagaaaacatggacacagagagaggaacaacacacaccagggtctgttgaggggtatggggcgaggggagggaactcagaggatgagtcaataggtgcagcaaaccaccatggcacacatatacctatgtaactaacctgcatgttcctcacatgtatcccgttttctgttgttcttgttacttttttttttagaagaaataaaaaaaagaatcagaaatcttggttgtaacatcaaatttgccactaactggctatatgtgttgcaagaagtcagtttaatttctgtgtcaaatttttctcatttgtaaatacaggggttgagtagttgttttcaacattttttaaaaaactaatattggtgtgttgctcatccaaccgaatttactcaacaataatttatttgaccaacactattggcgtgtgtgtgtgtgtgtgtgtgtttgtgtgtgtatatatatacacacacatatatatatacacatacatacatatatattcacatatatacacacatctgcaaatatatgctaatgagaactacagatacgtgacaattttcatatttcagtgatagaactacagaaaaaagcaaataaactaatcatttagtctatacagttttatcatggctaaatattcattttccattagcgattttgaaatatttaaaaaccagctactgagctctttccattagtaattattgcctttcagtaacatctttccacttatagaaacaaatatatatgtaattcctaaagacccttcctcacatttctgattatctgcttctatgtctcttgattgctctccaaagatagataaaaacaaagtaaactatggctcttataaaatgtaccatttgtaatacaacagtattagtaaattcatgtaaagaggaaaaccatgaaccaattcaattgcacttaatacaaaatatcaactatatttccagtttagacaccctctgaagaatagatgagaactgttttgacttggatcgtttgctgttacctataggcttttgagcatagcattattttccctccactgtgacaaatttcacaagagaaatggaatgtggatgggatattgtgtcatcttccatgcgtttgttaagtatagatttcccatattctgcaacacctttgtgttttcaatttctttattttcataaataaaaaaatgctgcagcttataataataaatacagacaactaaaaacttgagaacaaatcaggattatgcagtaagctacaaaaccattaactgggattttggagtgtgtgaatgattttttaaaaaactaaaacgtaaagccagattgtagtaggtaacttccattacgaccctcagtgatccccacccacttcctagtattcccctctttgtcacacctcctccctttgagtgtgggctagacctagtgacttgcgtctaaggagcaggattcagcgtaaatgattggatggcacttctgaggttagacttttgcttctctcttagatgatctctcttcttctcttaattgcttgcttggagggaagccagttaccatattttcacctgccctacggagggaagccagttaccatattttcacctgccctatggaaaggccacacagcaggaaatgaactcagagagatctccagctaataaccagcaaaatcctggtgtttgacagtaagcatgtgagtgagcctggaaattggtcctctgaggcctgacaatgaccaggtgaataaccttcaaagcagatccttcttctcccaggtgagccttgaaaggactgtggccctggccaccaccttgatttcggccttgtgagagacactgaaccacaaacacacaactaagccacacacagatccctgacccaaagaaatcatgaaacaataactgtttattattttaagttgctaagttcagggattatttgttccacagaaataggcaatgaatacaccttgcttctcacagcaaaaaaaaatcactcacacaagatacatagttcctgatgatagcatcagatactgaagtctatttctgtattaaagagactgaagcttcagcatttttattcagccatttggggccaagcaaagagaaaatggcatttaaggcagattactttttctgtaagtcttagctcatttgctttaactgagagtttggccaatctcaaccattttagaccaatcttaattattatagtattctgtcaataatacttcggttcacttattgtaaatctgaagaaagaagctattttttgaagattcgtgtagtttctcataattagataaattaaacagtcacctggaaaataacttgagaatttctgccttttagctttcttttcctaatagataaggataaataataatattccttgcaatattttggtgatcagatattctattttatatagaatgatttagacaagtactggaagtacattgcaagcttctgaccttttacaagtactccctgatcacctaactagtgtgtatctcttgcaaagtgtttgtgttgatttgagaattagcaaagcttaaatgacctgcccagctcttaccatcacacttttctgatttttagcagctatgctttctaacaatcaatgttcacactcattcccatttgcggctctatcatcatacctgaccctaggaaagctagtggcaggacacacacacacatacacacacataaaggaacatacaatcttgtgcattgcctacaatctctacattgaatcattctcctatcttgtcccttctgaccttgggcactaatttctaattcttcatttcctactttgtgtccacattacttctccaaactcttctcaattatcaagaggtagcataaacatcacatgttttatttggccttttaaaaatctcccaccctcacacataaaaagaattactaaattctcagtacccagacatgtttttaaactttattgtagtatttataacatcttgtcttattttatagatatttacacatctgtgtgcgtgtatatgtgtgtgtgtatgtgcgcgtgcacatgcgtcctgcattaacctatgaaccccttgaggacaggaacaatttctgaatcactttgtttgtatttgtataggtcaattgtggagagttccttccgatcactcttttctgttctatttctccctttactatgacattgcatatccttccatttacgtttgttctttttgatttttttctaaacaactttgtgattttgtgtaagaattgtataaaatggccttcttttagaaaaatacatcagcttgtattttcagtgctcataatttgggatccatctgatccacaatttttttgtgccatctgtgattcttcagcaaccaaagtgcctgcgtgtgtgggttaaccacagataattctttgtcttttcctatcaactgccacaaactgcctaattactgggcctgatcctgttactattgtcacaaggctgtcttcagcaatgttgtctttatctgcttagtaactccctatgaccagctgaatgtcctttctgctatgcactgattacgatttctggcttcccatgggcactgaaccagcacaaattctaaaaattaccttacagacctgtgtagactgtgtatgtctcctcatactcttctggggttatctttcagagcatcaatatgttctgcaaaaataaggggttaagtaaatatatacatttttattaagaataatcaatgtgacacaaaaacatgtcttagccattcttaaaattggcacattatacatgccaagtgccttccaattcagcaatggggttatgaaaattaaatcatgaatcttatattttacatcaatttctttctcagtagggaatattgcaattgacattaaagcaaaataggaaagagtacacggggcatgggaagcacaaaggaacaatttattaacaagcacgttacattttgctgttctctaatgtaaaattgaaacatcatttacaaaaagaaatatgatgtgagggattttacatgctagaataaagtagtagggaacaaagattatgaaatcatatacacacacatacatgtatatacatatatgtatatgtgtatagctatatagatgataaataggcagatagatacaaaataataaatagatattaaagtaggagacagacacatctgtccctggcctccagagaggattgaaaatgaatagattaagtttcataaatctgaagtcaaggaaacgtgcctgatgatttgttcttgaacaatgttcctgcagaagaaacttctccatctaacatgttcatccctctagggcaggaggcaactgcatgaaatggcatggatggagggcagagatggcagacggagtgtggtgagagaaaactcagactccaagctccaattcctgacagccagaagcatctaatgaaggctctgtttgccttgtttgggaccttctcgtccattacgtttctattataagatgacataagcttagtttttgttttgttttgtttttgtttttgttttttgagacagagtcttgctatgtcacccaggctggagtgccgtggcgcgatctcggctcactgcaacctccacctcccaggttcaagcaattctcctgccttagcctcctgagtagctgggattacaggagcccccaccacgcccagctaatttttttgtatttttagtagagacggggtttcatcattttagtcaggctggtctcgaacccctgacctggcgatccacccgcctcggcctcccaaagtgctaggattataggcgtgagccaccatgcctggccgacataagcttagtttctgaataagagcaaggtctggcctggggatgctcaacagtaacactctgtaaaactctctggcaatggccatgcaatgatgaaaacaactcattgtatccctttgctgaaatcaaagaaaccccagaattcccttcaatatttgaatggctcaagccatgccagtagaacaacggggattctactccacaaagcaatcttgtagtagtattaatagtgaacattatgagtgctcctttttagtattatagccacgtctctattacaatacaacactttattgaaattatttgtgtatctcaggtaagagactgaaaattctcaggtatagaccacttctaacttattttcctattgttgaaacctagtctcttccatacatacagtagggactcagtatttctgttaaatgaatgaataaaggctagctatggaagacaggcatacctctccctgtagataaatatatactcatatgtttgcagaccttgcccatattgatgtttctacaattgataagatttttatatttgtagtgtgtctttttctctcaaaaagttgtttttagatgggtggtagcttagagccagtataattaatatagatataaataaatgagggaaagagatcatatgactaatgaatatatctatttttagattttgtaaatatgaaagtatttacacaaatttttgtacatttgtttactggaaaatgacagcacattctataccatcaaatcccacaaaatgcagaattagaaagatttacaattcatctactgctaaagttagatatagtatgaacctgatcaatttgaagaaattgtttcaggccaaaaaaagtaccaatagatgactaaataaagaaaaattataggcacaaagagtctcaaatttatagacatacataaatacttttaaagtttcaggaacaatattgtaaatgatctaagaattttccactgagtcctttattcaatgtttaagatatattgtgtataaattattcaaatatgtacttttataatttgttatatattttaccttatggcatttccttattagtgtgaacaaataaatagtattttctgcttcccttcctactaaatttctttgttcaataaatactttcttattccaacaatttgttcctagaatatttattattaatgtgtttcattataatgccataaagctgatataaaacttttaatttttcatatacacatataagtctaacaatatttataaaaatatgtatgtatatgcaccagaattatacattatgcaactcatgtataaattattcctaaacaataaacatggagagcgtattagaagaaaaacttaaaatttatgaaagtctctaaaggacaaagtaaaatgcaaattaaatgcagagttaatgtattttgaaagtaataaaaagtatagcaagacagaatattaagaaaaattttccatttagtttttactgtgtcaacaaaaaacaaatttttcatgcttaattacttttcaggcattctaattcactggatttttttaaattatgggaaataaatagtattaattacagagtaataacatgtttttacagtctttttatgcacagtgtgtttcaaaatcctaattccttttctcttgtagaatttaactatattcctacctagagacactgttgtctacacacgacaatgcgatgaactcccggattcttactgattaatagctttttattttgttccagaaataacaacaaaagtaacctggaaaaaaaaataaagagaaatgttttcctcctccaatctggatagctcattctttcttatccccctctggaaattttactcttctctatttttgccaaaaattcagctgacattcagcttgattttttttattttagggagcccttcttctacatgtatacatcatgtaattggactttcatttagcattttcctttcttctttgtaatatgatttctatatctttttattcttggactgcaaagtccaaaatgtcaggctgaactcttttccctgtccttccacatttactacactgtgctccaaagagttcatgcaatacagatctgctgcattcttattgctattttatttttccatcagcattgatgtggaaaacataaattgtgcaaatgattttaagtaccatgaaagaaaattaaagcaaagctcttgcttgagaagtttacatttttcttgggtgacaaagatacaagaaagagtagacaatatcggtgcaatgttcatttaaaataaaaacagtattatgatgttaattacaggttaattgaattgaccagcatatcaaactctatacatgctatggttaaatctataaaatacacatatgcattttaaatgtttgtgatataaaattgaagacatgaggccgggcgcggtggctcacgcctgtaatcccagcactttgggaggccgaggcaggcggatcacgaggtcaggagatcgagaccatcctggctaacatggtgaaaccctgtctgtactaaaaatacaaaaattagccaggcgtggtggcgggcacctgtagtcccaggtactcgggaggctgaggcagaagaatggcgtgaacccaggaggtggagtttgcagcgagccaagatcgctccactgcactccggcctgggtgaaagagtgagactccgtctcaaaaaaaaaaaaaaaaaaaaaaaaaattgaagacatgaggcactatattagctgttgactttttctttactgttaaaatgcatgtatattttaaagtgtatttacagttcattaaatcagtgtgcagcgggttcaaagaatccagggaagccagtctccatagagcattatctttggacttaacaatttggaaatccaagattcacttgcaaaaactataaaaactacattatttttccctgacatttctgggtcctcacaggttacagtgccaggacattttttttcctgattgcaaaaccctctctaatccagccaaattcttgaaaaacccagccagcatacgatgaatggaaaacaattgtgatatattccctatcaatgagatcctaactttgactttccctgctagggtagatcctctaaataccaattatcttgctcttgagataaaatacttgatatgtgaccaaggctttgtatgaacatcttgttattgcacaattgtgtttcaaatataataatctcaaattcaaaatctgatctcttgcagtgaaacaattaagccccttctatcaactaatataccaagataacaacaaaacataaatctcaaaaatcatgtctttttgtgggcatacagttatatattagaaacatttgaaagaaaacaaggaagagactagaaaaagtacatttgggccattgaacacaactaaaataagtaagaattttataaaagttccaccaagtagaacaaatgagattaatgccatatgtagatatcaaaattaactaaagttgaaagctctaagtcttaatcaacagtatagatttcttcatttagaaaagaagtatagcatagtggatcaaaacacacttagtaataataattttaaaaaaacctttggctgcttatatagtaaaaaattaaagctgtgtttcagcattccggtatctctaattggtgtggtgttttatttttccaaagttgttatcacaaaacactgatgtaccaagatgtcttcacagcagtggtagatacactgctatttatttcaccaccagggtaaagttcaaataacttagtgaaattgatttagggctctgtctgggtcaagtaacctctgtgactggtaaatttacaggtaaaaggggaaccataaaacataaatttcatgtggctacagtgtcaataaagttgtcacgtagccgagtgggtgatattctttttaaaaacagtacagagagtgtttcaaaccatctatccacatccaagaaaatgtttcagtgactttcctcacctatcaaatgggaattggaaagcttatcatatagatgtgccgagaggaataataagccatcagaatctgtaagattacttcatgtctgttattcaaaataggtaactgggaaaaaatatggactcttcttgaaagcatgttaatcttggtaacaagttcacaaggttggctttatgcaaagtcaaactgagacctttccattcaagacgttatattctattcacaacagaatatttggttatacaggggctctaaactaagttctaactctgaggatgacctctgttttcttgaaaagttttgcatgcctgtctgatggcaaacactgtaaccttctcattttcccatccgggatctcactgttaatctctctatttctctgccatggcaggtttttgatcaattaaagcattaagcattcagtaattatttcaatccacaagtatttactgattgtcacttgccagcaccagtggcaaacaaagccaactcatgaagcttacagtcaaatatggagacgggtttaaacaaaaatcaccaaaaaaagtgactagtgcaataaaatagcagtaaagggcgtcatatgttaagagctctacactgctgccctcaactttggagcattcccttcgcattgaaatagctttatttgactatacaacatgagcatagtttagcggttatcaacagagatattactttccccgaggtgcattcagaaatgtggggaccagctttcagttgtcgtaatgattaggatacaattattttgtcattcggtgggaaaatccagtaataaaatttactgtaatgtgcagaattaacaaagatgtgaaacaaaggaaaattttatccttgctagtggaaatatggattagttaatccactttggaaaactacttgccagtatttactaatctgaaaatgttgctggtgggccggttcaggttcttgacttcattcaccacacaaagaatttgataacaagtccaaagcaagagtaggcaaagaagtttactgcaaagcaaaagtacactctgagaggcagagtgggctgctcaaagggagagataacagctagtatcctaagaggaattcctttcatgggagttgtacacaaacattcataaaatacgggtgaggtcaagtatgcaaaggcagacctgtggttggtgaatgcgctcagcatctacatgctctcacatgcattgcacgtatcattagcagataaaaatctccacgtaggagtgtgttttttaccaataaaatgagggaaaggtcactataagctaaaccttgagcctagctgcacatgtgggatcccggagacaaccctaccccccaaggcaggaatttgtagctaatagtttcctgggcttttagtgctgactggctggagaatgtgggagctacatcaggagtaagagacttttattctctttcccaggacataccaggtatcaggaacttgtaaccatttggtaatctgctcgtatactgtaggactggttatcttgcaaaagagttacttgctgatgcaggaaggtgcaagagatgcaaagcttcctgcaaaaggggtccgtggggcattacacaaggggacaagtcagcatggctctgtaatcttacttaacctgccccaaaaatacacgtagccagtgaaccatcatttttcctcctatgtacatgcctgactaaaatgcattaatttgaaacctccacatacacagggtgaaactccaagaaacccagtggaaaatagcatctcggaggccgagcagggattgcagcagccacatgatctgaaaagaaagagattagtccaagccttgtaaagatgacgatatctttatgaatacaatgagcttttacgtgaatctcaagaaggaccatgaccctggagatagggtcatcatctatgattatgacccatgccttaaaagtaagaggaaatttataggaacaactctaacaaagtctaaaatcatactttgacagcggcaaggtgacacactgctactttatctccttgttacaaaaaatttttcacattctcaagtaaaaatctaatgccgtgcagagatgctacagtttcttattctcaatgtctgaaatccaataaaaatgtatgaggcatgctaggatccaaaataactaaaaaccaagaggaaaaagcacatatttttgaaagacccacaggttttcaaatattggaattaatagatagaaaattttaaaataaatatgtttaatatattcaatatagagaagaaagggtatgtaatggactgaatggtcctgtcatgctcaaaatttataggttgaaatccaaaccaccaaggtgatgatggtaggagacggggcctttgggacacctcccaaagattaaggtcatgagggtgaagcctacatgaacgggattagtacccttataaaagagactccagagagtgtatgggcctcttccattatgtgaggacccagcaagaaggcaatgtctgtgagccagaaagcaaaccctcaacaaacacaaaatctcccttgatcttgggcttcccagctcctagaactgtgagaaataagttttattgtttataagctactcagtttatggtattttttatagtagaccgaacagacttatggtacaacataatgaagacatcaagaatgtcaatggaaaattggaatctacataaaagcaatctaatgagtattatataagcaaaaactaaaatatctgcaataaatacacaatggatgggttaaaaacagtttgaacacagttgaagataagagtagtaaactaagaaagttcactagcaaataatccaactgaggtacagagataaagaataaaggtacagaaaaaaagaaaaaataacataatgagagaaacatatggaaagctgtcaaaagttttgtcaaaaatgtaattggatctcagaaagaaaaaagtaaataggcaagaacaatattaaagacacaaaaacaatcttaaaagtagccagagaaaatagaaatgttttcttcaaaggaaaagcagtaaaacttatggctcatttttcatctgaaaaagtagaaaaaaaagagaataatattttaaagtgataaaagacaaataatcttctatatttgaatcaactacccagagaaaatatctttcaaaacaagaaaaggtatgttaatgtattgctaacagatccactacaataatactactaataataatactaaaggacttgtttcagactgaagataaatgatcccagatagaagtatgaacacgcaggaaggaagaaagtgtgaacacacaggaaggaagaaaagagcactaaaaaaatttttttaaatgagtaaatataaacaatttttaacaagataaaacaaacacaataataatgtctcatgggctttacaacatgcagatgagaaagaaatgacaaggacagtgatagtgcacagggtgaaaaggaataaacaattgacttaaactattgtaagatattcacatgtttcagtgagtagtaaatgtaccaatttaattagaccgtactaagacaagaatccacactgaaatctccaggatgaccactcaaaatgatataaatgtgcctaacttagaagattatggaaaaaattgaataatagaaacatatttgattaatctgaaagaaggcaagaaaggagaaataaaggaacaaggaatggacactacaaatagaaaacaaatagctaattttcaggcttaaccatatttctatcagtaactttattaagtgtaaataaagtaaatgtcccaaataaaagactgtcagacaagattttaaaaaatgattccaatatatgctgtatacgagagacatactttataaatacagccatggaaaaagttgaaagaaaaaggatggaaaatgatgataagttatatcttgaaaaacataaacaagtgtgtatacctattctgatatcatgtaaactagaatttaaggcaataagtatcactggagtttaagagagtcatttttaataataaaactttcaatgccacagcaagacataataatactaacattgtatacatgtgatgccacagccttaaattagataaagcaaaagttgacagaactaaacatagaagtagataagttcaatgtcacaggtggatattttcatacattacactcataacgatataaacaagtaagtaaaagatcagtaagcgtacaaaatatttaaacacaaagttggacaaatttccatatgtagaaccttatattcaacatttacccaatacacattctttataagtacacgtgtgacatttgccgacgcgtaccatttaccaaattgactattcaccaatactctgcgatgctccaagacatacagagatcttatactttaccatacactaagtttcaacaaatttcaacagactgaaatcatgtagagcatgttatgtgaccacagtggaattaaacaagaaatcaatactagaaagataactagatctttaacaaaggatttctattttgatagtagccacacacaaccaaataattaattaatctgttaaagggaaaatcagccctggttgttgttataatttatatgacttcaacaagagtttctgttgttctgctttcttaatattaatactgtgagaaattttagcttttaataatccaatagagtttaaattatcaatatggctttaatgggcatttagtgattcagcaaaaattaatatatttatgcactgaaaactgtaagtttccctctaagctctgttttttagatgcatactacacattttgataacttgtcttttcattcagttcaaaaatatacataatttcatttatgattttttatgattttccctttaacacatgaattttgctctattttcaacatattgtgttaagaaagtgacaatatccttgcaaaatgaagtaaaaatgttttcacatttttctaatattaagtaaatatttatacaatattttataacagatgaatattcattctgagaattattttttaattcagattttagtagtccttttgtgcacaaatttaaatttatcatacaattggttcatgacacattctcatcgttgataataagtatgtccctcattttcattcattgatcaacaataaataaacctcagttatcacccatcactcaggatgaaaaacttaacaagaatttatatccacttctctgcccattcctcaaactagccatcctcccaacctagtcattcttctgtagcctgtgtttgtgatttggttttagattacgattttcaaagtcatgtcactttgcttctaaaaaatttactgctcagttttagtttttctctttacaaaaaaaaagtttagcattttaaataactctctgttattttcttcaatcagtaaaaggaaaatagtcacttgtattctttaatgtagttatattcattcattttgactgccatgtaacattcaattgtgtgagcatactaggttgtatttactcagttgcttaccaattgcattggagtgatttactttttatatttaaagaaaataaacttgaaaagctatctgctccctgtgttagctttgataatatgtctcagataatttttaagaggatttatgctcatgaacctactgtgactcatatttattactaagtccatcaaaatatgcattagtttcattcaaatgtgcacaatggtcttacagaacattggttcacatatattactttttgaaaatttaaaaacaggccagatgcagtggttaatgcctgtaatcccagcactttggaaagccgagacgggtggattgcttgaggtcaggagttcgagaccaacctggccaacatgtgaaaccccgtctcagcatgatggcgcacacctgtagtcccagctacttaggaggccgaggcagagaatcgcttgagcctgggaggcagaggttgcagtgggccaagatggtgccactgcaccccagcctgggcgacagagaaagactccatctcaaaataaaaaaagataataataaggaaattgaaaaaatattgtcaagcgcaaaaacaaaaacagctgtaatcatctcatttggagtttcatcctccaaattcattaagaaacatgttgtttcatatctttcctggcctttctctatgcatgcatgtttttttgtcgaaaaactaagtaatagaaaaaatacagtttttaaaaataatatttactcctttaaagaataaaactcctgatttaatttttctttgctaatatcagtgcagtttgtaatattcgtgacattgtaggatttaactgtatggatacagcatagcaggggaaatgttatcagacttagctagttctttgattactaaagcagctgaacatgtttttgttatttgtatttattttgtgaatggctttgtcatacacattactcatttccttttgttattactttttaaatatttaatgactttatatttgaagatattatagcttcatatgtgtggaaaatatttacagactttccatttgttaattttctgtaactatttatttttgtgatagttaaatatctagctttgtgtagcaacacacaaataattttagttaaaattttggattttggtatctgatttacaataattatcaatacgtttgcttgtagtaattatgtatgcaggctaagagagggatatgtctcatttaagtctggattccatcagcagctcaacctccgttccaagtgtgactctgcccctctctgaagtctgctgtctggtgtgtcaaagagtcattgccagatccataggtacatctgcagcccctctcctggggcctcagtgctgttgcccttaaatgccactctaagatgacaaaaagatgccaacagcgggttcccaattttgccacagtctgccctaatctgtagctcacatctccagctccagattttgaagaattaaagactttctgccataccctttaatatttttccccctgaatctaccacttcagccatcagtactaaattcaacctccaagtacgttgtatctaacaggaattctttttcaatcctctcctctggatagcatttaagctgatatatatgacacagaaatatctgacgcttaaattcctacagttatttctatagttatatttctatcgaaatgatatatttctattgatacatgtcatgtaaaacgtatttgccctgcctcctttttctcttattatatgcaaatgtgaaaatggaaactttaaaatctcatactgaaatgctaagagagattagaaattggaagagtattttacagatcaagggaaaagttctacaaagatataaaaatgagctcatttagtctcagaataagaatttttcaaaaacactatagtgaaaggaaaggagaggagaaaatatagaagggtgaagtcattgttttacaaagatcttgatgtattattgactgttaatttatatacattgatggaaaggataaaaaacagccatacatatatagtaattgttttgattccgtaactaatttatgtacatgtgctatggttaagggacatagatttatataagaaggcccaaaatggagttttttaaattgaatctgagctaagggaaaaaaattaaatttccacatgtctattctctctatcatttttccacaacaagacaatgtccttttcaacaaatttctgccccatttatctaaaagtaatgtatgagacatttgtccatattgaaaagaaaatctcaggctgtttctgttttcacagctcctgaatctatagagatatctttgagagtcatgtaatggtgggactgaaatggttcatagaggtgacagtatgcctgagctcacatggaaagtaggtaatcttgctaagacataaatccagatcctctgccctgagtcatatctaactggtcagctggtattcacctttctccatagagattctaatttaattgttcataacacattttctaaagtatgcatcagaaaatttgaattctgtaatttcaaatgagagttctgcagatagtgttttgcaattaaatttgtaaccacttgtataaagttaaatattctttcccatagagatattcagcaagtctctagggatgagcactatgaaatcatttaagagttgcatgcaccatattatgtttttgatattttgctactacagaggactatttccgcaaaaggaccacttaacctaaggtacgtctggtcatattgatgctcagtagaacactcttgggatgttgtccagtagatcatgtgcacactccaattaaaagaggattcatcataccatctccaaggaatctgtttactaaattttgaattcagatctttgacaaaggacattttgtaagtgcttctgacacaggagaaattttgaaagtgaaagaggctacttaggatataactatgaataaatcacacacaatttcagccctcatggagcaaatcgtttagcaaaggacacagacaggaaacaatctcacaaatcagcatttccagagaaaaatgcacagattagttgcaccatgaaaggcttgaaatattcaggtgctatgattccagtatatctcaatttacttccaacgttttagcccatgatgcagagtatacatttgggaaattgctagtggattcttataatttgagtcagctggggatgctacttacagctcttgctttagatgctgtagattttttggaggatattaatacaattcctcataggtgatatgcagctattaacctgacccatgcatttctgtgcattttaataaacggaggtcataaaaatccgtttgctttaactggtaggaacagccatataccattaacatctgatcctgagggtagcaaccctaaggttctgtgctacatcataatctgcgggactttagaaatacatcaccacacaaggcatgatgttgatgcaacctattaataacatcatgctgatagaatctggagaggagagtagaaaccatcctaaacggccttggtaagttgtatgcatactgaagagggaaaatagattctctgaaaatagaagaatctgccttatcacttaagtttcaactgagaatcaataaccataggatattcacttcagtgcgaggaaaaatttgctgcatgctgtagtcttaaggagatttgcttcctcatatttactgacgtgtttaaatcttgaaagcaacttataccaatttggacccatataccaaagtggccagaaaaggattttagacggatctaaagcaataaatgctcctagcaggacctggctgcagtacaggcatcccatatgtgttgctgtttttcccatagcctagaacccactgaagcagtggttaatgactcagtagcaaaacattttattctggttttcaccatggttttgatatttttgtactcaagagcactatttccaccaatggacaaaaaaaaaaaatgtttccactggattggaaactatgatagcagttagataaatatagagaaaaggatgatttggagtcagaataagtgatggacccacactaacaggaaaaagaggattgctactctataattggatcaaagatgtatactaatggaccctggtacctgcttactccaccatgcccagaaatgaagatttattactactcttagaacatgtacaattgtaattgtacataatctgcctgctttgtgactactactcttcctccttcatataaatatatatgtatatatacacacacaccccttttttgaattacgaaaataactctctctaaaagcagaactgccaagtgcttagaacaccccattggaaaaataactccatctagctacattgttctgccagagttaattggtaatgtatatattttagcatttgatcatctcttcatactgggagattcagatttttgtaatgtagtttctttgtagccagtggcatgattataatattccagacaactataagcccaggaaagtagaatttggcatgccaagatgaagaaaactatgatattcagattcaatcattcacaaaaataggattacacagttctataagctaagcaattgtatagaaaaaagatgttccaaattctatcttaatgcagtttggaggactcagctcataggttatcccataatttaattacagtaattaattagaatatctgtattttccattaaggcttagatatccatctattggagctaggaagaaggagatgttattaatattatgatgaatggaaagctctttcacaaaaaggcaattgtaggatcatgaaatcaaggaaaaggactataaatacatctcctgatttttcttctttggaatcaggttcaccgagcaggggagtgcattcgacaaatggagggcaacaagaaacaaagaagttactgtgcaacgatttagcatgcctacatccagtgtgctcatgcgcagtgaggcaggcactggagtttagcaatcctgggctgtgttcagtacactgtgaatcagggaactgtttgaagacccagtgggcttgccaccggctctgtcagagtaatgggaggtggcttcttagctgatgctggaatcaggttctcacagattggaagacacgcagagcctcagtgtctgccatcggtgagagctgagctgaggcccatttagctaatatatactgaaaggttagcaatggaccaagagaaacatgatcgctagttacacacttcaagaccagaaacactcagaaggacagaaatttattcaggagaagcataaaaacccctgtgtaccttccacaccagcatgaggccagggtgctgctccttacctcattccccaagccagaagcccgcaattctccttcaatccttatccacttgaacagaaggagagaagcaggggaagcagagggatctgagaaactgagcatttttatccgcatgaaagatgaagcacaatctaaaaaaactcttgattaccagttcagactaaacttaatcttgtttgacattcagctaatcactttcctgctaatcagaatgtcagagcacaggagaaagactataggtgttttgcaatctattttttctggatatctaacttgtattatgagctatttgtgaatactactcttcctccttcatatatatataatatatacatatatttttaattaagaaaagaacttaattttttctttcccgaatttaattttttaattgacacataataattgtacatattcatagggtgcatagtgatgtttcaatcatatggtgatcaaattagggtaattagcatattcaaaattttaaacatgtgtcatatctttgtgttgggaacattcaatatcctccatctagctatttgaaattatacaacatattattgaagcagcgtcactgtctggggtaaatacgggaggttcattgcctcatgccaaggaaatcaaggactcagacacatatggattgaggttaagagcagaggtttaacaggcaaaagaaaaagaaaaaagaataactctctctcccttgagagagaggagtgactgaatgggaattccagcccacaagggagtgcactagattttatagacaggcttgaggaagtggtgtctgatttacataaggcccacagattggttggaccaggcatgatgcttacatagcagcagaggaagttggccactccatcctaatcctcttactatgcaaatggtgtctttgcttggccatggccatcttgtttgctccttactatacacgaggctggcaaagagaagagaagatggagccgccattttaaacgtgcctagttcccgggtagcttctttcctatcggcgcaactgccagcattcccccgtgcaagcttctagcattcctttctatgtctgcaactcgattttacaggctgctctttgttagaaaagaaagttatttcggggctgcttttcattaaaaggaaagccttactgagggcttccttgccctcactatctgcctaaataatttctttttaacttctatatcattattgttaactaaactatagaccctccagtgctataggagagattttttaaagaatacaaaattacagctaaatagaaggaataagttctagtgttctatatatatttcaaatttccctttgactttctttccctcactattgcatataacttcaccatttgccagtgatatatttagccaatataccagaacaagatcatggtggaaattaaggacaatgaataccacttagaaatcttggaattgaatctggaaaatgttcttaggggtaggatgacgattttatttttacagggaatgtttgcattatgtcaggtgggaagttttttgaaagcatacttttaggactaaagatgaggatagatgtaggggtaaaccttcatgaatttcttctccactatatgtacccttcctaggactgtttaacttctggttacagtgtgttctcatgaccgaagaaaggtaggcctactgggttctctctcttctaggaacttaaatcttcagcagaataatgtaaagactgaaagacagttagagcctattaattgcatttttgtattttgatggtgttctcatgaattgaatcattgtgcttgctggagtcaagaggttccaagttatgtgggaccacagcttatacagtttggagggtccacttgaaaacaaaagaatgcaaaataacaaaaattacttggaagtaattggaagaattacttggaagaacttgaaacttcagtttcattactgcatagtaaatgcacctcctacccttttctacgatctattctttcctgagaattcccatagattatctgaactgaacgttcagaaaacttaaatttctacttaagttaatcagagtcaatttcagttgccataaccaaaactccttaactaatgaaaatagtcaccattttattgttttaatgaaaatagtgctgtagaccgaattgaataacaattacagctacttgggccccattttcttattttttaatgcattcatctggaatatacacattattttccaatgtttctaatttcactgttgaatattattaaaaatggtcgatgaatatacccatttatttcattgtaaagcttttgagacttgcatcattggtatagttacactgatatttctccctctacaattctttagcaaactttttgatcatgtatgcagtttttatttttttaattccacatttttattctattatctaaactctgttctaagactacacaggtactccagcttatttttatagcaaatgcccatgtaaatattaagttactacaaacattaattaaatgattgcactgtattagtttcattatattgcctagaactttttcttttttctgtgaactctgcagagaagtagaacatttttataacagaaatacatcatttaaaatatatgaataaagtacaaagtaaaaatagtgagaatttttttaaatttgaaactaaattttagaaaaggttcaacatatagctttaatattctgaactgattttcttacaaagatcagttttgtatttttgtttatatgtttattattatatcccataccttgacagaaatctgcaatcaaagcacttttggagataatgtcctactgagttcagaacacctttacagtctccaaaatataagctataggaataacttcaaatttgccttggaaaataatattttccttagattatatgcaagatgtgagaaacaccaagtgtattgtactttttactgacactgggggaaaataactaaaaatacctaaaagagcttcacactaaagtcaagaacctttaattttgtagactgctatttttgaagttaatatgatggatagaaaagataataaactttgacataatataaatctaagtttaaattgtgggtctaacacttattgtacttcatagagtattatgatgtacacttcttccacattttataatccttgaactcaataaacacccaacaacggctgttggcatggcatgatggaattgtcattgcctatatataagcaagcaacaaaagtttcagggtcaaaactagtaggatagaagtcaatgcttggatagaaaacttggattcgatagtgcaataaacacattttatccctaggaaaaagtgattgtgaggaagaggttgggctctgtggtggcttgatacgtttcgcaacagtcttagagaaggagaaaatgtagaccagctctacatactcacaaagccagttttagagttcagcataaaaagctttgaattattttatagactccttaagaaatgctgttcccctaaatctctggtgttacagagccagggaggaccataatgtgtgtgaaaacatgtacctggattactctgcatcaaaagtcgattcagaacagtcacgctccaaatataaagaaattttaggaatattttacctaatttgtttcacttcatttttcttttatatacatgaaacataaataaatgaacatttatgtggtaaattaagcctaaaagagatccttcagtaagtatacaattctaagatagaaaaaaagtattatatcatggtacaaaattaacagtattgtttttagtggtatataagataatagtgcatcttacaactaatgcaccttagcttggatacaatgcagtactgtttttactttgctcaaatcttttctaaggctacttaagctttctttttttattcatagtattaggttggtgcaaaagtaactgtggtttttgccattagaagtattgctatttaaagtatttaaagtattactaaagtattaatatttatgtaaaaattagaagttctgtatcctaaaaaatcctgttctataatataccttcaatgcatcattattagtattatttgtcaaaatgcccacatttcttattgagtaaatacctgataccaaaacaatgaaaaaaatcagtaatgattcatatgcttttttcacttatacagttatatatgtatattgcttattattcttaggatattttcttacatttaaaactatgttggacaaactctaaaatgatcaccagttatcccgcctcctgatatgcgggtcttatataattttgagtgtgggcaggacctgtgaccttcttaaaaccagtaaaagaagccaaatgttatgggatgttaattccattattgcattacataagattgtaacttctgtatggccagcagaccctctgtattgtgtcattcccttgctgggtctgaggcaataagctgaaatgtggagagtctcatgtggtggcaaaggactgactataccctctggctcatggccagaaaagatctgaggccctcaattcagcagttcacaaagaactgaatgttgtcaaccacatgaacctgcaggcagatccttccccagttgagcctcaaatgagaccacaactttgctgtcaccttgattgcagcctatgaaacattgacaggtttcagtccaggaccctcctaatctatgctctgattcctgacccaagaaactgtgatataataagtgtttgttgtgttaagccattaagtttgtcataatttgttacacagcaatagctaatcaaaagaaatgcatgaagacatttaaaataatttctttaaaattgcagtttatatccaatcatttaaattttagagccttttttaaaaaaattacaagctgagggtggtggctcaagcctgtaatgccaatactttgggaggccaaggtgagctgatcacttgaggtcaggagttcaagactagcctggcaacatggttaaaccctgtctccataaaaaatacaaaaattagccagatgtagtggcaggaacctgtaatcccagttactcagcaggctgaggcaagagaattgcatgaacctaggaggtggaggttgtgatgagccgagattgcaccactgcactccagtctgggtgacagagcgagactccatctcaaaaaaaaaaactacaagtattagtccccctatatgcttgaatatctatctctacttcaagaaaaatgatagcactatcacaaactacctataagtagtaacttttggggggataaactataatttcagtgtcaattttttaatgtattaaggcattatttttgtctgttccttaaaataatagcgtttttctttgaaatagtacttattttcaaatatgcaattgtttaattataagctgaatcttttcttataaagatgaatttcaagttttgttttatatcatattttggtcttcttggtcactaatttcacccttgtgcaataaacattagacaatcaaaattcaatggccaagtgtgattcttggaaatcatgttcattgttgaagacaaatatgttattatacagaacagcatacacaaaaggtaataactggcaacaaaacaacactataatgaaaacattcttgaaaaatcaattgcaaaattattctagaagaattaactggcaaaagtagagaagataattatacatcataggattatctacattttcctgtttttgcccactggtttagctagctagggatggaaaggatgaggcaagcacatatgggacccaacaaaggctaatatattattctatagtaatctctagatggcctttttattttcatctattaatatttttccaagaatactttaattcagtcagacacgtgtcataaggacacaccttggagatgctagaattatgtggagactaagggttaaatggtcaagttatcacttagtgtagacgtcagtaaaagtcagtaaaattgaggctcttattaatattatatcatttatacttaatagctggcaagtgctaaaatatttaaatcatgtatatatcaaagaattatgaatcatcaaactttacacaggtgaagtaattttaaaaattatgagaatttgcaacagcaaactctactggtataaagcagtatctgtcaccccttgcccccgattcatctgtgtaaatatgaatctatattcccattgtgcggagaatatgaatacaaataacccaggtggtctttgacacatttcaagttagaaaagagaatgtgctgccttagtaaggaagggatgaaaggaaatgataatagacttttttaaactgacatatccatgccattctttcattttcttctttaaattgatatttagtgtttcatatagaagaaaaaaatacataacagagaaaacagaggaacaaaaaaccactatcttttataatcttttttacatttattacttttttaaaagctagatgaggtcacagtatgaattatatatttcattttatcctaatatttatgtcaaagaattcttcatgtagccatctttataaccattaatttagccatgcaaaacaactcatcaaaagtggggagggaggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaataataataataataatagtaataataataaataaataaataaatatgtatcccccccaaaaaaaaagtatatcccatactttatttatatttttctttcttttatttttaaatggtgttaggataatacacaagatttgatattttttaaaaaataaatttatactctttaataaaaatattacatgattttttattttgccttaataacatcctaagtgagactgaatttgcccccatatatgtgtagggaaggactgtggcttctctattgttatcaaactataaatacgggcaagttactgaatctcccttagtttcagcctctttaccaaatagatagaaatatatttgtacttcaagccttttttgtgacatttagtcagctcatatccagaacccaacaagaatctagaagctgattcatctttgtttcctttgttcttctccataaagaattgttcctcataagaacagactaatctaaggaaaatgttttgttcacttctatgagatttttgtatctgataataacattaatcttatgtcacacctgtggcaattgtttttcactgttaaactttttatgattctaaatatagactatttaaaatatatttgatttttcatcattttaaacagtaggaaatatccttcatttgatgtcttcacagaaatttatttttttctaatctttccaaagatattttaaaactataactctttgatattatgaaatttaaatacatttgtaatgtcaaggtgacagtttaaattgctctgttttcatcaaacttgttaaacacgtatctcacagaatttactaaataggaattctcttctccagtaatgtatgactttttttttaacgctctgggctttctgttgatccatctctttcattttttgctggtagcaacttgttttattttaaaaaggctaatctggccttaccaacatgagaagagtgttagttgtttctgtaagaggctgtatatactgtttattcatcttataggtatcagcaaaggcttacataaaaccaatcatccttattgtcatttacctaaaccacagcagtagtggcccatttgtcagttaaaatttttatgtgattagaaagagccttcaaaagagtttatggtaagagattgataggatcaattctatggctgcatccagatttttctttattaacaatgaactgatatttattgaggggttactatgggcagcccaagtattattctaagtgttccatatgcattatcaaactttaaagtatcccctagtgacccgcaaggatgttcaaaaaatgaaaggacatcatgggcaaggaattaaaggaaaccaagagaattatgatagtgattacacagacaatatgaataaaaagatagaaattacaaaacagaaccaagtataagtgttggagctaaagaatacaataattggaatgtcctacgagaaaactgatgcacaaagagccaaagtcacacatctggtaggagatagagtcaggattcgaacccacactggggctgtggtctatgcgtcctctcaagctgactgcctgctggctgtcaggttccctctgctcccatggcctctactgcccaaccccaaggctggaagttcacattgtcaaataatcctggtaaagctctgggcatggatgcagctggaggccattatcttaagtgaagcaatgcagaaacagaaaaccaaatatcatacattctcacgtataagtgggagcttaacataggttatacgtggatataaatatgggaacaataggcactggggagcactagaggagggacagggaaggaggcaagggttgaaaaaccacctgttgggtaccgtgttcactacaggggcgatggattcaattatatcccaaacctcagcaccatgcaatacacccatgtaacaagacttcccaagtacccccgatactaaaataagagttgaaaaagaagaaaaaaacagaattgtcctagcaaacaattctaatgccggcttaagatatgggaaaaggtttaagcagactaaaagtaaataagtgaaagttagtagacaaaaatgatatcattttgtgtaaaatatcctgatgtttcacagctcaatgttagtaataataactcagggctgcaaatctatcagacattacttttaggaatttaaattaagaacattctaaaaagccattagacggccaggcacagtggctcacgcctgtaatcccagcactttgggaggccgaggtgaatggatcacttgaggtcaggagttccagaccagcctggccaacatggtacaaccctgtctctactaaaaatacaaaaattagctgggtgtggtgacactcgtctgtagtcccagctactcggcaggctgaggcaggagaatcgcttgaacccaggaggcggaggttgcagtgagctgagattgtgccactgcactccgacactccttcctgaatgacacagcgagacccggtcaaagaaaacaaaaaaagccattagacagtgtatactctacccactgaaaatgcttagattcattagcatgaatatactccagttcaacaaatctatcatttggaaattcagaactatggaccaacatatataagcaaacagctgtatctcacagctttataaatattactaacctcagttagggaaatgaactaccaaatacttatcatttaaaaaataaagacattaacatttctacatgtcaaattactataataattaaattactataatatatatgtataaaaaatacatcaaaatatagtaataaacttgggatggtcacattgtaactagtggcttttttctcctttgtgcttttatatatttttaatcatttcatagttggtattaaataacttaataattattcaaagtgtaatgtaaaaatgaaataaacagcaaagagcattcccagtattgtcttactttgagggacaaaatgtgaacctagaaatgttaacactagataattatataattggtcatgtttttatttttcattccctagcatgtcttcaggaagcacatgttgtttttataatcagaataaacttatagaacattgtgttctacataatgacaaaaacttgccaagatgtttttgaaaaagaaatgtaatgtgaaaacgtgttgatttatttctgactggagagccaaaccttgtttgacaacacccaaatctggtactgattggcttaggtctccaagtatgagagcatgttttttgtttttttttccatcttgtttactgctatattttcaacatttagcacactatctgtttcataagagctcttcaagatgatttgttaaataattccacatattcaatctatgtcaatagaatgtcctgtccttaccaataaccagcagtatcacattcacatgataatagagcttcttcaccttcaggcagagtacagattgtaaaaaacatgaggctttttcattaacttcaagtacctactttttaagcctctcacttgctattgtatagccttgggaaaactacttaacattatgtggttatttctttcatttgtaaaatgaggatgtagtatctaatttttaaggttactatattaattaggtaaatgttaatgtaactaacccacagttcacctaaaaatatgataaaccaaattgggttcaaccatattgtacactttcataacccattgatatttttttccatgactgtatcttttaaattttaaaggaattgtctgctttattcacatttttatctgaaaatcttttttcaacttttaagttccgggttgtatgtgcaggatgtgcaagtttgttacataggtaaatgtgtgccatggtggtttgctgcacttatcaacccatcccctaggtattaagccctgggtccattagctattcttcctaataccctccctccccacccctaatatgccccagtgtgtgttgtctacccccgtgtatccatgtgttctctcgttttccttccacttgtaagtgagaacatgtggtgtttggttttctgttcctgcattactttgctgaggataatggcttccaacttcatccatgttcctgcaaaggacataatctcattcctttgtatggctgcacagtattccatggtgtatatgtaccacattgttttttatccagtctatcactgatgggtatttgggttgattccttgtctttgctattgtggttagtgctgcagtgaacatatgcgtgcatgtacctttataatagaatgatttatatccctctgggtatgtatccagtaatgagattgctggccaaatggtatttctgcttctagatctttgaggaattgccacactgtcttccacaatggttgaactaatttacactcccaccaacagtgtaaaattgttcctttttctcatccttgacagcatctgttgttttttaaaggttggaggaaaattacaaatttttaaataacttgccaactccttattgtcttttttcgtaggttgttttggtgaattatacaaggggagtcatcgaaattatttttataccttctccatttaatcatattcttccaggcagaaactgttaacaagattatgaaatgcaatagattttcaatatctaaacatgttaaaatgctgcaattaggttcctttagtacatgtacgttcctttgtaaaacagaattataagtaatatgccatctgctttaccctatttctaattatagcattgcatatgaattttaataggtatcataatttgaatcactatcatgagaaaatatagagatataggttattgtatctgtttattttcacaacaaatctgtaatagtaaagaatattttatgaaatactaaagtataaagagaaattgttttttactgcaatgaaaaaattgattaagtcattcaaagggtgataaaatttaatttcaaaatagatactccagaagttgaacaaaaatggttttgattataataatagtgcacatagatattatacaaaaaatgaaaacctgtataagcgcagccggaatcatcctctgattgtatgtggctgttaccattcaaaattagttataagaaaaatcatagtcacttgctgagggtcaattattgtgccagatactctacaaagctgtccaatgtccatgttttttctacttcattatgccccaggctttttttttttttttttttttttgagacggagtctagctcttgttgcccaggctggagtccagtggtgcaatctcaggtcactgcaacctccacctcacgggttcaagcgattctcctgcctcagcctcccgagtaggtgggattacaggcatgcgccaccacacccggctaatttttgaattctttttttttcagtagagaatctcacaataatgatttgggttttttgacatgccaaaaagattaaaaagtgcaaatcataaaggaagaaggaacaaaaacatccatataagatgataacaggtagcattcaccacttaataactttttatttggtgagataatttaattctttgagtcttagttttcttatttgtaacatttaaaaaaattcgcgtcaaagtgttattgtaaagcctaggtgaaagcatgcatataattctcttaacactaaattcacaataagtaatatatattattttgaagaactctgtatgaatttttgtttaagaaatgtattagtacttctatctaaggagataaaaaatgtagaaggcaaatagatttatgacataattaaaatactttgaaaagaattataattttttctagaattaactagcaagaatggagatgataatgttaaaaatgaagagagttggggaagtcttaacctaagacatattaaattttatattaaaaataatatttctcaaagttgctattttctaaagaaagaagaggcatttaaatgaaagacacagtaacgtatgtaaaacacatcctaaagcaataaggaagtaattctgccaagaaaattagctaacaatttaaaacagcttcaaatgagattcttaccttatagactatatcagctaaattatttttattaataatgttagtattaataacaatatttttacttactatgagacaattattaagccatttatcagagtaagaaactgaaaaatttgcaaaggttggttaaataacttacccgaagtcaagaactaaaaggagagctagaattaaataaatatcttaatataaataggcaaataaattgataaaaggtaaaaaaaatagtgtggataagaatgttttaagcattaaggaaagagattgctatcaaatgaaaatatttgtagatttaattccagaagaatttaaaatttctgacagtgaaaatttataaccaaaagcagccatttctgaaagtatggcaaacaagctattgtgaaaagttgtgtacattactccaagcaattttaattgcactgctaaactcataaagctaggaaggaagaaagggaggaaggtaggaagggaggaggagaggcagggaaggagggaagaaggaaagccaaagactaatgtgtaggcataggatggctctgccaacagcaaaaagagtaaacacaattctctctgggagaaacattccaaaatgagatagatattttagagtttccatcttgtagtaaaaaacgaagtcaatgtgaaaatattaccagactttaacaatgaaattttcacaagccaacgcaaacataaagaagttaaaaagaataatgagcagagtaagcacattagatctagaaatgattatatattaaaaggtaaaaactaatgaaatgcttaaggaaataaaagatgttatcagaaatattaacaagaaaaaaatcctgtaaaccatcacgagacaattttgaaagagaattctagaacttataaaattaaaactaaaatcattgaaaataaaacttaaatccagttaaatagtaacttaaatacagcgaaaagatgtgaactgtaagaaggtaaatggattaatctactaggcaatatatcaatccaaaatgtatatgcaaccaataccatagtttcaaaatatataaagcatgtattgataagattaaaaggagaaataagtaaatctaaaaacatactgggagattttaacatgtataactcagtaatatttggaagaaccaacaaaagaaattagtatagatacagacgctttgataacaaacctgacgtgatatgtatagaacactaaaccacaaaacttcagaatatatattattcttaaaggcacgagacagttgctgaaattaaccaccgtaataaagcaagcctcaacaaattttaatagatggaattcagataccatatgttctatgacctcaatggaagtaagttgaaaattagaaacaaatagataccttagaatattgtccaatgtttaggaattaaattaaattatgcacttcttaggaatccatgagtcaaaggaaaatagaaaatattttgtactgaatgatgacaacataccatatccaaatctgtgtgatataattaacattgaattattgaaaaataaaacggaagaagtttaaaaaaagcaacagactctaaaaagaaggatatgataaatataagaggaagattatggaagaaaaggaaaaaattaaataaaaggtacgcagtcaaaaaatgattgagaccaataaaagcgattaaaaaaaaaaactttgacaagatggataaaaaaaaaaggagacagggagaaagtaaaatttacaagtgttaggaaaaaagtattctgatatttaaaagattttaataggagaaatatcatttgaaaattaaataatatgctatattcctaaaataaaaaaaatgcaagaagcaatagatattttaataaaatttgcatttgttgaaacatctaagcccataagcaaaattttccatagaaataatctaggcccaaatggctcactagtgtattcttccaaatatttaaagaagaaataatgtcaatcttaacgaactcttcagcatacagaaagagtgggaataattcctgattgatcttataagctcgacctgacttgttacatcaacaaaggaattgtgagaaagtaaaattataggccaatccctctcattaacatggatgcaaactctgaaaccaaacacttataaatgaatacatatattggccattttgtatttattccagacttttattgcacaaaatacccaaaatccagtgtcattccacacatgaagagaataaaggagaaaaattatatgataatttcaactgatacagaaacacttttttttttgagacggagtctcgctctgtcgcccaggctggagttcagtggcgcgatcttactgcaagctccgcctgctgggttcacgccattcacctgtctcagcctcccgagtagctgggactacaggcgcctgccaccacgcccggctatttttttttttgtattttcagtagagacggagtttcaccatgtcagccagaatggtcttgatctcctgacctcatgatctgcccgcctcggtcccccaaagtgagaaacacttttaatattactttacacagattcatggttgaattcttttatcaaactaggaatagaggtaacttggtgtgatggaagatacgtagagtaaatctacagtaaacatcaagcacatgatgaaatatgaatgttttctctctaatatggagacaagacaaagatgcctgttttatattttttaggtacgattgtactaaattgagaaaatgaacttggactttgaccttacactatacacaaaaattaattcaaaatggtttaaagacctataggtaacagctgaaactacaaaactccaagggaaaacaaacaaacaaacaaaacaaaacaaaacaaaaaactggagaaactcttcatgacattgtatttggcaatttttttttggatgacaccaacagcgcaggcaacaaaagcaaaaagagataaatgggactacatcaattttaaaaaacttctgtgcagcaaaggaaaacaccaacagaaggaaaaggcaacatacagagtgggagaaaatatttgcaaaccacatatttgataaggggttcatatcccaatataaaagaaaaaacacctacaactgaacaacaacatcaaaaaacaatttaaaaatgggcaaataggccgggcacggtggctcacgcctgtaatcccagcactttgggaggccgaggcgggcggatcacgaggtcaggagatcgagaccatcctggctaacatggtgaaaccccgtctctactaaaaatacaaaaaattagccgggcgtggtggcgggcacctgtagtcccagctacttgggaggctgaggcagcagaatggtgtgaacctggaaggcagagcttgtagtgagctgagatagcgccactgcactctggcctggacgaaagagcgagactccgtctcaaaaaaaaaaaaaaaaaaaaaggacaaatagcttaaatagacatttctccaaaaagacatagaaattaccagaaagcctatgaaaacatgctcaacatcactagtaactagggaaatgcaaatcaaaaccacaatgtaatatcacacccaataagatggtgataattaaaaaataataacaagtgttattgaagacgtggaaaaatactaacccttgggccttttggtgggcatgtaaaatggttcagccactatagaaaatagtatggaggttgctcgaaaaataaaaatagaactactatatgattgagcacttccacatctgaatatatatccaaaggaaatgaaaacaggatcacaaagtgctatgtgcacacccatgttcacagcagctttattcacaatatgcaagaggtagaaggaacctaattgtccatcaacaggtgaatggataaagaaaatgtgacgtatgtaaatacaatggaataatattcaatcctaaagaagaagggaatcctgctgtatgcgacaacatagtcgaaccttaaggacattatgctaaatgaaataaaccagtttctgaaagacaaatactacatgattctacttataggaggtctctaaaatagtaaacttcatggaaacagaaaacagaatagtgactgccagtgactaggagagggcaaaagagaaattgttcaatgagtataaaacttcagctgtaaaaaatgaacgatttctaaagatctgttgcataacaatgtgcatatggttaacactgaaacagcatttttcatctggggtaatacctgaggtttgttgcctcatgccaaggaaatcaagaacgtggacacacaaggagtgagttcaagagccaaggtttaataggtgaaagaagcagaaaaggtctctctcctgtggagagagaggggctcccaagtgggtcttccggtttcttggtgaaacgcatggggttttatagatgagaaggaactggtggccccaccctaatcttttattgtgaagatgggttctctgtctggccacctccatgttgccggttcctttaccgtacacgtggttgacaaagaaaagggaaaagggagcctcaatgttgaacatgcctggcccccaggtagccttatcctattggcacagctgccagcattcacccgtgcaagcatccagcttgccttatctacgtctgcagttcgattttacaggctgctctttgttagagaaggaatgatatgggggctgcgtttttgtaaaaagggaagccttactgaggactctcttaccctcactaactgcctaaataatttctttttaagctccttatcaacactgctgtactcttaaaaatggtaaagatggtaaatcctgttttttatcacaataaaaaaattaagaaaaaagattgtactaaaggctctagacagtgtaataaggccagaaaaataaaagatttaataattggaaagaaaaaaagactatcattatttgcagatgcatgattgtataatataaatataccaaaggtcgagaaactatggtaagaatatttaatcaattcatacttttattattagatatagtaatttttagcaaaaagcatctatttgccacctagaaataatcccacataaagttagacaagaactttataccaacaaatgataaaattttgtatattaaagcagactataataaatggagagatactctatgtgtaaagacaggacaattagttcaacccaaactggcttatgaatttaatacaattccaatggaaactacatttctttagttaactgatattatgatttgaaattttatttgaaaatctcgtgggcagtgacagctaaagcactcaccaagaaatattatcaagttttattacaaagctagagtaatttgtatagaaccccaaaaccgaaccaacctatacagaaacttgttacatataaatactgtgtattagagagaaagacaggacttagtaattagtgctgagacaatgtgttatccataaggggcaaacaatagtgatagaacacttatctcacagcatgctttagaacaggagagaaagaaagaaatgtgtaaaacttaacaattgtttatggcctaatatacagaatgatgtcctaaacaaaataccaaaaagtaattatattaagaactcttgggggtagggaggaaatggggatatgtagttccaaggctgctaagttgcaattagtagaatgaataagtttagaaatttaatgtacagcacgaggataatagctaataatattgttttgtatactggaagtgtgctgagagagtagattttaggtgacctcacacacacacacaaacacacacacacacacacacacatgcactccaagggataactgtaagatgacagatatgttaatttgcctgaatataggaactatttcattatgtatattaaaaaattatcttgtatacttaaatataaactataaaatatttcttaaaatctcttaaaatttcattatcactaaatttaataagaaatttgttcattaaggggaaccttttaaaaacatagaaaacaaaccacaaattgggaaaagatacttgaaaatgataaatcaacagaaaattaataacatgaatttataaagttctccttcaagttgacaaacagaagaccacccaatagaaagatagggcaagagatatgaataggcagttccaaagaagaaacccaagtggtcagtaagcacatggtaatatattcaatccatcacgaattagaaaagtacaagttaaaaccaatcaaaatgagatataattttacagtgaccatcatagcaaaaatgtaaaaacaaagttggacaaaaacaaatattggtgagaatgggaagcccaataggaattcttatatacagtttgtggtcatgtaaatttatatggcaattgctgtatgcagttgggtgaatttgtatttgtcagtttagctagaccaagttatgtttcccagcactgctgtcttgcttagttctaagttaatgcaagccacaagagatattctgtgcaagagctggcaggtaaaagtgaaacagcagctatgtacctatgcttgaaacaagaattgagaacaccacgtacgaattcagcttacacgtattgtcagttgctgctggctcactggggctgtatggggcaccatttggcccacagcacttaaacatcctgtggcttctgcaggatcctagttgggacagcatatctgccccagggatatttcattctttctggtggcatcttttttttttctaggaggaagcacctggtattactaagaattatgcttcctgtcaatgataccgacctgacttcagcagaaagaaagcgcactgacattatataaccataagttgtaaaagagaggggaatttaattctgtgatgaaggacatcatgctctcctagaaggtattcttatggtcaaagttgaagtctcagaggcagagggagaaatatgaaggtttcaatttgccatcatggattccagcttatccatcctctgttctacttagtatcatcttgccttcctgactacccgctctactgatgttaggctccaaccccaagcacaaaacagctttatacagactttaaccagctgctacaaatatataaggtcaaattcttatcataagtttcttatcacatatataagtaggattctgtttcttcgatttaatctcaactgtttcaactgattatgacatagacataataagacaaattgcagcaagtaatggcttgacattttattaaccatgaaaaaataccaacttttcatttatttaaagacaaaaacaacacataaaattcacctctcttaaaacttatggtctgtgtgctttctttctcctgaactcaggtcagtatcactgacaggaagtataactcttagtaataccaggtgcttcctcccagaaaaaagtagaggccaccaaaaatgctgaaatatccctggggcagatttaggtgtcacctgacacacatagagcatttgtgcagagactaaaagattgatctgagaaaccacttcctgggatgaaatgaaagccaggcagagaatcccatacccaaatataatctaaaggggttaaactgagaaaaagaacaccggtgagacaaagggatttaaactggaggaacaaggaaagaaaaagtgagtatatatttgaaggtgagaggtagagcctagaggaatccattgaggcaaaggaagccagctctagctagttgtttttctaatggtccctggtgactaaaaggcaagtcacagccatgattttactattaccattacatttttttcataaagcatctttaaagacactgcagaaatctggggggaaacttcaacaacatgttgatccaaagaacgaactataaacatattacctgtcaactgcaacactaaaatatagatcagttaaactagtcataatgacatgtaaacctcatatatctggacttcagtattttgatcaatatcttgaatgccctaatagtctggctatagattgatatctggcaataaatgattaacttgtaatgtatgaaaatactgtttagctttcataaaatgagtagtagtaatttgaatgtatgatttcaatggattttaaaatatttctaaagaaagaaaaataatgactccaactctttagcaaaaatatcatgagacatataaccaaaacaaaaatgtcttgactctgaataaaaatttttttttcagttttcagctatttcgttcaaatttgtgtctccatattcactgtgctttctgttttggtacaaaaatattttcttaaaattggatgtaataatgatcaacattttgcattgtattttaaatttaatgtagagttacttgacttaattctgtggcaactttttgtgaagtggggtatctttatttatgttcctaattttagcaaagttttgtcattacaagcaacctcagtaagtattatatacaaaagtatgtaaacagtttcaataatatgcattctaaaacatatcatttctaatgataaaattttatattctccgatttataatttcacagtcactactaaaaaaacttttgaatattagaaaaaactacattgctcattttggtgaatgaacttagccagaaactcaatttgcaaataatgaaatctaaaataagtgtaaattttattaaatatcatggggaaagaatttgaggtaactgggaagtaaatgtctactaatcttatttttgggtctaaacaatggtaacctagaggtttgcattctcaaaggcatttatgtccaatagatttacataatcccaaaggttctctaaataaaaatttgtgggttctggctctactataacattaatcaagatcaaattaaggatttatggcttataataaagtagttccagtgtctatcacctatttttctaaatagttcatcaactggcttttacactagattaaattccttccctgtagaagaaaacagctcaagtcttaactcctacaatttatatgacaaataaaaatcaatacaagtgttcttgttaatggtcttataagaaaaagccagaatatctggaacaggagacaaaagaactccagggtcaagtctactcatctttggattccagcatcttagacttcccaagaataatggctctcatattaccctcttaccttctgaactgcaatctttcttgaattatgagcctaactgtgcatggcagaagtgtttctttaacaatcctaactttatcacactgaaacactacgagacagtgcaataaacccatcttcatagctttaaatattactataatctaagaagtacaaatgttagggaatttcatagatattggaaatgaatcatctgtttaaaccctatcactttttatttgaggaaattaaagatcttcaaaacataaacactgagcccaaagtcataggcctaaagagaaaatttaaactagaacatagacacgtgatttgtagctaatattatcatccagttggacgtatgagcataggaatttagagcagaaagacagtctaattctatccctttattttatagacaagcaaactgggctataatgatttcaaatttgcttaacggagtgaaattatccatagggtttgtgaaatcaaatgctgaaagcccaaaaaatgcttccttctgttttgatatataagcagaaagcactgccttaatctatattctttcagaatctttttttctggcagtagttatgacttttctgtactttgaggcccaaatagctttgtttcaaaacaaagtgcattttcaaaagcaattttctaatatcaaaataataatacaatcagccaaaacactcactaaatcaggcactctaccaggttctcttctaggtataggacaagacaaacaactaaagcagtttcattctagaaagacagacagacaagctgagacctagctaccaagcaggcaagcagataaataaatataagattattttaagtattaataaatgtgatggccaaaattcaaaactcaacattgagtgagactatgtcctaatcagaatgattcaataactaaaaaaaatagtttattcctagcaagtgtcttgtaaagagggagttccaggaagagaaatttctgtgccaattcatacagactactaaaaatcgctagaggagctatattgctttggtttatttgttaaagtaccaaagtgttttcaacagcgtgggaaccaatgaagtaagagtgaataaaacactttaatttgaagcaaaacattctctttctctctctctctctctctctccctctccctctctctctctctctcacacacacacacacacacacacacatacacacacaactcacaaacaagcacagaaaaccaaatattttagatcactgtggctgctataataaaataccataaactgggtggcttgtaaaccacagaaaattatttcatagtgctctgaggctgggaagtccaagatcaaagagccacaaattcagtttctggcgagattcactttctgattcagtgagggctccttctttctgtgtcctcacatggctaaggtttggggggtggagttagcactctggggtctttcttagaaaggctcaattcgtaatcccctcccaaagatccacctcataataccatcaccttgagcgttaggattttgacacataaatttggagggtggcacaagcacaaatggatcatagtagcaaatgtgaagaaagtgaggagggtgaggaacctcatcccacaagacatgctacaagaaactctgagtttcattaaatcagtgactaataagaatatctaacgatctaataattggtcttattccttcaccagattctagggaagacatctaggatatcgcacaattttcctgtttcctaatttctaaggcatattttcatttttttttacttaaatctacaaattattcaaatctaaacatttttattaaaagtaacataggtctactttagaaatttttaaaaaatacgaagatgtataggaaatgaaatatttaaaaagcatgactatctcgtctcattactagagctgtctcctaattgattttcttacttttcactgtggccttctcctccagcttaggatccactgcacagtgatgctgaccactctaaaatgcagatatgatgacggtactccttgacttaaaatattgacatgacccaactccttattctcactgtgttcaaggaatccagatttgcagtagtttagaaggccgtgcatgttcctacccctgctcaactctcccacttgatttgttttgactcattctgggccctctgaggctttatgccacccatttctccaaggaaacattttctttaattgcaagactcatgagcattctgtgtcctatacctaaagtacatagaggcaggcaccacccttttcaccaaacaaatcagacacccttacatgaccaaatgagacatagcttcagccaatatgagtttgatgtttctcttatattcctttgaaagactctgttggttttctccacttcattgctttatattatgattatttgtaagtaccttctacatgccagtcattgctctagagggaaaagaaggaagcaaaacacacaaaacagccactcagcagcattctacattctaataaggagaagcagacaataaataatacaatttatagatatcacacgaacagatgttaaaaagtccaataaagactggttaggggaaaaagatttctagggaattctcgtttatatcaagtgatcaaagagaaacccaatgagataggacatcagaacagagattggaaaaagtaaaggagcaaaccatgtgaatttctagaaggaatattttccacgctgagggaaaacaaagtgaaaagactgagaggtttccacaatccctgtgttttcaaaggtcaacaagaatgccagtgttggagttgagagaaaaaggagaacatttgaaaatgaggctttccatctgggattctcaaatgctattttaaatccaatatttctttgatgtaacggggtaacctggacattctaggatatttagcaacatccgtggactccattcactggatggtagcaacatccacagccccccaactccctacccccattgccacccagtaatgatcatcaaaaattatcacattttccctgggggagcaaaatcagccagcaattgaaaactgctgttctagaggtagcaaaaacaagattgtgcgaagtgttatgcgccatattcaaatatttgcctttaccttgagtaaaacgtatgccaatgtaagacactcagcacagaattaacatgaacttcagttatgaaaatcattcctgcttttgtgttgagaataggctacaggataacaagacagaaatagcacagtaatccaagcaggagataaaagttgttcagatctgtacgacagaagtggaagtgatgagaagtggtcacattctggaaggtcaccagatttcccagcatattgtaatgggtgtgagaaaaagatagcaatcaaggataattccaatgttttgggaacattagacttgctatgaactgagatacagaaggctaaaattggaatgggctctgagagaaagaaaaaaggaaaaaacagtcattaagactaaaaaggtgttgacacggatgtgtttaaaagggaacacttccacactgctggtgggaatgtaaactaggacagttactatggaaaacagggcagaaattccttaaagaactaaaagtagaaataccgtttgatccagcaatcccaccactggttatccacccagaggaaagtaagtcattatacgaaaaagataattgcaaacacaagtttagagcagcacaacttgaaattgcaaaaatatggaaccagcccaaatgtccatcaatcaacaagtggataaagaaactatggtgtatatataatactactcagccataaaaacgaatgaattaatagcatttgcagcaacctggatggaattggagaccactattctaagtgaagtaacacaggaatggaaaaccaaacatcgtatgttcttactcataagtggaagctaagttatgaggatacaaaggcataagaatgatacaatgtactttggggatttagggggaagtgtgggaagggagtgagggataaaaggctataaattgggttcagtggatactgctcaggtgagggttgcaccaaaatctcacaaatcacccctaaagaacatactcacgcaaccatataccacttgttattcaaaaacctatggaaataaaaaacttaaaaattaaaattaaaaaggtgtgctacagagaaggaggaaaaccaaatgagtgttgtatccagggaggcaaacgatgaaagagtattagggagtagagaataaataactccaccaaatccttctgacaaataagaggaaaactgggaatggcattggacttaacaatatgaaggttacttttgtcaatgctaagaggatttttgatggagcgatgggtgcaaaagccaaaatggagtgcattaaaaccgactttcccctagtgttctattattggaatgctaaggatgtgggagttattcatatcctactgctcaagatcatcgctgaggtctgggaaggggaggggagtggaggggagggaaggagaggagagtggaggggaggggaggggaggggaggggagaggagaggagaggagaggggaggggaggggagacgacaggagaggagaagagaggagaggggaggggaggggagacgagaggagaggataggaggggaggggaggggagacgagaggagaggagaagagaggagaggggaggggaggggagacgagaggagaggagaggagaggaggggaggggaggggaggggaggggagaggagaggagaggagaggagaggagaggagaggagaggagctatatttgacaaattacctaactacaccctaagcaaatgttttgaatccttgaaggcagagatgttcattggcattttttcctttgtaactatacaataatgcttggaagagagtaggtgctccgtaaataagtatagcctttgaagatatcccataattcctattttataaaaatatatgccgtagaaatagtcacagaaatgtttatagttgtacgttgaattctcagtgttttacaattttagtattttggcaacaaggccagccacaaattatatcaagatcatttaattggtgtcatatcatcttaaataagagcacaaaacatagagaaattattttctaatcagttgtaacttggtaaactatctcgaaattattattcagaaagatgagaaaaagaccaggaaacccaaggaaacacaagtgagaatacgtagagactaacgggaaagaataaacatgtaaaagatgaaaaaaatgaactaaaggatggaaaacaaatgagttatttagaagaaagttatggcaaaatcagaataactgaagccgtgaataaatttaagacaagtagagtgacagcaggaatacttccaatatatctaataatcaggaacacattgaaaatgaaggaacagttgccttggacaaaaaaaaaaaaaaaaaaaaagcttacctttgaagatttggccatcttagaatcatatgtctggattactgaagtggaggaactagcatgctagaagtatacttcaggataattcatatccccttatatttagtcatgatatatacttgaatctgaacctgagtataagatttttttaaacaacttaagactaaaataataaagtaatgctgttatgcatataaaaaatgaaatgttatagcaattgcatttagtttgttggtttctcagggaactatagacaagtacagaaaaacgctttgattcttaatttgtaatatgtgctgattattattttattcaattttactaatatgctgtaattaaaccaacagcaaacctaagtatactatttatgattccacctttttggaagagggcttagtcgtgtggacttaggataagtcatggcaaagaaatggaattgtgccacacagttgtatcatcaaatgcaattttcaaagtacacagtaaatcacatacctgaattttgttctcaaatactgggcagaacagcactatcaaacacaagagtcacagaaacaactccacacagtccacagatgtaaataggaataagagtcatattaaaatctcatgccctattcaggcctttggctatgaagttaacccccaaatcacctactatttgtatctcagtatggccatactattcttactttctattctatatgcactaacacttataaaaataatttttaattaaaaatagctgtccttgtgaaaggcatctatttctgttttaaaaaatcaactcctagtgctgatgactgaagtaagaaaatagttaaatctgagaaagtgatgatgtttaggtggaaaacatcctagggttaaaacaatacaatgaaatattatattctacagtggtttcaattaataatctaaatgaactcattttttctgacctatacagagacaaacaagaaagtttataaaacatcagtacttttggggaaaactttatgctacatgaattcttgtttgtttgtttgttttgagatggagtctcgctctgttgcccaagctggagtccagtagcgtgatctcagctcactgcaacctctacctcccaggttccagcagttctcctgcctcagcctcctgagtagctgggattacaggtgcacaccaccacccccagctgattattattttttttttttttttttttttttttgtatttttagtagagacaggatttcaccatgttggccagactggtctcaaacttctaacctcaagtgatctgcccaccacatgaattcttaaaggtgtgtcttaagaaactgtcagagttctactgtaccaacaatttccaaggagtattaatcattgaggttaaagaatgtgcctacatattcaattgagcttatttagaaacgcctgttttcagaacaatgatctccacatgctataaggactgtgtggaattgtttctgagaatcccgtgtttgattagtgctcttctgcccaatatgtgagaacacaattcaggtatgtgatttgctgactacttggaaaattacattttgatagtgcaactctgcaggcaatcccatttcttttctagagtgcttccataataaatatgttctggtgtttcactaactctcataggtgtcatttctatcactacatttgtgtttctaagattgagctattgaagtagtgtttacactacttcttccacatggtttcctatctaatatgaatgataactgaagtagctatgtctacaatagatcattgacattttttctcccaaaggattatctgtttgagtttttcaaaatgatgttttctgaatccacacctgatactgcctgggtaacaacttaattcacagtacaccaagagaatgtctccctttttgtatctccaactgtatttgcttcactttaaagtagtatcgtgttttgtattattattattttaatttaatgaaagaataagaaatcattaaagtttgaataaattaaaatattcaggtgccatacacttatattgctcctggataagaaaaataatgtttaaagttttttatgccaatgcaaagaaggagaaggaaagttacatgttaggagaatctgttctgtctgtggttgttaaccctctcaataaagctacaaggtagcattagtttcttcatttcaccaaaagtcacaaggctaagtacctagtatatggaaaatttcaaactcaaagtggaatttgaaataatgttcctatggttccaaaggctgtcacttttttagtatgctgtattcttttctatacaactatttcactttcattataagaaaattcagcctgaagtacatacgttaacttatccatttaaacacattatcacataattttttgtatctgaaaaaaaaatgtagcccatataatactgagaatgaagatttaaagaatgcctttctgaatccaataaccagaatattgaatattcactaaaaatcccagtaagcctgttttataggtgaaaactcttgtagcatgttggcatggtttactttcagaactattcttcacaaggaatgcttgaatgacacaaataatactaatattagtacacaggtattaatactattaataatgttaatatatcattttatataagctttacattaataatattagtactgatgcactaatgttaataatataacaagtagttaagtacaaacaatctcaaatgatcttgaactcttgctacagaggtaatatgataaattctggcctttaccgtgttgtcatggggaacttactggctttcaatatgaagcaactctgagtttttaattatctcatttacaaaggaagatttacaatgaagttatgatcatatatttgtggacactttctaaaactaagaaatattaaattcaatgaagattactgtcactttctatgccaatctctatctctaccaccaccctacaaaaatacatataattatactataatattgaggctacaggcatgtttgataattgggttaaggtacaactgtattggtgatatattttgtttggttgagtgaatcaggctaggggcagaatataggtttctgatacataggacaaacatcttttttctattctatctcacttttcaaacatgtttggtaaattttatcaaaattatactggtaggtcaagtaggaaatagcagtcagacaatatatacttatctttttaaatagtttccccatgttagagcttcccattctctatattttatggaaagtttttgttattcccaacggtgatgaggtgagcagtgtttgtattttgaaatatgaggttagactaggcaaaacgattaggtcagtggtagttttactgaaggcagaaaaaaatctaaaaaattataaatatgtattcagctgagacctcatcagaatgatatattgttagttgtaaagatatgatactttataaaaaagacattgatcatcttgtgaaacaaatgaacttaaattgccatctagtttattgctggagagataatttctttgacattagtttaactttcatgctccatttatacttataaaagcttttaagagaccaaaacagattctcattgtctacctaaacgcagtgatattggcaacaattatgctcttctaaaatgaacagtcaaaaagatatgcaattaatatggattttaacaaagatattggcaaatgtattttttaaaaacaaaaatctcattaccttaacgattgtattgagcaattcactttccaagatgtcatatatttgagattacctattcttagcacagttcttccagtctacctcagaaataaaataaaaactttttatcttattttctaaaatctgtattattcttgtgactgttatctgctcaagattacatcattttttctgcataaaagccagtttccagtaagtatacggaacttagtattaaagctagtcatttcacattacatttgaattatgcttaatttctaaagtatttcaacatattatctctcttgatattataaatatatcaagggttagctcagattgttatcactctacaatggcagaatcacgactccaagtttttattgtctggtcatgtttactattttcacaattgcaaataatgcctcaaatactagtagatttgcacatacattacagaaacaactatgataaagactgggacgaattggaataattctaatgctgtaagttttaaataataaaatttgttattttattataaaaacaaaggagtctttcttacatatagagtattgttatgaacacagactgatacacaattaaaatatgcaattttataactaaataggtacatcatcaaggcaactatagtgttccctttgagtgaagagaaaaagaaggaaaaacgcatttaaaacattgcctgtaggtgtctttgttacttaaaagtttcaagagccttcctaatagcatgcttccaagatactcaaagaatttcttaattaaaattgtattgatgtattctatctgcagagataattaaatacaacactagttttctcttgcaaaaacacatttgtcttgccaagaaagtaattgagaaatagagtcgagtgactcaaccttgatacggaaacttttgccagaaaagtttcttctgttaagaaaagtctgaggattagccactgctatatagtttgatctaatttctttttgtcttaattgaatgtgaaaaataatggcataataaaacaaatgcatatttctccccattagttcacgacatacaaaagaagttaagccaagtcagattttgaagtcaactgagagccgatgccttattcaccggtagcattcatctgtttcatcatgatgctctctttctctgtttttctgtttcatcatgatgctctctttctctgttttgaacagtcactgaactattaagttggactttttcattttaaaatacaagttactctctcatgcctgcatcccaatgataattattgctctgaaggagcagttccaattaaaagatgtgctgttcattcattatcgctgagttactgtgataacatcccagttactggagcttacagttgcaaggttacaatagaaaacagtggaaaggaaattctagggaacccatcagcccagatttacgcaaaaaatgtatttattgctacgcaatatataatatcctttaaatccttaaacccaaacaaagatttagaaaaaaaatatgattttgttagagagcacagcacattgactcaaattttcaaaagccttactatctcagcaccaaataacttcagatgaagttaaagaaggctatctaagagcaaatatgatccaaaggcttcattctgatgccttagtgagaaaaaaagcaggaactcaacctctacccaggccctaagcacttcagaatactgacagtggttgaggtatttgaggatagaggtccaagaaagaaccatccagtcgtgaggaagatgacctccatccagtaagtgagcaaattcccacctccaagagtttacaggttcagcatttgtgacatgtcccagtggaaacgtgaaaaatataaagttgtgaaacattcttacagtgcagtgactttcagaatgacaattaggacctcaaaaatctgcttatctgtaatgcaatgatagagcacttgcaaaaactgtctaaattacctttttttgaaattccagaagttaacccaaaacttccatcactctgcagggaatttcttcaaggaaaatagctgaacctcagtaaaaaacagaaaggcttgtaccattttattttatttatttatttatttatttatttatttttattttattttatttttttttttctgagaagagtttcactcttgctgcccaggctggagtgcaatggcacaatctccggttcactgcaacctctgcctcctgggttcaaacaattctcctgcctcagcctccctagcagctaggattacaggcatgtgccaccacacccagctaattgtgtatttttggtagagacggggtttctccatgttggtcagggtggtctcaaactcccaacctcaggtgatctgcccgcttcggtctcccaaagtgctgggattacaggcatgagccaccgccctccgctggcttgtaccattttaacctgccctattctcatctcatttttgtcggttccacaataaccttgaacaccagcagcttcacagccatggtagtgaaaccaagcagcccagtagctactagaaacagttaactggatttggatctcctcacaatgcttgtccccacatatataatctgtctggcagctccttgggaaatctccattagcaaggcttttctttatttcacctcatccagtgttcaacaggaaaagtcttgtctccagaacatttgttgaaactaattgcctaacatggcaactgcctgaggccaagataacaattgaggcaaacaagaggttgggcaaaaaggaagatgagaatgagatgttcctagtgggcttggaaaagcttcaatgtattactggggatctagaaggccccatgcatgtgcaaagctgtgcatgtgcccaggaaaacctagaaaggtcctaatctctaagcagaaagtaaaggctgaggcacagctttaaactgcttgaatgctaaaggcatgccctaatacatacagagctcctctgcaaagggtaggatacgttgtttgaagaaaaaatcaatttaagaaaatctctgtcctatcattagctgaccagtaaactaaccaagccatgacttcagtgctgttcatgacagaaaatagagactttgcagaattcatacagcaaagctgctacacgaagaggatcaaaaatatcagatgacaaaaacaacatccctggggaaggtagagaatctgatttccacaattattatattatagaatgtccagttttcaacaaggttataagacacaaagggaaaaaatgtagtcagtaaaaactgtcgctaaggaagcctagatattgtatttactaaacaaacactttaagtcagttattgtaaatatgttgaaagaactaaaagaatccttgtctaaataactaaaggaaagtatgaattgtgtcttagcgaatagagaatatcattaaagacacagaaattatattttaaaaatagctacacagaaattctggagttgaaaattaaaataactaaaatgaaaaattcattggaaggagtcacatcatatttgcattggcaaaagaaatgatttgtgaagttaaaggtagttcattgaaattgcccagtctgaagaagagaaagagaaaagaacgaaggaaaatgaacacaatttcagagatctgtgagataacaccaggtatatcaacatatgcataacaggagccccagaaaagaagggaaagagaaagaggcagaagtaatattttaagaaatactgactgaaaacttcccaaatttgattaaaatgcttgtaagttaaaatgataattgcaagtattcacttcattgatatttgtcctactgcatttctaaaatcttctaaaacacaaagtagacattcctcagctttagtatgcctacctgccatttttagtgcaatggaaaaaaaaaaagaatatacagcagtaaaacattttcgttcactgttaaatcaatcctatttaatcttaattcatttttttcaattgaatatatcttagtgtataattgtcaatttattaacaaaaaatctatcaaaagtattttaatgtatgttattaattttattgaaaacgacttactttaaatatatttttatttgatagattttcacacatataaaattttaattttctgccttacagccctttaaaaacatggaatgggattgcctattttagagggatagtctaagtgacatattaattcattaatttggcctccccaagacttcacaactatatcaattctgaattaggttacttcacaatgggaataattgctcattccacaatcatttattgcatatatactatgtactctgtactaggtactgggatggtaataaaacatccagtatctataaagcactttctatgtgctaaacactgtaaaataagcaatatatattgacatatttaaactttccaagccccctaagaagtaaacactattattatctccattccacggatggtaataatgagtcatagaaagagtaagtaacttgctcaaaatcatacagcacttaagagttaagtcaggatattaatctgggcagtctggctcagagtccaagaccttccttattccactagacactaggagaagactggcatcaatgtgttagttgcaattaagtccagttaattcagttgtggaggtaagtacttcacactagaagagcacatgggtgggacctcctaacttaccttctaacatgaagttaggtttctctacaaattgatatctagactaatatatttgatgactattaagttaatattagtattaaaggataaagtacccttggcacttgcaagtaaacaaataactatattagaattaattacactattacctacttaatttcattattcactaaatggctctaaggctgaaagtgtttctgatcctttatcttgataaaggacactttaagaggctgcggagatatcacaggcagaggaaatacaatggcaaatatccggatgcaagggagaagattagagccatgagaagtcatgaagaacttctaagaagtttagtaaattagattgcattctatactcaaaattgggagaaatgaagccatcagatttagagacaaaagactgagggtattttgccaacaggtttatgaaaaaatgctcaacatcactaatcatcagggaagtccaaattaaatccacaatgaaatgtcacctcacacctgttagaatggctgtcatcaaatagatgaaagataagcattagcaaggatatggagagaagctgttgatgggaatgtaagttactacagacattatggaaaacacttttaagaagcatgttctcactcataggtgggaattgaacaatgagaacacatggacacaggaaggggaacatcacacaccggggactgttgtggggtggggggagtggggagggatagcattaggagatatacctaatgctaaatgatgagttaatgggtgcagcacaccaacatggcacatgtattcatatgtaacaaacctgcacattgtgcacatgtatcctaaaacttaaagtataataaaaaaaaaaagaactaatcaacaggcgacatgtcattaaaaaaaaagaaagagaagtttttcgaaagccagaaatggaattactatatgatccagcaatctcaattcttggaatatgtgtaaagaaatttaaatcagtgtgaaagaaatatttgtactcctatgctcattgcaacattattcagagttgcaaaatacagaatcaacccaaatgtccatagaatacttttccatagaatagataaagaaaatgtgctacatacatacaatggaatactattcagccttaaaaaggaaatttttgtcatttgcagcaatatggatgaaactggaggacattatgataagcgaaattagcccagcacagaaagaaaaactatgtgatctcatttataagtgaaatgtaaccaagtcaaagttacagaagtaaagagtataatcgtggttactagagtctaggggtgggagggtggtgaggatgggaaatgaggagatgctggttaaaaggtataaaatttcaggtggacaagaggaataattttttgaaatctattacagaatacagtgaccacaattggtaataatgtatcatatagttcacaattgctaaaacagtgattttaagtgttctcactacaaaaaaatttgtgaggtgatggatatattaattaccttgatacgataattccacgaggcacacatatatcagaacttcacattctaccctgtaaatgtatacgatcattatttgacaatttattttttgaaaggcagaaagccttttgtaggttagcttaataagtttaaatttgtgctaagtgcaataagtaatgaacgaggtataagggaagcaattttcagatttggattttaagacaactcactctgattgcaatgtgaagaataagctggagaggaacaaacggaagagagaaaacacttaggagcctgttatatgtgacacagacaatgacaatttgaaagatgatgcaacactgtgaaatgtgaaagatggtgtcacagatgtgaaatgtgaaagatgatgatgtaaaatggtgatttgggacatttttggaagactatttggttaagtgatgtggagcatggaagcacaggaaggaatcaggcataattcccaagtttccttaactaatctcagaaatccctttttataaatgtgcttcaacatttcactatgctgttgcaaatgctcaatatatatgagggatacacttatagaagaaaaaacaaactcatgcaataaatccctttcagaaatctatatcaaagtaacactttcttaccttttgaaccagtatattccattttattacctaataagagcaagtcaaatgcaagtcatgtatcccttgttgcactggaagtcaaaaggctccaggacaagttttgctttcaattctattaacgtttttttttttttggcttagttttcttgtataactaacttctcccatcccttaggctttgtcatgtacctataattttttgattttgtttttgtgatatgtaaatgttaaatgggtgttataaatgaactaatactaatgcatttttgacaatctaattaggacagagaagattaatgtacttagaatactgtactaataaaattaatgcaaagtgtgtataaaattaaagaagaattagaaattagaaaatcactcaaacaaggtagggaattaagacaaagttctttcacataagaccattaatgaatttgtaatatttatacagtccgagctaaataaatttaattgaaacctagtatttaataactatggaaaacaaaaaaataaacaccactagacatacaaacaaataattataaaacaactcaagctttttagattgctaacaggtagagaatgtttggtcaaaatatagtcaatcttttgaacatttaactattaggaatgacttatttttcaaattatatcttaaaatcattatatgcttgcacaaattgaacggacttgggaggtatttacagcttgagattcctagcctttttcactataaatctacaacattaaaaccacttaaaaatccagaattatataacatttacctttatatcaatttaatacaagttataagtagatatgcatattcgaacacatatttcacattcttggaattgtctactataatatttattgacatcccagatgtaccacaatttattatagtcagttgtatattggcacttggaagtaaacaaataactatattagaattaattacactattacctacttaatttcattattcactaaatagctctaaggctgaaagtgtttctgtgtgattaaggaactgattttcaaaaacctatatttcattcattttagcataagttcacttacatcagcagaaaagtcacccatagccaagtacgtaaaacaatgcaaactgatctctggtaaaggaattatctccaattacaataccacttctatgctaacatatgtagttatatggtcattttccaggtgcattcctacttacctcaagggttctgtgcaatgaagtagaaaaagaacagaaagaatttcagagagactcatcagcatcatcacagggatccttgatgaagcagatggaaaatacagcatgaaccctaataaaaatgcttcctgtgccaatcctgagaccacagtgactgtggaacctgaattaacatatgtcatgagaggaaaggaagctgaacaaagagcacagtgaagtgacttggcctgacctcatttccttacctcatgaggacttcgtctgaaaggtgagcccagcgcagctgtgcatagccaatccttgggaaacacagaaaaaggaaggagccacattccacacaagcccagtgacactagactctcaggaatttcttgagtcaaatcaactgttcccccactttaaggaaaaggtgattcgggaagacgagaaggctctctgatactgcctttctctttgggtgacttcctttggtcagtcttcaccctgatccagcaataccttccggacatgtcagatagggctcactggcctttgatacagttcaatactgctattccatttactataaattaacaggaagaaggtgaaggagtacaagagcccggcttatctgcagaagatgtgttctaagatcaccagtggatgcctgaaactgcagatagtactgaatcctgtgtacagtgttttttttctatactatatgcctataataaagtttaatttatacattagacatagtactcttgcactttggggctatcattaagtaagataagggctacttgaacaccacaacagtccatgtgataactgagatgactcttagtggctaacggatgggtagcatagacagtgcggatgcactgcacaaagcgtgttgaagcacccaaatgagatttcatcaagctactccgatcagcacacaatttaaaacttatgaatcgtttatttctaaaatttttcacttaagatttttggaccatgatggtccatggataactgaaactgcagaaagcaaaaccgtggataaagggggaatactgtaatttaaaataaaatgcaagctttctgcttaggaagtgtgagcaggatattcctgccctttataggtgacgtgagtgcgtgttctttacaatactgctgtaagagtacgtggaacttaattttcacttcctaaatatcctttctcctgtcctacaaattacaaccagagccactaaaagaagtaatacaattggagaggtataatctatagtaatcagtgtcaacagaagcagtgagaaaaaataataataatctacagtaatacagttagctcttgccaggaaatgaatcagaaggtatttatatttctatggttttggaaaacaaattcgctcattagagaaagtaaagtcattattcacactgtcctcaaacaaaatgaagtttcacttgattcttacttgttttttaatgtatttccataaactctcatgtttcatatttttttgttgctaatatattactgattttttcctcttagaaataagaaagtattgctctgtgatgtaggggtggagggggagatattttcatacctcagccccacctccacacctaccttggtgcaagcctagggagttagccaggtctggagaagctattaatcatgttaatatcattttgggacaatttcaccatggaaaaagatatacctcagccctaaagaaagattaatgtaacataagaaatttaatattagcataacaaatatgtattcaaattctctttgtcctgcattattgagcctcgtatctgtgttactgctctaaatgacacagcagtcaacctgctattccctctagcacccaaacctctctgtcatatgctctggtgggatttttctgatataatacaattgtaatactgaaagtaaaaaattacctttgctttctccctccctctccttgaccttagccaaaagaattcctaaatagttctgttctgcacaaatccaaccctatgattacttcttatctggctaacaaatacagttataagccatggagatggtgtcaataaataattgcaaaggaaagcagaattacctcctctcataatcacattcatgaaattttatactttgtcctactaagccataaaccaaataactaagaggttgtcacattaattgttctatatgaaactattaaaattccaaacttaatattcttactttatatgagaaaaaacaaaaaatgtgcaaagaagtagaaagagtgagaaataaaatgctcaattgaatagtacatcaaaatcattcatagaacactacatccatacaggtagcagaaggcagtgaaacaatttttaaatgaagagtatataaagctcatttgtctaatataaaaagagttcatggtttctcaaataagtttataaatgtctgtcacagaagtgactggatgttgtttcccaaatgaatttgctaccactgctgtgattacacagtgattttttttgaagtaggctgcagttcttattatgccaattcattatgaatgaaaggataagaaaaccattaccatcgtgagtttaccaaataacaaagcagcaggtaaaaataatctctccacctgtcatttccatatcggtcctaacagcattgtctagcttttcaagctgcttgacaaacaaacaatattgcaacttctcattgaggcagacaagacagtatttagaatgaatgcattttctaaccctcacagcaatacactcagaaaatcattagattccaaagtcgtattgtattttgtaatgatttcaaggttatcgaaattttgtaagacctggagaaatgttttcaaccaattatacgcttgcaaataatgttaaataatagtttcacattaaaatttttgagtttatagaaatatgactatttagaaacctgtacatgctttcccctttctaaactaaacaagtgtgggttttctggaagtttttctataacttcaaaacataaaatctctgcccatgaaaaccatcctttaatatcatcagaggaatcaatgaactacaacagatactgttgcattgacaagctcaaattaactgcagattcttatttgtaaaaagagatgagacttatacaagtacaaaatgacatcaattttattgactaaaacattccatcccccagtttactagctctcttatttagtgcataccacaagaaagctctgggtctttgaagatttcattacaccaccataacccatgttttctatttgtttttcaagagaattctaattagcatataaatcatctgaaatccttcgtagctccaatttaactcatgggtaatgaggtaaggtattcagtgcctgaatatgctgcaatagttctgtacaatcttcatagggtgagagaaaagtaccgaaagagacatcaaaattctttcaggaaaaactacatagacccatatttttaaagaattcaacttggcttctttttcccaaatccttggattatgaaacttcagctagtcactcaacaagggaagatgtaattcaaattagtttcaaaaagttgcattcttattatccaaattttatatccagataaacttacgatctaagtgaaaggaccattctgagtatgtcctcaaaaaaacacacactatatcagttgtgcaggcggaaatgacatatttagaaactacaggcccatatcccatttccatagacatttggctctgaaatattgtggctttacatatacagagagtggatttcatatattcttcctttgttttccatagctctttgatatatagctttcaagttttcctcttcaaagaatggttttatagaaaacagtgtggagtattaattttacagtctatctctacaatgtcacgtatttctaactggaccaatgaatcaaaatatgccttccatccacaatcttcttattgacattctacaaccaccgaaataaggtggtttgtactaaggacactgcttaagaaaagtcccttaaactgagacaagaacagttagcctagccctttaaccctctttctttcttttttttctttttctttctttctttctttttctttctttcttttctttctctctctctctctctctctctctctctctctctctctctctctctctttctctctctttttctttttccctctcaggctggagtgcggtggtacaatcccggctcactgcaacctctgctccctgggttcaatcgattttcctgcctcagcctcccaagtagctgggattacaggtgcctgccaccaagcccagctaattttttatttttagtagagacagggtttcaccatatcagccaggctggtttcgaactcctgacttcaggggatccacccgcctcagcctcccaaagtgctgggattacagtcataagccaccacacatggcccctttcacccttttctataagtttctgaaactgtgaatgtgacttgaggttgttattaacctctttccattaacgcttctaatctccatgaactcaaatctcggatatcattccatagaaatcagaactttgcctcagacctctactttgcatgttggaaatttttaagttgataaaacaacaacagaaaacctgagacaaaacgtaaagatctagtggttagttccttcagtgagaattctttctaccatttagataaggacaatttaatttaaataaataaagaaataaaaataaaggttttgaattttagagctggaagggaattttcttatttgtttcttgctaattttataaatgacaaaaattaaggcccagggagttgaaacaatacctccaatgtcaccaaaaaaggttaaagaaataagtggtatataatccaggtcctttgtcaccttgttaactactactcggaccctattcaatgaccaagatgtggccattaacatctttacataacattgtgaagaagaaaatcattttagagcagcaacttgtacttgaggcattagggaaatttcttgagtaaaaagaggaaaatgcaggtgaggtccctttattaatggaaagttttaaaaaacaaataaagtgactagcagtctagctaatcagcctttctttttctatagtcatcagcttaattttatgctaaactatgactcttagactaccaacagaaaaccgactacacagtgaatttctttattcatttattattttaggatgttcccaaatggccatgatttgaaagaagatcccttctgatgattttcttcgtaatcttttatttttaaggagaaataatttaaaattgttctttgtacagctttttgcctaaaatgaatttcctctgatatacaaaaatacaacaaaatgaatacttacaattagaaaagtatctttattcttattagtctaataagaagagtagaataaaaatgttttatcatcactgctgtgtattagaactggaaagatttggggttcatcagatggaacacttgattggtttctacagaattcaataggaagcctgcatccagcttcgagtgtgctatgacactcatgtcaccttgattgtacagtcaccatggcaatagtttcattagctatgcagtagcctctttgtactcaacttgaatttgttctgcattatgccaccttttatcaaagctgaacattagataaatgagtccaaattttcaatcctgattctaatgttggcaagcctaaaatgttccaaattagttagtaatttaaaaactcaacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcgacagagcgagactccgcctcaaaaaaaaaaaaaaaaaaaactcaataatcttcaaagtaggaatacttgaagataagttgattggtttattgttgaagttaaggtaccatcagaaacatgagtaaaatctgaaacatttgtaaatcttgctttttttccattgtattcaaatatcttcattgttggtaacaatatctagaagtatttccaattcttatttgtattacagggctatttatgttattaaatatatttttaaaatattatgtgtaattattttgttcagatttgtggatattgggatattaattgtacccaagtaaaatctctgatgcctttcttcaggatcatacatctaaactgtatcagagagaaagcacagactctcaaagtttctaatataccctttatactttgttggtttatttacctaagagatattttttccagttttataatttcctggataattcagtgaggcattttgactggggagaattaaatgtctgtacttaaataactatgttaccaaaaaacaaaattcatatagtgcatatgtatacataaaagaaagtaacaagttagtaattgtgaatttttgctgtagattaatggttggtatctgtgtagatatggttcaaaatatagcttacatataaataactgaaaagcttctagtcttgtcaacacctgtacattaacaggaatatcagtttacagagttcatacctacttagtttcagaaagattaacccttaagcagaatagtgagcaaacttactccatggatatcaacattctacagcaatgggaataaaataaatcatcactccaagttatgtgtggcctgtattcttatatttttcctgggcacgggagttacatatcatgttttcatttctgaaagagattcacaacaaaattattataccacactctagcataaaaaacaggggattctaacttgtaagaatttgtgtcatcctaggatgcattaaatattacggagcttaagcagcatctcaaaagtttactatttttctctgaaaaaaattataaatggtaatactaaaactaatggttgcaattgcaataatgactctcacttttgtagtgatgatgtttaccagactctgtactaagccctttacatgtattaattcatttgacctttacattctattattacttccattttacagatatggtaactgaagtacaaatcgattaattgtcttacccaaggccacatatatgacatgtggtaaaatcagtcttcaaagactgttagaatgcctctagaattcaagctctagaaatggaagcatatttgtttttgatgggttaaatttaaaaaaaaaactgtacaaaaaagcaaaaataaatacctattatttcagctccagaaatgataatatagaacaaaagcttatttatgttcctaccatataatatgtaaaaaggaattcaactcgttcccttgcctgagtaacctacattctcatagtccagcagctttgaacatagttaagtccattattaaggtgattcagatgtaggaaaaaatcacacattgtagaatttttaacctttaaaaaacatgtttaagtagactagaaacactgatgaatctcagatgatattcaactaacactgctatatgaaacaacaagaatatctgagttctggtactgatttgtaatattttaaaccgtgtaacctataccgataaggaactcattttcttcatttacaaaacagtggggttgaacaagatgatctctaatgcccttataaccaaacgtgaatttatcacagctttgtgaaatgacaaatccttaaaaataggtgtgctagtggtcaagacgctgaagccattagagaattattggcagaataaagacagagttgtggccttaccagggtggcataaggcctgagtccactcaaagttccaagttattaatttaccaagaaaagcaacctcattaatgtaacaccatctgttcagtgctgctttgtttctggtttgtgctttgtggtcttcacatagagcttcttgttctgacttgtccctttacctttggatttgaactttacccctttcgatcccttgtgaaatgactctgaccagaagcgatcccaactcctgcatcattatttggcctgaaggaatcacttagctttacacacaggcacagcttccttgctactggatcaataacctaatttcaatatcttctctctggtattccgggattagaaatactactgcttgtttgggcggatttatttggctttcttctaatacaactatttatattttcatgtacagccatttcaatgactgtctttccatcatgcttgtttaatgtgattgcattgtaattataacagttggaataaaatgagttgaacaaaaaagactagtataatctgaagagacttatatccataaattctttgtcaaaaatattaaagaaagtaaactcccctactattttttttcatttaggtaatccccacatatgttcccttctctcggaccctttcatgggatctctgatatcaagactgtttttataatgatatcaaaaaatgaattgccttcttaaatatgtttccatttgcactgatgatgcaaaataatagtaggtaaaactgttggagcttcagcaacatccaggttgaagcagggcattaagctgttgtagtaatcatttattcttcatgtccacacacagaaaaaaagaaaaaagtcaatttcactcaagaatatcgatggtgatattcatcagtaagatattagtgttttattaagtctcaacacttaagcacacatctttttaatattcagtgtgataaaatgggaagcaggtataaagcattcctgctgcatctgatgttcaagtatgatgattgtctccagaaaaacactcagataacactaagttgcaaactgaaactgccacttttccatagaaaaatatttttacttgcaaaaaaccactcaccaatacaaactgtggttattcaaattgcatatctagcagacattttcttgaaaagaaagtaagcctgacactcatatcagtcacctgagtttgacagcttcccaatacttaaaagacccttctgatgagatggatagtgatttaaaagatgtggcttaaaaatgatacattatataataaaatgtgtcaacaattagaagatgcatagctccatggaccaatactttccaaatgtttaatgcatgatgttacaaaatcatccagaagtaaaaagagccattcaaagtgcaagatgaaccgatagattttaacgtaacaaaatacaacaatatcattgatgtgctttcttatttcacattacaacaaatcttcaagaaactacatgtgcagaattgtgaagtagtatcaaataacaatatccagagttaatctaaaagtctatagaaatatttttcctttagtttcatacctctgtgaaggcaaattttcttcatatattttaaccaaaacaacatatttcaacagattgaatacagaaacagatatgagaattctactaacttctatcaagctttatattaaagagatttttcacacatgcaaagcaatgtcactgttctcactattttttgttttggaaatacagttattttcattgaaagcatgttatttacagtaacatttaatagatttttcattaattttacttgaattaataaagtgctccgtttaaatttctgattacttattttttaaagtacttagattatgtttctgagtgtttactgatagatattacccacatgactgagagttctttgggatcctcgttcattttctttaagaatgtaaagattcctgagatttaaaacagaataatgttttggaacctcagtcctcactattcctatcccttacaacctcacctcctaatgcctttcttccccaattgtcaagacttggtgatccaagtattccaaatagatttccactgcaggacctttgcacttgctgttctgtctttatagagtctcctacttgcagatagtcctatatctgcccggctcatgactcctctcatgcaaagctctgcttaaatacctcctcatccaaaaggcttttactaactaccacttttaaaacagaacctcccactccatgactctctactccttacctagtattatttgaggtcatgtactaatcccatccagaaattttattatattgttatttatctattgtctgtctttcccactagaatgtaagcaccatcagagcaatctgctttactttttcactgcttcctacctggaatataatttgtgctctatcaatagtaatttaaacaatgtaaaaatatggtgtctatatttatttaatttgaaggacgattatgctaaataggtttctcttaaacgagaaagtctggaaatctatatttaaatatgagagtggcaactatagaatgctccctcccaaaagggcttgtgtctgtcacaagaaacagcaaaacttggagcacaatgaaccttcctaggttgcagaaaagtttctaagtcaagtcttgactttctcactactaaaacagtggttactcatgcttactggggccaataataacggattgaaaataatacatttctatactatagcatggtatatagtacaaaaaaaaaagaaaaactttaaaccttcaagttaggtagaagcaggtatgtattctaggtctgactcacttctttgtaaccttgagaggaatgcttaaccttacagggaaatatgctttaattgatacgcagtttcaaatatccattagaagtttgtagtcatgaaagcaaagtactcctacttagctcagatatatacttttactttagtgacagtgatacaaacgaagaaaatcactttcttttattggtccaattttgcatttctgaaaaacttcctattgactattttcattattttcttaatgtatgaatgagttttattttctaatatgtctttgaacactttctgtcaatggtaaataactatgtaatattggattataggtttttgttttctcttaatcattttaaccacagcctggcataaattaggtgctattggaatttcaaagcatttttttctgtttaaagttgattttaccttcccagtttatatttctaggagggatggatatcttggtctttgtgttaaaatttaaacagttttaaagttcagaatggaaatacataagactatgtaagtcaaaaaatataaaggatagagcttccctctgattaattccttactaactggcatgtttgttctttatgtgtaggagtaattgctgtcactggaggattttttcttcttaagagggaaagatacaacttcaagttggtggatggaagatctatgaataatgccaaacacatctgcaccttctttcttccatggtagtttcaataggcatgaagaaaaacagcaaaacagcacttccttcctgagtttgtaaaattccctacctcctatctattgctcaatacggctcagtcccacagtctatgagtcacaaccactgagtagggaaaatgattgaaataattatttaaaaataattcttccattcagccagctaagatcttactttaaaatgctaatggcaccaagaaaaaaagtaatatgacctactttttaatatatctatactattgttagcaggcaagaataaaatcaccctctttcaaggaaaagtaaccaataaaaaccataagaacatgggaactataaaatattctgcagtatacactaataacagtatgttagaactgaaatattagtttacttaaacttgtcaagatataatcaggaataatgaagtaatgactcccaaagattctttcctccaaaaatacaatgagaagactcataaaaattctccaaatcaactttttcaaaactctagaaattaaccaaaagctcgtacccatatttggagcatttcttcaagaaaagagactaaatcttggaaagaacagataactttgtgatattttaaattatgctcttcccattccctcttcccagtctgtggtagcctggaaaatccacagccatcaatttttgtgaaaaccagtagcctagtagccgctaagggtcagaacagggctgatgctctttcaaatccctattctcaaacaatttcaataattttacctgtctggcaggtacataaaaacctactcacaagtcttgtctttattttacctcactcagagttcaccaactggaaacagtctgttccccaagagcatttgctgaaaatgctcagtggcaattgtttaacattgccttacacagtgaaaaaagttgggacaaaaaacaaataaaccaaaaaaacaaaattgtaaaaaggaagatctggaaaatgagatgttcattggaggatttgaaaagttcttaaatattcttgaaaatccagaaggccacacgctatgtacggctgtgtaaacactcagaaaagacctgagaagaccctcagttcttgcctctgaacttgaagttctgcacaaggaggaagtgatgggaaagacataattataaattgcctggctgaatgttaacagcattctgtaacactcacagaaagcccttcaccaagattaggagaaaacgtttctagagatttaaggaaatctgtcttgtcactagctcacaagtaagctaattgagcagagacttaagaggtgatacatgacaaggaatatgacattaaagaattagttcaagatagtctttaacaaaaaagtgggaatagtaacaacaaacacctaagacaaaccctagggaagggagaaaaatctgatttccagagttctcaaattgcattataaagatgtgcagttttcaaaaaacaaattagtagacattcaaagaaacaatagagtatggcccatatgaaagtaataaaaaatcactccatagaaactgccctgaagaaatcccatcattaaacatactaaacaaatactttaaatcaactatttaaaacatgttcaaagaactaaaacaaaccatgtataaaacactaaaacgacccatagaaataaggtctcaacaaataaagaacatcaataagaagatataaattattaaaatgaataattttggagtgaaaaagttaccaaattggctcaacagcatattttaagaggcaaaagaaccaacaaacttacaaagtagtcagtctaaggaaaaaaggaaaaagattggagaaaagtgaacagagccttacagacctgtgagataccatcaagctcacctaataagcgtaatgagagtcccagaagcagaagagagatagaaagaggcagaaagaatatttgaagaaataattgtagaaaaattctcatatttctgaaacacatgaatctctatatccaagaagctcaaaaaaccttaaagtgggagaataaactcaagaaatccacactgagataaattataatcaaactgttgaaagccaaagacaatgggagaattttgaaaacagtaaaagaaaagtgactcattatattccaaggtcctcagcaagattaacaattaattttttatcataaaccactgggacagaaggaagtgatatgctatattcaaaggtcaaccaattattctatatttagcagaagtatgtacatttcaagatttacatatactgagaaaatttgttaagagcagatttccctataagaaatcttccagagagtcctttgaagtgcaacggaagtacactagacaataactcaaattcacataaagcaataaagagcattggtaaaggtaaatacagaacataggtaaatacaaaagatattataactgtatattttgtttgcaacaattttttctcctatctgacttaaaagagagttgaacaaaacaatcgtcataaatttgaattgattttaatacaatgcataaatacataatttgcataacaataaagcacagaggaagaggaggaaatacaagcatacaggagcaaaatctgtaaatgttactgaaattaagttggtattaatccaaactagattattataagtaaaaatttgaattgtaattcccagggcaccactaagaaaataactcaaaaatattataaaatataacaagataattaaaatggcaaactagaaatatgaatttaacacaaaagaaagaatttggaaagaatacagaaaccaaaacaacataagaaatacaaagaagaagtagcaaaatgagtggcataagtcctatcagtaattacattaaatgtaaatgggttaaacactcaaatcaaaaggttgagattagcaaaatggataaaataaacacaatggtctcatatactgtatatagagataaactggattcaaagtcacaaataacttgaaagtaaaagaatgaggaaaaaaaataaaatatgcaaaaagtaagcataaaaggcctgaagttgatgtactaataccaaatcaatgcactttaaatcaaaaagtcattgatttacaaaaacaaaggaccgtatacattgataaaagcgtcaattcttcaagaaaatacaacaatttttaacatgtacatccactaaaaacagagcttcaaaatacatgaatcaaatactaaaaaactgaaggaagaaatagacgactcaaaaataatagttggaaatttcaataccctaccttgaataatgggcagaacaactagagaggaaaacaacaaggaaatagaaaacttgagcaacaccataactagacccactagacgtaataggatctacataatacttcctccaataccagaatatacattatttgtaattgcacgtagaacagaatagatcatatgttagaccataaaatatgttattctcaataaattaaaaaggattaaaattatataatgtacattctctaaacataactgaatgaaattttaaattcataaaacatggaaatttgagacattcacaaataaatggaaattaagcaacactgctaaataatcaataagccaaagaataaattaaaagataatttagaaaatattttgaaattaataaatgcaagatatcaaacttacagaattcatctaaaattgcgcatagaagaaaatttgtatgtaaatacctgtactaaaaaaaaaaggtgaaagatctcaaatcaataacttaacctttcaccttcggaaactagaagcatgaagaatagcttaagcccaaagcaggcataaaaaggagataataaagattagagtgtagataaagtaagtagaatatttaaaaaatagacaaaaatcaataaaacaaaaattaatttatttgtattcatcaacaaaatcagcaaatttagctaaacctatgaaagaaaaggagggaactcaaaatattgaaatcaggaatgaataagcagtattacttctgaccttacataaataaaagggattataagtgaatactattaaacaattattttccaagtaaatagtaaatgtagatgaaattaatatattcctaaaaacaaactactgaaaatgacccaagaataaatggaagttatgaatagacataacaagaaaaaaaattagttactaatcaaaaaaaaaaaaaaaaaaaccatcccggaaagagcatcccagaaccaaatggtgaatactactaaatttttaaagaggaattaacccaaaccccaacctttcaaaaaatagaattagtcctcacacattctgaggcctgcattaccctgataccaaaaaaaaaaagatccctagaaaactacagaccaatatatctcattaatataaaagcaaaaatccttgacaaatactagcaaaacatttctcacaacatagaataaaggattatacaacatgaacaaatttataaggaatatgattactgctaaaagttcatctttaaaaacttagctccataattacagtcacttgccaatataaaatttctttcatttacatgctcagctcaaagtaagtttctcagtaattatttttcttatttcatgtctctaagatagaattgatttgataagtagataagatcttaaaggtaagttttaaagtggtattgatataaagactgacaggtttaacgtacccaaaatgcacatgtagcattaaaattttatatcactcaaactttttctttgagaaagaaagctgatgataactaatactgaaaatggtgagacattctgtttgttctatttcacttaaatacattctgatttatgaaaagtgaagaaagtaaagagttttcatgtctttcatcttaagtagggcagcctttctagtttctttaattgcactaagaactaaagataaatgttcacaaaatcaacatgactgatttgctttttcacgaagagacagcttatttagtgcctggaagcaatttttgtgtaatacagtggagatgccatttcttcaaatgagttctttaatgagtctttgtctctcaatttaatagtactttttactttattttccaagatgttcttgtgtcttttgtgcaaaatgctacaaacaccatgtctaccaggagaaattctaagatggccaccttcaataataaaagagggtacctccattttaaaatattattcattaaaaaactgccttttcagtattcaaagaacactcaatttgttttcaaggataagacttaatctattgagtatattatttattgacttttgtaatttcactcaatgttcctaaaacctatgaaagcaatagcttttcattttttcccagacaagtgagtacagattgtttataaagtttaaccgtactttaaactcattttacttttaggtaactacagattgttaaatacagttgacttaaagagatattgatattcaaatacctgaaaggaagcataatcataggtcaggggatgtgtctcatactattaagatgggggaaggtgccacaggaaacagaggctgtgagaataatatacttcattgaaaaattgctcctggcagttttcaataaaaccaattcagaaagtaatgcttcatgttgatgtctgaagtgcaaatgaaatctggtttcatttatttatattaagtagtcatttccctgtattgcacttaattgagctattgttctcttcattaagtatgcctcttgaatttttccattttgaaaaatgctgttgtttcagtcacagtaaatgtgagatggagaaatcaagtatcattttcagggaattcgagatacatgaatgtttgttgatgctttatgcttaagaaaataaggagaaacggccaggcatggtggctcacacctgtaatccccgcactttggaaggccaaggtgggcggatcatctgaggtcaggagttcaagaccagcctggccaacgtggtgaaaccctgtctctaataaaaatacaaaaattagccaggtgtggtggtgggtgcctgtaatcccagctacttgggaggctgaggcaggagaatctcttgaacctggaggcagaggttgctgtgagctgagatcacaccattgcactctagcctgggcaacaagagtgaaactccatcttaaaaaaaagaaaataaggagaaatactaaatattaataatttgtatttgtagaacacccttaaatttctcccaagttctccatattaaaagcgtaatcagtttattagagaatcttgactcttaaaggcataaggcttcattacttcacatgtcattttcatccccatcctaatcatctcctgctcggtggaaggtcccatgacaacgtaaggcattgttctttgagaattttcttctacttgttagttttcggttactaggttctctttcccaacatgcaaccaagtcttacaaaattctaccgatttgtttaagttccttatagatgctggacattagacttttgtcagatgcatggtttacaaatatttactcccattttgtaggttgtctgtttaccctattaatagtttcttttgctgtgcagaagctctttagtttaattagatcccatttgtcaattttcatttctgttgcaattgcttttgacatctttggcatgaaatctttgctagttcctatgtccagaacggtatttactaggttatcttccagagtttttatagtttgggggtttatgtttatgtctttaatccatcttgagttgaattttgtatatggtgcaaggaaaaggttaattttccatcttctgcatatgactagccaattatcccagcacctcttattgaatagggagtcctttccccattgtttgtttttgtcagcattgtcaaagatcagatggaggtgtgcagcattatttctaggctttctattctattccaccggtctatgtgtctgtttttgtaccagtaccgtgatgttttggtagccctgcagtatagtttgaagtcgggtaatgtgatgcatccagctttgttctttttgcttaggattgccttggctgttcggtctcttttttggttccacacgaattttaaaataattttttctagttctttttttttcagtatccagaactgtgagatgtttttcctagttctgagaagaatgtcattggtaatttcataggaatagcattgaatgtataaattgctttgggcagtagggccaatttaatgatactgattcttcccatccatgaacatgaaatgtttttccatttgtttgtgtcatctctgatttctttgagcagaattttgtaattctcattgcagagatcttttacgttcctggttagctgtattcctaagtatttcatttgttttgtggcagacccattaaaaagggggcaaaggacgtgaagagatatttttcaaaagaaggcatgcatatggccagcaagtatacggaaaaaaagatcaatatcactaatcattagataaatgcaaattgaaaccaaaatgagataacatctcacagtcagaatggctgttatcaaaacatcaaaaaaataacagatgctggcaaggttgcagagaaaaaaaattacttatacactgttggtgggagtgttaattagttcaaccatgttggaaagtggtgtggctaaaaacggaactaccattcaacccagcaatctcattcctgggtatataaccaaagcagtataaatcgttctacataaagacaaatgcatgcatatgttcacagcaacactattcacaatagcaaacgtatggaatcaacctaaatactcacgaatatcagactggataaagaaaatgtggtacatatacacaccggaatactatgcagccatgaaaaagaatgagatcatgtcctttgcagcaataaggatggagctggaagccattattcttggggagctaatatctggaaaaccaaatactacattttcttcctgataaatgggagataaaagattggaacacatggacacaaaaaggggaacagcagacactggggcctattagagggtggatacttggggaaggaagaggatcagtaaaaataactaagcttagtacccgagtgacataataatctgtacaccaatcccctgagtcatgagtttacctatataacaaatctgcatatgtatccataaacctaaaatagagttaaaaaatagaaaaaaataaaattctaaaaattctagcaaaccctattgtccccaccaaaaaaaaaaaagttaaagaaatattggacaatctttatcaagaggctaggaaatggaaaattaaaatgtaatagtagaacttattgctattgttatccagcaagtttttttttcaaagttgtcaactgtaattaccatagattccatggaaaaaccatatcattcttgaatactgccaaaattatatgcaaagagtaagcctctttcccaagtaaataagtaagtgaagatattttaacagctataaaactaacatcactgtggtcagtcagggatcttgggggagacaaaacttgcaaaccttggctgacatatgtagggaagttgttcatttaaaagctatccaaccctggcaccagagacccctctcatatcacagaatcatagacaaatgacctaggctcagccaactgcatatccaacagtttgaatttttgaggaacaatgcagttacaaagccatttggaactatttacactagtcatgatagaacgtaaaaccctgcatcaatattgagccctctcagaggaacagtcagtggtgggagttctactggctgcatcctgaagcttcccttggttcttaagcatgatgagctaatctttctgtgtattatatgagtaccaaatatgctttaaatacatttcatttccatgtaaaatctcaaaatttgatttatattgatttcccacaatcaatgtcccccactgatacagtggtgctagcattccagggtcagacagctttttaacatctccatgtgcttacagaccaggcataaattgtttcatctccaattcttggtgctttgaaatacattttggcatggttgttgcggcactaaaatttgctacagaatgatgtggctctttcctgtaatctgtaatgtttccagcagagtctcttcaaaaactcccatattcattataccaatgaatactgacattcctatctataaactactccttctcaggagttttacaaatacagtcccctttgtccatgacagtacaaataccaagtgtagtcttactggagtgaaaagttttctgatgctttagtaagcttctaatgtactatgaactaatctaagaccagaaacaaatgcttattgtttagaaatttaaaattaggtgtttttagactatttccagaagtgcgccgaggagcaatagaatgatttctattgctcaaaaatttaggtggactaatagaaactattttgatattagaagttttaatagcatgtttatgtgatctagaattaaaatcccaaaccactaagattccttctaccctaacactattaacatgtagtagaaaacataattattatggagtccttagggtattcaagcagtttaataatatcacatatattcttaaataaattcagcatattccaaagacctgagaagaaattgggatggtgatgtccatgagatgttaaatcagaggatatcttctttttatttttatgcatacataaaagttttacatatttatgaaatacatgtggtatttcgatgcaagcatacaatgtgtcatgataaaatctgggctactgggatatccatcacctcaaacatgtatttcttggccttaggaacattgcaaatatactcctgtagttattttgaaatatataataaattattatctgttattgccctattgtgctaccaaacattagatcttatttcttccatcgaaccctattttggtacccattaaccaaccctctttatccccacctcactacccttctcagccttctctggtaaccatcattctactctctacctccataaaatcaaaatgttagctcccacatatgactgaaaaaatacaacacgtgtctctctgttcttggcttatttcatttaacacaatgttcaacagcatccatgttgctgcaaataacaggatttcattcttctttgtggctgaaaaatattccattatgtatatgtaccacatttgctttatccattcattgatggacatttaggttgattccataccttggctattgtgaatacagttgcaataaacatgggagtgtagatatgtctttgatatactgatttcctttcttttgaatatatactcagcagtatgatactagctgtgcatctgctgtataaggtctttatcatgctgaggtatgtttcttctgtacccagtttgttgagagtttttatcatgaagggatgttgaaagagtttttatcatgaagggatgttgttgaggcctcgctctgccattttctagtgatattactctgggttagtcatatcatcttttacgatctatttcacctgctgcttatagcaagctcaagtttttgcctgaggttcaatgacacagggcatctaaaaacactttgcaatctctgccatactatacaaatgctaactatggttatgttctgaaagtggtaaaaatagattttatgtacagtaaagtataccattatggtaatgggggagatattttacttatattgggctctttctctccctcaaaatactttttatctttttctttcaataaaagaattgtataaaataatggtgagatcgatggggaaattcttttcaatgaaaaaattaggctggatttggaaaaggtaaatattttagcatttaacactaatctcaatatatttactgggaaataagcaatgtgaatgtttagtgcattttttcatcctctgaacacttattcttatgcctctaccactgactgccatattcaaagtcctgtggtaccataaaacatttccttcttatccccatcataataaaaatatccacctttctttctgattaaactaaggagcttctgcacagcagaagaaactatcaaaagacaacctactgaatggtagaaaatttttacaaactatgaatctgacaaagacctaatatccagcctctataaggaacttaaacaaatttacaagaaaaaatacaacctcattaaaaagtggacaaagtttatgaacagacacttttaaaagaaaacatacatgaagccaacaagcatatgaaaaaaaggtcgacattactgaccattagagaaatgcaaatcaaaaccacaatgagatactgtctcaccacctcagtcagaatggctatatatcaaaatgtcaaaaaataaaaggtgccggtgaggttacagaggaaagagaacacttatactactggtgggagtgtaaattagttcaatcatggtgtagtacagtgcagcaattcctcaaagacctaaaaacagaactaccatctcacctagcaattccattactgggtatatacccaaagggatgtaaattgttctactataaagatatatgcacgtgtatattcattgtagcactattcacaatagcaaagacatggaatcaacttaaatgcccactgatgataaactggataaagtaaatttggcacatatatatcatggaataatatgcagccatgaaaaagaatgagatcatgtcctttgcaggaacatggatggagctggaggccgttatccttagcaaactaacacaggaacaaaaaactaaataccacatgccctcacttataagtaagagcttaatgatgagaactcttggacacagagagggaaaccacagacactggggcccattggaggatggagggtgggaggagggagaggatcagtaataacaaccaacgggtactaggcttaatactccgacgatgaaatattctgtacaacaaatgcccatgacacaagtttacatatataacgaacctacacatgtacccctgaacttaaaataaaagttaaaaaccaaaatcaaaatcttcatccttgagtggtttgtagcagtcatcttggtgaaaatttaatatctgatttaattaattccagagtcgaggtatcccaggaaacatattcttgccttttcttttcttctattattcccgtctctttttttcaggagtttatttaactaaaccaattactcaaaaccataagaattgtgaggacgaacccaattttttgagtgaggaaagaaggaacatcctaaactaggaagcatacacctattctctaactaggaaacttcacaatcctttaaagaagaattcctggagtaaactacattgcacagttgaaactatcagacagggatgttaaagtaattgtatttaatgtattaaaggtctagtggtaaaggtaaaaaaaatggatgaatagatggggtatttcaaccaaaagtaagaaattattttaagaacagccaaatggaaatatacctaatatcacaatgtcagaaattaataattccttagatggaattatcagggcattacacacacctaaagaaacaatcatagacctagagggcaggcaatagaaattatctgagctggaacacaaacagggaaaacaaagaaagaaaacaaaaggagaatccaagatatgtgaaacaataccacacagtctatcacatgtgcaacaggtgactcaaaaggagaaaagagagagagcgaggcaaataaatacttgaagggataatagccaagaatgttcttcagaaaattagtgaacaatgttaaatcatagatctaagaagcttacagaacttgaaaaatcagatgaactttttaaaaacgtagatgaatcatgattacattgctaaaaaaaaaaaagaaaaagaaagaaagaaaaaaggaagcttttgaaggcagctaggaaaaaaaaaagaaatgttatatggaaatgaaaaagacagaaatgatatcagactcctttttcaaaaatatgcaagcccaaacataaaagaaggctttaaagcactaaaataaaacctgtcaactcaaaattctatacctggcaaaaatatcattcaaaaatggtagtgagataaaggacttttcagacaatagtttaaagacctcattgccatttaaactgcactaccagaaatgttagattaaatactatctttttcatgcagaaggaatgtggatctacacaaaggaattaagactgccagtaatcgttaaaataaaggtagatgtaaatgtccttttttcccaaaaaaatgttagtttaaaagaatttgactttctgaagagtaactatatattgtgaggtttacaatatatgtattaattaactatatggcaacaatagcccagaggataaaataaggaaattgaggtatatggttacaatgttcatatactatatgtgaggtggcacaatattatttgaaagtaaactgtggtaaattaaagatgtacaggcataccttgttttatagctttgttttatcatgctttgcagacactgtgttctttacaaattgaaggtttgtggcaaaacggcatcaagaaagtccatcagtgaagccatttttccaacagcatgtactgtctctttctcagtattttttaatgaaagcatttataattaagtatttttaaatttaggtgtacacatcttttagacataatgccattgcacattatagtataaacataactttaatatgcactgggaaacaaaaacatttgtgtggcactctttattgtaaaatttttatgattttgatgaaccagaacaaataatgcaatagctccaaggtatgcctgtatattatcaacctttagcaacctttatattgtcaatattcatatatatagaatggtaataaagctatgtaattaataagccaatggtagaaataaaaagggattatacatactactcactattttttaaaaggtctgaaagggaaaaaaagaccaaagtcctagatgaggtgaaaagatacaattattaaaatggcagactgaaatccagctatgtcaattattacattaagagtaaacggtctaaacaggctgaatgaaaggcagacattgctggattgtctaaaacagcagatccaactacatgttgtaagagtaaaaactttatgaagacataaataaaagtattggagaggaaaaaaatgtgtgtatgcatatatatgtgtatatatatacgtgtgtatatgtatatttgtgtgtatacacatatatatacacacacacaaatatacatatacccacaaatatatatgcatattcatatatatgtacatatacacaaatatgtacacagaaataatatatgcaaacacacaaatatacatatacacacatatatatacacatatacatatatatctatatatatacacaaatatacatatacacacatacccaacactaatcaaatgaagactggagtggtgccatgaacatcatactaagtaatcttttgaagagaaaagatatactggggatatcttttgaaaagaaaatgttatcagggataaagaagaacattgcctaatgataaagaaatcaatttatcaaaaaaattaatggtaagtatatgtacattacacactccaatgtacgtaaaacaaaaactgatggaactgaaatgaaaggataaagagagaaatctacaattctagttggagacttaaactatcatctctcagtaattgacagactacatggatataagatcagtaagagtatagaaactttcaacaatactatcagccatattgacctagttgagatatacagaatcctctacccaagaacaacagcaaatactttactttcaagtattcatgaaacattcaacccaaatgaaaaatatgctaggccataaaacaaatctcattccataacaaaaggattgaaatcatatcctctcttgccacagtggaatctgatcaatagctgaatgtgttttatttgggaaactagtatattccactatattctgccgagaaatttggggatatcaggaagaaggacatacagacactaataaatatgaaataaagtttattactcagatagtaaatggcaaaagtattctccaagaaaagggatcagattccttctgtagtaaaacaaccatgagaagaatagatgaccccagcttattttggattaagaggtgaaaccaggtagggatctacatggtttgaacttctccgccaatgccaagggagggagctcctgagcttttttgtaaatcagttttccagatgtgaggcaaaaggtaaagagggaggggtggagctttaaagctgtcagtgatcaaacatcaaaataggaatcagtctttattatagaaagatatctggataattcttacatatttataagctgaacaatatgatagctcaatgtgaactatccagacagttcataatataactaatgtgttataatttacttgagaagatagaggatgaggtgaggtccttcaagtaagttaagtcttaacctaacacaaatactactcatgagatatagtctaaaatcaataaatcataatacattatagataattataatttgtatcataatacatataacactatatacatatgaaactatatacacatatataacatatatacatacattataaacatatgcatataatttagaaatatagagattgccaccagaagatatagctggcaaggttacaaagtgatttcagttgtcaagtgggactgagcacttcaggattttcaccttaatagaggtgtattttttaacaaaaaaacaactaggccaaattaaaagaaaaacaaaaacgaaaccaaataataagcaaactttctttccttgctctactcttcactatgagacgttaagagattcactttaactctgagtcacatgttcttaccttagtaagaacaaaattgagttgaataatgttccccaagggatgtccctgggtcacaactgttatacacgaaaagggttctgatgtggagcttggacttcagttttagttaaattaaacaattaaaacaattttgttttttactttaggatgtcttcaagtcacccaagcagtttctactgtgaatctttgagagggagattgcaaggggccatcaaaagtcattccaagtcaaaccaaggtaaaacctgatgacagtgatgggatttttctcagcaaatggtcttgggtctgctagaatatacaaatgaataaacattcaaggtccaaaagtttcttttacatttggctataggttgaaagcatgagatgtttatgaagtaaacacccaacatggccaaagtgaaatgtcagtaagacaactacagaaatgtgatctttgagataactttctaattcaccctctaagctattcataaaatgtatagctaaaacatgtatactaggatttgagtttttctcattcataagaccacttgcatctgttgcatgatatcttctattaattttaataagtatcagcaaagcaaaacatttcttcaaatcttgcattcatctggtttttctcaactctaactacaaaacttagggtttcttatcttttcattcatatgtgataccttttatatatttttttcttcatgaatttttcttcatttgcatttcttcttctcataaaaactatccttgagctcggtgcagtggctcatgcctctaatcctaacactttgagaggccaaggtgggaggatcacttgagcccgggagtttgaaatcagcctgggtgggcaacacggaaagagcccatcctacaaaaaatttaaaaaattagccaggcatcgtggtatgcacctgtagtcccagttaccaggaaggctgaggtgggaggattgcttgagcccagaaggtggaggctgcagtgagctatgatcacaccactgcactacagcctgggtgacagagcgaggccccatctcaaaaaaaaaaaaaaaagaaaagcaaaaaaattctttgatattttcagtaacaatattgtagttttcagttacaattcttttaagtttttctcaaaaaattctcaattgcttattttctcttttaggagataagctgttattttaactctgtctttattatctaaggcacttccaaatctgtttcttttgtctgcttttcactgtcatccaggatgtcttgtattctttgtacctgattcctttctttgtactcgacattatatttgcaaaattgttgtagaaaattatttgagagctaccacatcaccttcctttagagaggaattaggctgcttttgtctggtacttggatgcactaactatctgggatcacttcaattcaattccaaagattaaaatgattcatacctgagctgtagtccttgaaaaggtctatctattcctagttcttttttttttttttccaaaggtgtaattttcggcccctcactaaaggtaaaggatgcttagcagaaccactgcttttgatgggacctggactctaaaccctattaccctagttctgtgagactgtcagtagcaaaattcagctgcctgtcaactgccccgggattatcaataatctagggggaaaatagcccaagtgctagaatttgccaatcttggttttgttctcttcttgaatcctgggctggtatttcttcattaacactctgatgcctttttaaatagaaggcctttgtttgtattgtttaatccagtttttcaagttgtcctcagcagaggactgtcttttatccagtgttttgttatttacaaatattagaaataatacaaatattacaattacaataatactaatattacaaagaatatttatgttacttataaatattatttatgttacttataaatattatttatgttattattactaccactgtaattcatgcattaatcatctactgaactaagtctctaactggctttcaaggcttctgggctctattattactcccttgcatcaaacctgtctccacactgctcccagggtgatagtctaacacaaaaatccaataatgtcacttagatgttttaaattatttaaaaacttcactgcatacagataacattatgtagaaaaaataaagtggttatgaactttatagcaaaataaaccttatttcgaatcctcactctaacaacagctgcatgagtttggacaagctacttaagttctaagcttcaattttctaatctctaaagcaagcatggtattaacacctaacataaaaaagtgttttgaagattaagtaagaagtaaagtactaactatggagagtattaagaagataattctcttcttgttatagcattgcatgagttcaatagacattagaagttttcttttctctgaactacctctgacagtgcaaacattccataatttgtcttccttccattcctttccacatattattttatcctttaactaggagagaatccagaggaaaaatagaaataagtgtggtttctcccatattccacagtagttagagggccaaacactctttcctactgcaaaagaagctattcagagggcctctacccatgaccacttctttagattacagatggagaatcgatccacagaaaatatgataatactgaaatttgcttgatttttcttcatgggaatccatattccacatggttaaatgggattaagtaaatataggctattctccaacaaaaaagtagtggttacaataagacagagcaagaattcaagtttaaatcaagaaaaaatgtctgaggcctctatcaagggagaaacatactgatggcattttaacaaaagaggaaaaactcaatgtaggatgcaaatgatatacaagggagacacaaattaactgtttgaatgaattttaactactttagaaggaataaaattgccctcttagttctgataattttctgtcaccctagagaaaaataaaatgtgatttccaaaatagcagaaagagcaactctccttctaaaaacagaaaaatagaaatgatcagctggctgccaattgtatgttgttaaattaaattatattataaatgtatacattttctatataacatgatatatacaaccaaaaaaggaactattaaaatttatatctaaagtaatgtcatctcttagaaaatttctatcaaatgcacaacttcctaaagtgtctacatgattagcatcatgttaactctctttatttttcagattttcgggacccctttgttatctgattcttcaaatgagtcatccttctttaccccatttacaatcagggtatatttggaatttaaataactgtaaaaataagagaataagatataaaggacacataaagatataaaggtgacctttaaacttaattttaccatactgaagttgacaaagtagttgatgatttttaaatgtggcaatatagcctaaacatgttaaatacaattttccaaaaaatgacaattacaaatacattagatagtctaggaagaaagctgtagttgtttgatgctgtgagtaccatacactgactgagatggatatgcacttacttggctaatgagttcaccttcaaactctgaatgctcaaatggaaataaatcaccaggcaactacatcaccagccacagaaaagtaaaatgaattaataaattacaaacctaaaacatattacacactatcaaaataccgtatttcatcttatctaaagatgccatcagttacaagatgcactgttatctgatttaccatcaacaattttttttaaacactggcaattcacatggaacatactattgattccaagatacatcctgatttgagatatgaaatgtaaaaaaatcatatctttgaaaattaaaatgtagcattcttttatttattggctcttactcttgcctgttgtaacaaaaggaattctcagtctcaatcctagaatgcctgatatcttcaaaatccatttaggcacaagctgactttccaaacgcagacacacaattccacagtgccttggtcttcatagcaaagttgggggcactggggatacagttaaaaagcagaaaaataaaaattaaaaaaatttttgacctttggaaacctgtgtgcctgtgtgtgtgtgtgtgtgtgtgtgttgtacctacttaattctggcagtaaactttcctcttctctgtgttcctatggtaactttaactcttgtaaattgtgctgattgctaatgtcattgaagattatttttcctattgtctttccttcttcccacttcacaccccatagagtatatgtctgatccacatctgaaaggactgaactatcaatcctccagagagaaaaaagcagttacaaagcttccagccaagcattttccggtaaaaatcagaacaaaggagtgatctcttctacttcactaagttccagtaatattacatcaagatatagaagggatcactccactgattgcagcccccaaaactgtgctctagcaaaaacatattactgaacaaatactatttttacacccattcacaactcctttgctcccagaaaagacaaaatgtcctattaaaagctgtaagatgtctctttgagtgcagtaattatctaatcgcaaagcatttctgaaggacaaactgtacatattgttcttagaaataactaagacatagccacttccagtagtcagtggcagatatagatttagtaaataagaggggcttacagtgattgcctggtttttgtgttgggcagcctatagagacttttcttgaatctacatcttggtgaccctttacagaagactgaaaatctatttgttttacatcaaagaatttgaagtcagtggtgtaagtcatggagatcatgtggggaactgaagactagcccaaactttacctcagggctcaccactctctagactgataatgatatcaaaaaatacatcttgaactctcagcacagacacagcaaagcacatttcatttctccatgggtgtcaaagcacccatggagtccaatgtattcctatgaagatgtacatatccagatagatttggataaaatttagtaatatattttccctggagaaaaaaaagaatattcaagaaaaatcttctctcacaaattctaaaacccaaattattaaatatatgattttatttctaaaactttagttcttcttattcatttttcctttaaagtgccttttgagtacccaaaggtcaatattttttaatttacttttaatttaaaattaatcaatcatataggtctgcagggcaacacaacagtaatttcagcatgaataacagtattatacatatgtgacatatattttactcctaaatgacattaataatgataaattttatatcacattgatttttcgcctctacacagcagaaacagcatcatagatcatgattctattgttgctgcagggattcggccttgcagagtgggcaaaaactagaacacactgcaggtgggaaattgtaaggaaaaagttctgcatatattaaatataatacggagctcttgactctgctcaattatgtcttgctggaagtcaaaaaagttagtactcatgccaagtacttagactgcgatgctaaatcatcaagtaacatgataactatgacttttccatttcctttgttataggtaccacagcggaatattaacagtagccttacatgtgttcacgttcttacattgcctagcacattaaccaatttctaggtaaaaaaataataaaaccaaaattaaggccattgtttctttttctcaaaactataaaagttactgatttgtgctccttagttttacaaagcaatttatttggaatttttcataggtaatccaaagaaatccaatttacacattccctgaaaggtaaagttcccatatgactagaatcctttctattaatgcaaaggacaagtgtgtagagatgtctcattaattgatttttcctggaatgttaagaattcatcaatttatatatacagatcttgcttcaaatcagaagaaatgaaatgttctgtttagtatttgaaaattgcttctatttgtaacttttggcctactgtagaaatatcattatttggttttgttagttctttgttttgtcttccacatccttttactccttctcagtttttacactatttatggtttttctacaccttcttaaagagctcctcatttttgccactgtgtagattaaagaagtatcaattctgcttcttatgacagaaaatgcccatttcaatcttgttatttttaagagtatcttaacatttttaaaccttaataatattcatggtaaaatgtagaagtgcagaatgtgataaagtgaaatattattttctctgaaatctaatttgcattcacaagaagtacaccctgttaacattttccttcatacaatgtttactatgcctatatgacatgaatgtctattagtgtgcatatacagatgaatttaaaatgtatagccttgggtttgtagaatggctttcttcattttcctattcctaaactaaatttggtcctagaataaaaagccagcaggatacttactgctgaaaactggaaacgtttccattttagtgtgggacaaaaaaaaatattatttgtcatcagattatttgattgtgagatacttaaaaacttttaggttttttccaatctttttctatcataatattgcttcaaggagtgctgtttcacatatgccattttgtaaacatgggaatgaaatttctcttcctattgatatgaggtcttttgctctaaaatactatttgtacatatataaaaatgatactatatataggtgtatatatatacgtgtatatgattatattatatgtaatgtatacacttaaattatatatgcacattatcgtgtatatgatattatacacacatatataagttgcattatatatgtatttatgtattgtaatgatacgggaggtgagcagggaagcgctggatagagaaaggcagggtccctggtgaaggctccaccttcgggcctgtgcccatggacctatgtgaggagaggcactcctgttttcacacccaactgttgcatttttcaagaccactctggccagccaccctgcatccccattcctgtgcctataaaaaccacccagagaccctagtgggcacacacacacaaacagctggacattgagaggaacacaccagcagaagaacacaccaacagacaccgccagcaggaaccacatggatgccaaggaaaattcagccaagggcagtgggaggagagccaggccgctgaatgagcggctcacgcaggggaagaccaccttcccactccatccccctcctggctcccgatccgtctgctgagagccacttccaccactcaataaaaccttgcactcgttctccaagcccacgtgtgatctgatttttctggtacactagggcaagaaccccaggatacagaaagccctctgtccttggaataaggcagaaggtctaattgagctaattaacacaagccacctgtgttaaggctaagctgaaagagcgcactgtaatacgagcccactggggctttgagagctgtaaacactcaaccctaaacgctgcagtggggttgaagcccgcgctccccacgacctgcccttgcgcatgcttcccctaggggttctttgctgtggggcaccgaagaagcgagccactcctcctgtcacatgccctgggagggggataaaggaaaacttttcctgttttaataatttccatctatttcttttgtacccagccacttatttagttttgatattattgatattgttggtttttttctttttggccttttccttcatcatcactattattttctattgttccagaaatgtagatgatataataataattataaaagttaagaagaagtaaaattagcaattatcacagagagtatattgttatttacctattaaaaacattttttgagattttaatttctaaaatttccctcccattcatataagtaatttatagagctttgaatgtatagccttaattatcttgccctctatgattgacagattaacagagatgcagagatgtccaagtttaaatctctagaacccacgaatatattagaacggcatggcaaagaggaattaaggtggcagagataattaaagttaactgacttttgagatgaggagcttatactgggattaacagggcaggcccagtgtaaccacaaggggcgttataagtgaaaggggacagaaaggtgaaaacattagagagatggcagcaggacaaagactcagtcatatgctgggtttgatgatggagaaagggggccatgagccaaggaatgtgggtggcctgtgtaagaaggaaaaggaacggatcctccctagggtctccagaaggaatgcagcactgctgactccttaattatagcccagaaagacctatttcagatttatgacttcatgaactttaagataataaatttgtgttgttttaaatttgtggtaatttgttagagcggcaacacaaaactaacataccctctaaacctaacctttctgttccaatatgctatttcccttatatttatccttaaacaactataaaatctttccaaacacaagatttgtcaaaatggggagcatgtgattactatgctcccattcaagaaccacttggacgtttttcaaatctcttccttgcagatacggttggacagtaggatttctataacaacttccagcctctaaacagccatctatgtgttgtaaataagatttcttcctagcatttactaaatattatgaacttgatttcttcctagcatttactaaatattatgaacttgatttcttcctagcatttactaaatattatgaacttggagaaaaattaaaatctactcttctgtctgccaccaggattcttcctgtatccactctgttttatgagactaattatgtggagaaagtatgctgcatagttttaatttgtcactttcatacccattagttttttagagccgtacccacctaatgaatctaacatgcgatatatggggtctggtgcccaataaattaaatatattcatatgtatttttttcgtacaaggatggctactctgctttttttgtttgctaaagaccctgcagttttggtgaggtgcacacagcaaaggagaaactaagtaaatttctacctactttgaagttggcacagtactgctgacctaccaatttcactttcagtttcattctactggcgttggagttagtggaaatttccctagataccatttgaaacgggaagcctgtcttcaattctcagtaaacaatctcttcggcagtggctctttgaccttttgtctgcttatcttattaccagacaaatttgcgctgcccttttaaaaccatcttctaataacaaaactaagtactacaactagctcacaagggtaaaatcacaaatcagatttgtttagcagcagtgtccttgaaatgggtaaatttccactgtgaaagaaactctttgtccccatcaagatcctttttacattttgattaataccttacctaaatatccagaacaaaggcagaagtgaagacgtccgtgaatgcttgcgtaagtaccaggagatctggaacatctattaattatttttcaccattctgccatttccaggactcgaagtcagcagaattgactgaaatagtcttctaagtccaatccaaatatgtctaataatgaaaggctttgtaaggatatggctaaggtgatgccaatctagggatggatttcatgaacatgagtccgagaactgatcaggaaatgaaagattaaccagaggttaaaatgtgcacatagaacgattatctgggatgtcaatccagatggctatcaagcaaaaagttccaaaaattgacagtaatagagttgcaaagagacaatttattagcatcaggaatctggggtttcaacacagggaggtggataaccagagtgcacaccaggaatcaagaaaccagagcatcagaggtagaggggcttcaacacaattctgactccaggctctttcagagagcaatttatctgggatcgaaattgatctagatgaaggggttgtactatatttacaggtgaaggctaatttggcatttagaaaaatatggaagtcagcagccagagtcaataaacatcctcatctttcaactattaaccacctctactgagtgactacataatatattttcaaattcttgcacaggcatgcccaatctgatacattgatcttttgagatattacattttattttgctttgtaaatttatctcatacctgtctactcttttcagttcaattaggtagccagacttcttaaatttcttgaatcagagattttggaagcaataagattaagaaaagatcaaagatgcctttctttcacaaaagcctaaccaaaatgaagagactgataggagacctgggcagaagggagcagagagaatatctgtgcagcagataccagtttccaccaaatagggaaaagagagagtcttcaatctttggaccagaggctggtgcactaactagtccaaggcagtgtctgatgaggtattcagacctcagagagatgtttcttagtttaccaggaatgcaggacccccaaaatgatacagaagcagaactgtaaaagctcaagaaaccactacattatgaacagtgcagctgcattagggttcaccagagaaagagaaccaataggatatctgcatatataataggacattaattataggaactggctcaagtgattatggagccaagaagtcccatgatctaccatctgtaaactggaaaaccaggaaagccggtggtgtaattcagcctggatccagagggtggagaagcaggagctcctatcccatgtccaagggcaggagaatatggacactgcagctcaaacagaaaaagcgaattctcccttcctttgcctttttcttctattcaggttctcagtggattgggtgattctgaatacctcaatgatttattaaaggaaatctattttgaaagatactgagaagcttacaatatcaaagaaaaactggaatgatcaggcctttaaaaaaatatggaatcagccaggcatggtagctcacacctttaatcccagctctttgggaggccgatgcaggaggattgcttgagcccaggagtgcgagaccagcctggacaatatagcaagaccctgtctctataaaaataaaatttaaaaataaaaaataaaatctagaatcaaggccagctcttctctctatagcaggaactcatgaaccttgagtattctcaagatagcatagcacccaacagattcatatgctttgtaacctctgtctatcactcataacttcaggagaaagtctgataggttccactgagaccatattcccacctatgtctaagactggaaggtgggcttactggcaggcactaccagtaatgctcattgtatctccttcggcttggctccttagttgacatatatcttgtgctcaaagaattaatgttgaatttaaatattctaaatggccagtttttaatgaaggcacatgctggtaagcagtacagctattcttataatcctagacttttgttctttcctatttattttcacatttttctatgctcccgtttttgtcagaaatctgttggaacagttattatctctatttcttccatggtgtctaaaactagagagctatttttccctctgcaatgtctttttttttcctctctttgccatgcttcagtgtaacttgtcagtccttcatgttatgtactagaggaattgctgtctcaccagaaaaagtcgctgaaagaaactgcttctgagcttgaacacaaatcaattcctttcatctcattcttgctaagttgaatattgatctgtgtcaaagcaatatgcatgactttttcattaatatttaattgttattttatatgacttcaagcaaagagacatctccatggttcattgattcatccattcttttggccaaatgccaaatagcctgtctccaagaaaatgtatctgcccttttcaaatgagactctttgaagaccaattcaattcaatcaaataattaggctatcacatcatgttattatcctactaaaaagtatagttgagaacagtacatattctaaagtagcagtgatagaaaaccttatgttacatgtaaaaattacacatgaatgaatttttggcgaatacaaaacggaaaaatggaacagaatataaatataacaaatctgcatataaaattcagaattaatgcgctagttacacccagattaaaatgaattactttatgtacaatttcattgtaaaaggaaccaacgctccatggttgattgggagactggaacagagattgtacaaggtacacttgtgcaatgagcctggaacttcttgtggtaccaaaaaaaaaaaaaaaaaaagaagtgctaaaatttttaaatagaaataaaaaggataagagcacatcaaagtgacacagttgccaaatcttcccacggtcagagctggaccaatcaaacaataaaagaaataacacattatggattataagtgtcacactggattgaagtatccataagcccttaataataaaaaatagctaaaaagaaagaggcaactcttctttatggaataattccaattaataactatagaagaaatgtgggaaatagaaaaccaactttaaaacaccacagtaataatttctgctggcaagattcaatgctgtatgctacagtgggtagcaaaatttcaagaacaggatagtggcctagattcaaatatcgcccttttttttttaattcttgttgtgattttaatatacactcatgaagtttttggtaattctctctttaggggggtggaacttaatttgtctctccttgagtgtggaattacttttcttaatgactcactttcaacaaagagagtatagaaagggaacaacagtaacttcacagtagagaaactggcagacatcactgtaataaagtgattttaaggttagcatcaccaacaataagtcatgttgatatcatgctactcttgaaattataaggacacatcacctttgtagcattctcccaaaatatagaaactcaactaattatgagaaaacatcagacaagccccaaatgaaggacattctacaaaatttctgaccagtactcttcaaaaagatcaagattataaaaaaacacataaagactgagaaagattgggagagacaaaatagacgtgacaactaaatgcagagtggtgtcccagattggatccttaaacaaaaaagagacattgatgtaaaaatttatgaaatccacacaaagtctatagtttagccaatagtatcatattatttagttttgaaaattataccatgattacgtaacatgctaacattagagaaaactgagtgaagggcatataggaataatcagtactatctttggaactttcctgtaagtcacaaaacaaagagttccaacaattaaggtgaggtcaagacaagaacatttgtcataagtagtctcacaccagagaaaaaggacaaaactttagaaaggactaaagagaaccagaaaggtcaaatatgagagtaaatataaaataatcttaagtgcttagaccagcagtataaatgtcttggaggttgataagatatattgaagtaccatatatgaaaatagctcaaaggtaggggtacaggtaaaagaaattactgtttgaagtttcttgtatggaaagttgtaaaatcattaaggcaaattataaaaagaaaaaatgcatattgtaatctctaggcgaccaataaatgaatttttaaaacatagtgataaaatgctgataaaagaggtaagtcgtttttttctttatcttaatgaacccaaaagaaggaatggaaaagtaacaataggaccaaagaaaagattgtaaaattggaaacaaaaagaaaggtggcagaactaagctcaaatgcatctgtaattggaataaatgtaaatgaattacacacctcaattaaaaggtgtgtaaattttcaaaagagttctgaaaaaggcccaatctatgctgtttacactttagatataaggacacaggaagtccttacgtcggaagaaaaagtatgggaaaaggaatacctaacgtattcctttaggtaacgtgaaaacgttacctaaacatggtgtggctacattaatatcagacaaaataggtttaaagaggaaaaatattattagagaaagtgaatttcataatgattaaggtccaattcatcataaagaaataataatcctgaatctgtaagtatttaataacatgggcttcaaaatagaaattgatggacctaagaggagtaatttaaaaattcttaacctgagtttggagtttgaacacatctctgtcagtaactaacagaacaacaaaataaaacattagtgaagctatgaaatatttaaacattttttgctaaccctttctcattcatatttatagagcactacccctttaatgggacatagaacatttacaaaagaaaaggaacagaaggaagaggagggaaaaacactggaagaaagataagaagaaaaagagaaaggagagaagaaagagaaaagggggaaagcaagcagagaattaagtcagaggagtattaaaaacattaactttatcactgataaaattagtctacagaacataccttgaactgtggctagaaataagcttccaaataatttatccccacaagtaaatttaccctgtggtcacaatcagaatacatgggcaatggtatattgtcaccttagagagacagagatgcctcagtgttgtaggaaggagtgaggaacacagtgtgctccagacaaggtggtccacaataagggagaaagaatttgtgtcacgtgtatataaaccaaccacttttcctagtttcagatcgatgggtaaaaagaagcgtggacccttctctccaaagatacaaacaatagacatttgtatttaagagtcgcagggtgtggtgcactggctcatacctgtattcccagcactttgggaggccaaggtgggtgaaccacttgagcccaggagtttgagaccagcctgggcatcatagtgagaccccatcactacaaaaaattaaaaaataggtgggcatggtggtgtgtgcctatagtcccagccactcaggaggctgaggctggacctgaacccaggaggttgagactgcattgaaccagaaactcataaaactcatgaaaaacaaaagagtgattactactgatcacatgaaagaaagagtatctgatttcaagcattagagtttgatagttcctccgcagattccatcaaagaagtaatcactggaattaagagagaatccactaagggcttgcaaccctgcagtatgttggtttatgaagcgctcatattatggcaggatgcggtggctcatgcctgtaatcccagcactttgggaggcctaggtgggtggatcacctaaggttgggagtttgagaccagcctgaccaacatggagaaaccccgtctctactgaaaatacaaaattagccgggtatggtggcacatgcctgtaatcccagccactcgggaggctgaggcaggaaaatcacttgaacccaggaggcagggttgcagtgagttgagatcgtgccactgcactccagcctgggcaacaacagcgaaagtctgtttcaaaaaaaaaaagcgctcatattcaaactccgttcagccataaacaggaaaaaggattcagccagctcatgagctaagtgaacaagtcaagtgtgatctacaaattttctaaaacctcaacagcaaatttggggcccaataaaatctctcctgtccctaagagaagtgagcatttatatctactttttaaagcatataaaggagtcatattgaaaagcagacataaaaatgctttaacataaaataaaaagaaacttaaaataaaatgtcagcttgctctcctgtgagaagatgcaaaagacatgctaatagacaagaacagaaaagcatgtagaggaataaagcttgtttattatttttttaagtgaaaataacagttaaagtcgcaagatagcctaaagtatttttatggcaatttataaattcaattccccctacagctctatgaaactgttattactcctctcccagttttgcagatatgaaaactgagaaacaaaagatttaggtaacttgtccttaattgtacaaaagtgaattcgtagaactgggatttgaaccaagagattctggctccagaagcctcatactgaacaccagagcactgtttccatcagggaaatacaaacacaaatagacataattatggagttgaggttcatgaaagatttccaagaaactaaaatgtccaaagcaaaattaaaattcacagtagagttagtttaaaactgaaactccatacaattaaggaaccagtaacctttttcagcgtttactaagtgtcaagcattgttctatttgctttgattcattaatttatatgatcctcccaatagcaatagtagatattactattatccttattttatatagaggatcaccatgttatgcataaatacgatgtaaatattattgaatttctggaacgtgacagataagattttctcatttcatgatcatgaattggatttgcttaattttctcaaaatattgttttatatttcaattatatttctagctttttagcttattttcacattattttgccctattactccaaatcacagtctcaagaaaaacatatgtatagaatatatttataaatggaatattctttaaaatcaaactattctgacatttcttcaaaaatggaggggaggttcatggttgcaacatcaatttcacatcctgtaaaaattgagtaagttattgaattcaatctaagcaaggttgaaacaatcactcgtttttggtacaagaaacactgttttgtgatttttctaagaagagttaactactctttagcataataaataaatgtatgaataattggtggccaaatttcctgtgatttaggatccatttatcaggagaccaaggctacagtgagtatatttctaaaggtattttccatccaaatccctccaaataatttgctcaagtattttttttttttgaggggggaacggggggatttatttgattattctctaaaaacttacttttattttgagactgtgattattggaaaattccaacaaatatgcaatttgtacaaaagtaggtaattcattcccttaaatggaaagctataaaaaattacaaatatttattatgagataaccaactccagacaggggaacccaagaaaatattctgatgtttccaaggaaagccatgtttgaaaaccagaagctttagctcccttattcaaagacactatcctgaaaagtatatgtttaatcctacattgtttattttttcagtaaatgatctacatttttgtcaaaatacggttaagaaatgtgcatttattatatgtctgtctgtcaataaagattgtctatttcaaaacaaagccaaaattgaaaatgatgtgtagcttactctgtttcaggcatttgtctgaatagtttcctaatatttatcccttttatttagcaaaactcttttgaaaattaggagtatatctattgttacagacaatacaaaagcaagttaacttgcttaaaattcatatagataaatgacaaaacatagtgttctttgtacctatttgtgtattcattacttcctttactacttgattaaaatgtccacattgggtcctgtttagctgtctctctggcatgcagaggattagaatgaatctcaaccaaagcagatttctgatcataaaaaccatatgtagctttggccttaattaaattaattataaacaatttcattttccttttcaggacaagatagttatggagtaatcctcacaactgctatctcaataattgattaacatgaggaatttttttctaatccacattctattgtttgccacttaagagtgctgtgttcacatataaacatgaaatacctccttcactggccatagaaatgacattgtaaccacacctgaaggaagtattcttttttccatgtgaaatcctacctcaaatattaattaatgttgatgcattcttcacttttattttgccactaatttatactttagctttttgaaagtcttgaatagaaattttgttgttgttttgccttatgcattaggttttatttccactaaagttctattaacaggaggcaagccactgaatggctttagaagtagctttgtgaaagctaacttttcagctgagagaaatctccctggggatattacagagacacagaaactttaatagtattttgttttcctcagcacatccccagattttaacgtgtctgaatttaatgcattagaaacaagcatatgtggtcttaagctaaaatctcttcttgtatctagaaaatctatcacaaaaatactagctactgaatatatttatatataaagagaaaatactaaaacaatgaacaaaggacacaattacagtataatctgcaaagcagaggctcttgctccttgagggcaagtaatagctcatagatatttcccaacatctatcttccccccttagtttgcctttgcagatcagatgctatctgaccacacatggtctgttcaaaatgataaacagtattactcaatgtatcttctctgaaatgctaatgcgttgtcaaaatgctataatagcccctattacatctatttatgaaaatagaccattcaaggaaaagttaatttaaatcatcttgtactctaaaatgtcagtaacagtaatcatgaatggtcagcaacaacaatttatgctgtaaatgtttttagactttttctctaccaaaccagttcactacagcaatgcttatgtaaattatacattctctggaagtttctataatacagattgaaaaaaatgctatgttttaaaattttcttttcggtgctattagactttaagtaaatcctcaaaatggggtgtaatttgggagcagatataaatcagcacacataaataatatgcttaatttgctataccatttgatattaaaaacatcctacttagctggtgagggaataaaatgtattatttttaatttaacctcttttttgatgcagaaatgcacctaaagtttctgcttttgagcatatattaattgaattctaactacataatatatgtaagacacttttaaaacatagaaaatataacagtccatatttctctactcaagtcactcagtcttttgagggtgacagtataaccacatacaacataagacacatttgatgtactgtattatgagaaccatacaactttcatgcaagatagctgactgagcacatacaaggtcctgtcctccattttcaatttaaataatttagtgatatattcatacaatgggctactacattgcagttttaaaaagaaagataaaaactattgatagatgcaccagaaaggatgaagcttacaagcattatgttgagtggaagaagctactcaccaaaaaatgacacaaactatgatttcacatatacaaaattcatgaacagacaaaacttgtctatagtaataaaagtcagaatagaggttacctcattggtgggagtgaagaaaggtagttaatgacatggaagtagcagaacagaacataagagggtgatggagttatataagcttatgtatgtgtaaaaatgccctgaggtttaaattaatgacttgcgtatttacaaccagtatactttcttccctttactatatgtatatgtgttaagcttcaattaatgggttaagaaaagtaaagttttatgtaatacaataaagctgtgatggaagagtgtgttagcctaaatcaaactactttatatgtgaacaggtttctgcaagacataaagaggatacaattgagttcatgaataaattagagcagaggaagttgccatccagaatatgcacaaaataaatgtatgctatacctgaaacggaagctattcaagacagagttctaactgtaagttagttctaagttatgtttttctaatggaaaaatcagtcaaacttcagtccttcttcctgtatttttctccctgacagagccggggctctgtcctcaggggaaaaaaaaaaaaaaaatggagggatatagacaataaaagatccaatttcttatattttgactttcaaaagtgatgattcagaaataagaaaaggtctccaagaatgcttgacttatcacaagtaatgttctcttgcccagaatatatgaaagagaagtagagagtagaaaggaaaggaaagagaactgaaattggtattttaaaaagcgttgaaaaaatattcctttaacaatacaaaaatagttttcaatgaaatacctgaacattcagagtctaggatatttaaatatcaagcatgaaattattctatagatatagcctagaataagactgtccaatagacccttctataatgatggaacagccctacatctgtgctgtccagtagggtaccccttagccacattggctataaagcattttaaaactgattttataactaattttaattaagttaatgtaaatttaaatagttacctatgactaagggctattgttttggacagtgaaggaatagaaaataaatctgagatctagaatatagaatgagatcaaaatataaaatatatgaaagaaacaagaaacagaaaggatgtattgaatactttcagtatttatctaatgagagttacataaagtgaaagtgagaaaatgtataagagaaaataaagcataaaatgaaccagaaaagaaaagagagacactggttatcaatcagtgatagcccttaaatagaagttcttaaccaaaaaaaaggcggggctcatactttcatatgtttcttaaaatttattttgaaatttaaaatttacagctttattgtattgtataaaactttacttttcttaaccccttaattgaagcttaacacatatacatatagtaaagggaagaaagtatactggttgtaaatacacaagtcattaatttaaacctcagggcatttttacacatacgcaagcatgcctaaaatttccaagaaaaaaaatcaaattgactacaattgaatgaacataagaccactgccgtatttctcagctgtaacactttctcctagaacaacaagcagcaatggattcaaacaaatgacagaaaacaaacaagccaaaaaccaacaacaacaaaacaaaaagcattctgaattctatatacccagacatattataaatgaatcataggcataataaagaattttccaaacaagcaagaactcaaagttgacctcctatgaactccttttgaaataattacctcagaacatattctaacaggctttggaagggatatggaaaggaagaggctataaggctactcttcaatcatttcattaccatatctggaggacaattttgagaaagaaagaaggcagatgatctggtcacattgtattgtaaacgtgtaaacaagagactttatggtaaataaaccaatggtacttactaggagaaaaatcctaatctcagaaatcttttgactaaaatgtttctagttagtattgtttatggtaaagaaacctacagtctgtggatttataagaaatggctccctggaaaatatcacatatattttctaactccatggatataaaatgaaacaattaaaatacttgttacttaaaacagatgataaagagatttagggtttgttactaacttaaaaaagttattgcatacggatgtgaaattattccagcacaatttttgaaaagactatcacttgttccatttatttgcctctgcactttggcaaatgtcaattactgtatacgtgtgagtctgtttctggactctcatttcagttacactctatatgcctattcattggccaattccatactgagttactatctctagctttataaaaagtcttgaaataaggcagcatgtgaatgtcaagtttgtttttctaggcaaaacaattttggttattcttgttcatttgccattccacataaattttataatctcttgtgcatttctatgacaaatattgccatgacattgatttggattgtatttactgatttgatcaacttggaatttggacatatttggcatcttaacactactgagtctttcaatacatgaatataatatgcctctccatttatttcagcctttttgatttctttcttcactgttttgtagcctttaccatacacatcttttaaatattttattacatttatacctaagtagctcatctttttccaccatcaatggtggtattcccatttcttactgttcattgtcagtacctaaaaataccattaaatttttaaattgtgatcttgtatcttcagtaactttgttttgtacattctttgaaatcttcttcaaatacaatcatgttgaaagtgaataactacaattgcacatatttttttttctatttgtatgcctagttctttttcttattacactgcctagaacctccagtataatgttaaatgtgggtggtaagaacatttttcttttgccttagagtgagggttcagtcttttatcagtaagtatgatgtttgctgtaggttttctgtagctgtttcttatcatgttgggtaaattccattctacctaaaatttagagtttatcatgaatgaatattgaattttgtaaaattatttttctgtatctatagagaatataatttttttctatatctatagagaatataatgtatgtagggtctgcaacaatgtcctctttttaatttgtgatataataatttgtgtcttcttccttgttggtgagtctcatcataggctttcactgatttttctctgctgctccatttccaattttatttatgttctttattattactttgcagttacttactttggtttaatttacttttttcaagtttcttaaggaggaattttaaatcactgatttaagacttttttcatataaacatgaaatgctatacatttctctttaaattgtgctttatttgcatcccgcaaattttgcatgagagagagattattttcttttattcaattcaaattattttcagatgtcccctatgattttctctttgacctgtgagttattaggttggtaaaaaaaaaattgtggtttttgccatttaaagtgatatttagatgtgtgctcatcagtaaaaatattcggcaattattccagatacctgtttgtgatttctattttaattccattatgatcaaagaatatactatgtacatgtttttaaatgtattgaggtttgaattatggccagaaccacgatatatagactatactatatgttctacatgcacttgaaaattatgtatattctgcttatatttagtgttcaataaaagtcgatttggttggtgaaggctttgataatactgttcacatctgcgaattcattattgatttctagtcaatcaattactatccaatcaattactttgggttctctgaagttattatatctatagtttgataaattattctttaaaattttgtaaccactatctcttcaaatatttcttctgcctcacattctctctctgttttctctaggatttcaatgacacatatatcacactaatgatattttcttacggcatttgagtgttttgtttccttttttcttcactcttttatcatttgacagtttaggtaattactattaactgactttcacatcctctatcactttgcttagctgtgtcaagtctactggtgagcccacccaaggcattcttcatatttcttatcgaggttctcatttctggcactttcctggggctctttcttgtcattttcatttctctgctgaaatctttatctatccatgcatgttgtacatctttgtttacaacctttaacctattaaccatagttattttcaattacctgtctgattgttgcaacatctggatcatctctaagtcttgttcagttcattactttgtctcttgacagtaagggttgtgtgttttgtttttaatttgatttttgtgtctgttaatttttttattaatttccagacatagtgttcagagtggtagagactgataaaagtagtatttatgtgttaggtaaatgtcatttgtcttctgctaggctattattgtgggaaggtgagtaaatttatctcaagagttgagcccaattttcagttttgttcaccactgtctttaaattcctgtttgttcttaggttggagatagtttgctggtgggttttcacgatgtttctgctccactcattagggcttccctgtgccactgcccctcacagggaaattctctagtcatctccagtgttaatctgttgcttctgtcttggaggttgaggcgttacggttgtggacgaggttctctgtcatcctgattcagcctcagtttaagcagtcattgtctccctgagtcttagaatatggattttctcagtgagcttcttccaactcaatggaaggagacctttactggtctgggctcttctgagcacatttcttgcttcgacctatggataaagtatttcctttttttttttttttttccttcccctacctacaatggagacatcttctccttgcactgggccaagagctttctgctattccccagcatcttaaaagtcttttttccttatgtgagaagaaaccaaagatgggttcctgtgtttcctacagcagtggatgcacctcttcttcaggctgcatctccaaagtagtctatattagtacctgccctgccaataaacttttttcatcagcacatagtgaagtctatggagaaaagcctgcaactggctgtcttcatagcttccatactctcacagtatcagagaagcagtctttgaaaattaattaaaagtcactgtgacttctttttattcacttgtatggtggccttctcttactcttatgctcttacacaggtgaatccatgcttgttctctatctgtccgcagaggcacctgtctttcctcagatgccaggctacttgttgtcctgcagcattagctctccaataggttccagaaaaattaggattttgaggaccatctatctttctcttgctagaaggcagatgggtactccttctagatgtctacattcttaggcagaagtcagaagacctgggatttgtgttgttattgtgggcaggtattaaagtcaatcactttaatttttccagtaagcttccagatatgtccacacaagaaaccatgcagatacgttcttcattgttcattcatttagggcccatttccccagatcatacagcaggacctttggttaaagtgcaagagtctgtaaatatccaaacactcgcctgtgaaagtctaacaagcctccctctgctaattccactgctattgcccttgtgcaaacccgaacttgctttcttcttcaaggctttacaaaacggccctgtggcccttattctgtattctcactctagaggatcctttcagtggactaagaagccaccttttccatgactgggagagaatggtaagacccagactacacagtatccttagtgggctctatttttggttctatagtcagcgaagcaactgctaatataaactgtaggctcccctgaagttaccctcttagcatctttctaatatactgtctctaccttgtgaacaagctttgctatgctgcactcctcctatctgaatgtctctctgatatcacccatggcgcaatcagtatttctgtcctcagaattttctgatgcccttcagtagtgggagtggtttgaaccaaccctcagtaacaatctcacttttctctcctgagttgtatatgctaaacaactcagcagttttagccaaacttcaagagaactcactgaatagccctattcaatttctgcaaattcctgcaatctgcatatgtactggttacaacaacttcaaatattatctgagtagatggatcgtaagtgtccagtgaaaatatctgtgccaacacccttggtatatctttaacacttgtttctgcaaaagccccactcaaattcagatttatttttagtgacattacggttcaggccaacaggattaatagataaatatgattcaaccaaaaccccaaaagccctgccagtctctaagtttcctgcctatttccagtatatgagagaaccagtaatttatttctcaaagtagaagaactatctctggtttctcctgtctatatacattcttcagaatttcatgggttggaataaataaattaaattttatttaatttaataaatcccgcttaaattttagcaggatttatcagccagcctctgtttttcatttaggtgcctctcttctttagctcaacctgatctttctctgaagaggcaattctcatactgtcagtgtagtaaactgactttctatcagtgatttttaactccaaatccttcatgagaatatggcaaaatgctagtaaattttaaaatccccatatcaatgcatgaaataaatactgattcactttctacaagaatgcaaattgttactggctgggttcccaaattggaatggctataatagtgctaaattaaattaaatttggcctgaagcaaccttcatacattgaatccctaagaatgaactgcaacctaagagtttatttttgtaagaaatagttgagtctcagccaatcacagccactaagctccaaacaaacacaggctgccaactgatcagaccatgtccatatagggccaatgcctcatcacaagacgcaaattaggcaaacactcaactgtaaccaataaagctgtttctgtatgttacttccttttcctgtctataaaaactgcttgccacatggctggacgaagttccctgaacctcccctggttctgagtgctgtccaatttgtgaatcattctctgctcaaataaagtctactaaatttaatttgtctataaagtttttcttaaagatagcataccatcccccgtgatctgtggtacttcctttatagcctttacaatatcagttacaatgaaggtaatcagaaataccaacctgttcaatccttcatactggtaacctccaggatccatctgtcttaagtactgaccagacaagaatttggaaaagagagttagagggaaccaaaacttctacttcaacaatttccttgatcagaacaacaatctctcattacttcaagagagtctgtatttattgtataccaccaaagatgtctccagtcacattttcccattagcaaatttacccctaccctgctttaaagtgccttacagagtatcatctgtataccccacagcgattactggacaactagtgtccatatctggtgaccctaagaagtttgcatatcacctctacatcacttcatccaaaaaagccattgcaataagcctaaggcttttttttgttttatactgtaagggatattttaattatatggacttttgaattttaattcctagaaattacctttattattattttctgtctagaacttctatatctggatatttgcacttctatggatatttctcagctgttcgatcgtatttgtttccttctaggaatgtgctggtatcccaccttacaaatgatgaattctttcttcagctatattcattctcatatgcaatctattatgcttcttattcagctgttaacttctttgcacctagtgtttctatttgattatttttcattacatcttattcttgtttcctattggtaatatccttcccttgttgcatattttctctatttcaaattctgactcttccattttaatacttatgatatgttgtccaatttacattttttaatttaaggaagatatatttctgaaatgttcaatttaaataagttatatcttagtattttggcatttaataatattattaatttggcttatccctgaagagatagatacgttggctgttaatatgaacaggggaggggcagaagaaggaatctaggtcaatccttagaggtcaaaggtttatgaagggatgggctttcaggtgaagaactcaagttaccacaaaccagaattaaccactccaatttggtttcaccgcaccaagtaacttttcaagtcaacactctacattcaaacaccaaggaaaaggaagactgcctaaattgtcatccatcagccctggaagtttggaggaaaatgaatgaaagagagaaagccaaggctgttgagtcctcatccattagttttcctcaattctccaccctgtcagggattttgcattcccttgattttatccctacagaaggatgggccattggaagtattggccttcaaaggtatgggcaaccattgccaaatcctgcaacaaaaaagaaggcaaaggggaagccaagacagtatttcaactgctcttttctaatttctactttaacagctgagccaaaagccctttgctgtcagctgcagccatctacctgccttgccacataccagttcaaagtagctgtcttttttcctaaggatttctcacatttttatgagtctgcatcgagttttccttctccccccgagtttccctcgggttgatttgctggagagcagcagcagcttgtgctaatttgcagtcttggcataaattggaaactctcctccaagcaggtttatgaacaggaaacagaagacaacatcgctgtaatagaatcaaagtagactactgaatagtcttctgagatatataagatccaaattctggaagaaacctcaaacatctaattgtacatttgactaccctgctggaatatttaactgttaattcctttaacaatatggtctcaagtgaatggactagatagacaattttaaagtgtagaataaactgaagaaaagttttacagtttaaagtttaaattattttaaattttgacttaaaacttgattagaaattatcttaattttaataaagaatgaaaaacaaatttgagaaatcttcaaactgctttccacagtggctgaactaatttacatagccaccaacagtggataagcattaacttttctcaacacccttaccagcatcttttttttctctttttaactttttaataacagacattctgactggtgtgagacagtatctcattgcagttttgatttgtatttctctgatgattagtgatgatgagtatgttttcacgtctgttggccacttgtgtgtcttcttttgagaagtgtgtgtccatgtcctttgcctattttttttaatggaattatttgtttcttgcttgctgaattgagttccttatagattctggatattagacctttgttatatgcagagtttgtacatatttttccccatgctgtaggttgtctgtttatcaatagtttgtttcttttgctgtgtagaagctctttagtttaatcaggtcttacttgtcaatttttggtttagttgcaattgcttctggggacttagccaaaaattctttgccaagaaagcctcagaaaggtatttcagaggctttcttctagaagtttaagagtttgaggtcttacatttaaatcttaaatccatcttgagttaatatctgtatagagtgagctaccatttgacccagtaatcccattgttgtgtatatccccaaatgaaaagaagttattataccaaaaggcacatgaactcatatgttcatctctgtgccaatcacaatagcaaagacatggaatcaacctagatgcccatcaatggtggactgaatttttaaaatgtagtatatatacagtatgaactacaacatagccatagaaaagaatgaaatcctgccctttgcagcaacacgaatggagctggaggtcataatcataagtgaattatcacagaaacagaaacctaaatatggcatgttttcaattataagtgggagctaaacatggagcacagaaggacagaaacatgggaacaacagacactgcagattactagagaggggagggagagagggggacatgggttgataaaattatttgggtattatgctcactacctgggtgcaatatacccatgtgacaaacctaaacatatacccccatatctaaaataaaagttgaattttataaaaataaaaataataaaatatgttaaaaaagaaaaaatagatatcagtactggtaaaccttaaactacagataaattgcaaagttctaggtaaagtgtcaaaatccctacttttagctgggacatctatttgagaaaacctgtatccagctctttaaatataatttgcattgcggttgcttgaattcacaaatttgaagcaatcatcatataatgctcctggcattggtggtgaaaataagtcaaagcatatttaagcctgtatttttgaagcatgttaactgtcctaatgcccatctcctaatgtcctcataacagcaatattttatttttacattttggtttctcttatattcccaaatatagagcccacattaaatgaaagctaactaaacaactatttgggagttcctagaacctactcttttccagccgtctctctaagtggactacccttgttcctcaaattccaccacattaggtcttttaaagttaatcatgagtgctctacattaaaatgcaaaatatcctagaaagaaagatatttttacctactggtatataagtgtgtattattttatcagatccttggtatggtattgaccatacgatggtcaatgaattagtattgaataccaggatttaaagcaggcttcaaaagacactgaggaacgtagatcaaagagagctggtgaaaagttttaggataccaggtgggacatggaaactagcagcacctttaggccatttgccaaagtggggaaaggagaaaatattttaaagcaggtgggagtatgctgatgtaactaccttcttcacgctttcatttagagccactgtgcccaagagactgaaaatacttgcgaaattattacacatatcccaaagtcagggctataaattgtgatgcaacaaaagacctgactttcccaggctgaccacccagcttgcttacacctccctgcacagcaacatacacaagttccaatttgaggccctgctttagaaatttctcacctgtccaaaagaaattcacctgaatcttcctctctactccacctaaaactgatgaatcttccttacttctggttgtagaaagaatgaatgaattcatttctcagaaaagaaagttaacactgagatgatgggggaaatgttggcagatattcatatatggacaacttttcctcatctctaaaatcatactatgcctaaagccaatgttcaggttacacctattataattattttgcaatatttagatagatacctaagtcagagacgtcaaagcaagggctttccttcgcaattataacccctctaatcctatcccaaattcccagctatcttcaaaacaaagccagtggatttctgtgcataattaacacccagactagaccattcttaactggctcctcacctgtaacacaaaattaacgtcaggaaatacaactacacctatcattagctgcattccatattccaaaagagaaaaagatattgctttgaatatatcttcctcttactttttcaaatatttccttatttgaattcctttgggtaaatgtcatttcctgttaggaccccaaattcgaattcctttttgagattcaaaataacaaccagttgttggtttcacaatagcactgcaaaagactgaaagttcttataaatccctgaaggaacaaaaaaccatgagagtttttatctacctaacattttgagttttgatcctttggttttagtttgatatgctaatattttatgcaactaattaataataactaattttaataaactcagaacatctgtagaaggtacaatttaggcaactactaaatcatgcacctctttcctggattcattccgtagttttaaaacaaattagtgtccattaaatacaacatatttccattttaaagaaattatttaaattccacgtaatactttatgcatgcatgaatatttgaacatgtaaaacaaaaacaaaaatgttagaacttgtagttagcactctgttcaatgttctagttcaatttctatttttttcgtctatcctataattgtttatcttgattctattattaaatgagtatgctgggtttataagatgaaattaattccaatctagcaatttctaaattcacaattttataagtcttagctatgtgaaaataaatagaaacagacctttttgctgattttataactaaagaaacctgaattgaataattaggacataaaaatatgtgatagtaaagttttctgagaaatggccaccaaaaacaagattcattttcaagtaaacaatgcaaaaattcactaagctgtttgccaagtagtttttctctttctacctttatacttgcactagctctgctaaaagaagcctaatatatctatgattgaggccatgcctttattggaaatagtgaaaataggataatacattcaatattggttcacttaaggtaagcctaaactacaggagataaagaatgccattagccaaatagaaactgtcttaaagatacaacatctaagaagatgatgacaacagcataatatgaaactccagttagttagcaacctgctttggtgataagacttgagctcataggggtatgcgtcccaataaaataattcaaaacgtggaagaaaaaacagagtgtgacatcagaaaattgctgaaattatttctatttgaatactttttttctgacccagagaggtacaatttatcatggaatgaatggaacaatatgtgacaataagaggaaccaatgagaataaattaggctagattgctgtgatacagtgttttgcttacttgaattgcctacaagtttctttgctaaattcaagttgtttcctatactgcttaacgtgccaaatttgttttgattcaaaatgcagtaatgaaaagaaaaaattacattggcattactttatacggcaaagttatttttagatattaatatattccacaaacaaatttattgtactcattctagttgaccttaaaattctgttattctgctattttcctaaagaatataaagatccagtatgaatgttagtgtaaaaaaatcttacaaagctctacctggctttgatgacccgtcattacacagtaagatccctgctgctactggcgctgaattctcaatcatgatagagctgctccacaatcatggaaagatttgttaatttttgcatccacaccccttcactctagtttgaccacacgctaggttgcctctttaatgccaggttccaccacgtgacttgaattagccaatgaaatgtaaacagaagttacacgagcctcttccatgcaccaggtgcaaatcttgtctcattttcttctatctctttcctcccccgcactgccacatgtgaagctgctgattgcctgggttctggactgaagatcttatggagatgagcaccagctggtctcacgcatgtagtctgagcaagaaaccattgtttatctttttttaaattttctgttactgcagcataattaagccttagatcattaataaaatgtgtatttagaagactggaagaaatatattttatcaaatatatttatatcaaattgtaaacagtaacatatgctggatgatatggggtcaaggtaatcttttcattttttgtttttctgcacttaaggaaaaatatctatttaaatattggaatcaaaataatgctttctatgttctcacttatttgtaggagctaaaaattaaaacaattgaacccatgaagatagagagtaagtagaaggatggttaccagagactgggaagtgtagtgggggttgggggagaaagtggggatggtaaacaagtacaaaaataactagaaagaattattaaggactagtatttgatagcacaacaaggtgactatagtcaataataatttaattgtacattttaaaataactaaaagaatataattgtattggttgtaacaaaagataaatgcttgaggggatagacactgcatttatcctgatgtgattattctgcattacatgctggtatcaaagtatctcacgtaccccataaatatataaaacaatgtacccactaaaattaaaaattaaaaaaatactttataaatactataaaatcaaatgctttgaatatattcatatgctgttctaattccatccattgcaggcagttaaaaatttactgtgataaataatgtatcctaatctccctaaatgggcagatagaattacatactttttaccctttaaccctggaagaatagacgtgtctattggcaatttagaggacaaagaaagaagtgtgcagaaaccctgaagcccttactgtccaattctttatggcaccaagagatgttctcacagtctgcatcaagatggctggtggctggtaataagttttatgctagtaagtacttccgtgaaattagttatttgctggatccaaaacttcattagcttatgttaagggagaattatcttcaaagcaccctctcaactagcagggtatgccccatagacgtttgggccagaaagctcatggctgagtctatccaccccattcccttcccctacatttgcatttctgttccttaaactgcttcctgcttccattcatggaagtaagaccctcctcttccctctaaagatcacaccagcagaaacacctctcccctaagtggctttagttttccactcctaaacttattttatgttgtattgtatttgttcgtcttcattagtaaaagttagaaacttagaaacaagaaagcaaaaagtatttagtgattttataagaatatatgccatgtctcaaggagtgatataaacttaaatattttaaatgtttacattctgctaatttctctctttattggagcaaaataatcgtaacgctattctttaagaatacccataaattcacctcaagaaaaacggaagatttaagcaaagatttaaataatgttgtttactaaaatattatttgtaaaagttaacgataaagagaaaaattaacaaacattgattacactgttatttccaaagaagtaaatatgttgcagtaattaaaacttgtgatttttcaaagacgttttgagaaaataagaaatgcttatgatataatgttaaatggaaaataatttaaaagtatgaatatataacataaatattcccattttaattatttcaattactttaaagaaaaaatggaaagaagcaacaagcatctcaggatcacataattaggaattacatgatagtattgttgccccaaaatacataggttttgtgttttttttgtgtgctttcaaatttttcaacaaaataaggcttcactttcacaactgtaggaaaacaaattaaaggaatctctacatgtacataaattccagttttcagtaatccaaacgctattcaaccaacttcttagttgaattaataatacagcaacaatacagtatccattttaaaatccccatagtaaaaaaaaaaacaaaactatttctctaacattttgaggaataaagttggctactatgctctgctatgtagctgagaagacaaacaaacaaacaaaatcctaaagctctttcctggcagcactgcaaaatccgaacattaatgaggggaaagtggcatatatatgtttattcatagtgctcagattgtgtcctagagattaaagcacttgcccagagcaaaactggaagttattcaccaatagggaaacaactgtggcctcctgagtgctaactgaacctttttctttgtaaaggaaatcacattttaagtgtgtacatcatttcacttcttgcccaacatttagccataaggaatgcttaaaatgtgagactggactttacctttaaatctcattaactttagtaagggacaattttttaaagcttttctttgaatttaaaattaaacttaacagccaggtgcatacattattgtaagtgacaagttgttattaaaaacatgtgtattaggctcttaaatgacctgaacttactgtggtcataccaactttgacagaacattatccaaacctttcatgaagtatttgggatagcagcccttatacctgttgatgttataaattctaacaagctagatttaaaacagagtaaataaaagaataaagagtatatttacagaaacttcaattaataatagcttctttcaatagaactattcgtcctcagaaggcacaatcttgaattactaaacattttttattcttttttaaattttggtaaatttaatcacttcattttctaattttgttttctgttgcttctatttttatgtattcctgttttctgtatgcccaacagcaaaaattgacagcctgagccgtgaacttaggcccgcacagaatttcctataggatgcaagcatcaacatttataactgaataagtcgattatacttacatgtcatgtaacttatatgtaaaataaaaataataaaatatgttgcaaaagaaacaaaaatagatgtaaatactggtaaactttaaactacagataaattgcaaagttctttgtaaagtatctaaatccctacttctagctgggacatctatttgagaaaacctgtctccagctcctcaaatataatttgcattgtggctgcctgaattcacagctttgaagcaatcatcatataatgctcctgtcactggcagtgaaaataaagtgtatttaagcctatatttttgaagcatgtgaactgtcctaatgccaatctcctaatatcctcatgccaggaatattttatttttatgttttggtttcacttatagagcccacactaaatgaaagctaactaaacaactatttgggagttcctagaacctactctttcccaactgtctctctaactggactaccctggttcctcaaattgtaccatattaggtctttttaagttaatcattgctctgcattaaaacatcactgaattttattgtttttctactgttcataatatgcttttattatttttatctataattctgtctctgataatttcccctaattcattctgcgttgctttttcctcttcctgaaacagtctttcctcagatgtccacattactcattccccacgagtcaagtgttgactcaaatattcttccttcagtgtggccttcttgcaccatcctatttaaaattgcagctatcatcttcccctttattttgagccacagcactcaccatcatctaacatacttcctcgtttcctatttattttgaactttattcatctctgcctactctaattaaacttccctgggagcacggtgtttaggctatttttttttatactgtgacatacccatcatattgaagagggctctttttttttttttatactttaagttttagggtacatgtgcacattgtgcaggttagttacatatgtatacatgtgccatgctggtgcgctgcacccactaactcatcatctagcattaggtatatctcccaatgctatccctccctcctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttctaagtctttgctattgtgaataatgccgcaataaacatacgtgtgcatgtgtctttatagcagcatgatttatagtcatttgggtatatacccagtaatgggatggctgggtcaaatggtatttctagctctagatccctgaggaatcgccacactgacttccacaatggttgaactagtttacagtcccaccaacagtgtaaaagtgttcctctttctccacatcctctccagcacctgttgtttcctgactttttaatgattgccattctaactggtgtgagatggtatctcatagtggtttagatttgcatttctctgatggctagtgatgatgagcattttttcatgtgttttttggctgcataaatatcttcttttgacaagtgtctgttcatgtccttcgcccactttttgatggggttgtttgtttttttcttgtaaatttgtttgagttcattgtagattctggatattagccctttgtcagatggggaggttgcgaaaattttctcccattttgtaggttgcctgttcactctgacggtagtttcttttgctgtgcagaagctctttagtttaattagatcccatttgtcaattttgtcttttgttgccattgtttttggtgttttggacatgaagtccttgcccatgcctatgtcctgaatggtaatgcctaggctcaacacagtgtaagtgttttataaataatggcctaaataaatgaatgaattctccattttgtttatttgtgtcttctcccttgttattttcctcaactagtcagtccatgaatgtgttcattttattactctttcaataaaccaccacttaggatttgttattcactttttaaaattatttttatctaatttgttgatttcttttcttcacctctgtctgtttggtagggagggagatttgttcctccatttttccatgcaaatctaagtacatagattttccttttcccaacctttgtgttttcattcccatgctatcataagtatacagctttgtctcttaagaacctgtggcaataaatactcttagcctcattcttgactgtaattcagctggccattcatcgcataaaaaaaaatagaagtataaatcatgtaacagtttttttaatgccctagaaaactgtgatctgtgttttgattcattttattcattatttcttttttctttttctggtgaatgactattcaaatagtgatacccagtgagttaacagctgtaatcagacttgcatttactgctgcttttaaaaaattgatttaacggggttgaactcattttaccacatttgattatttaactgtagcttttcagtctataggtataaaaggtcaaatgctaaatttgagtacttaaagtgaggagtaattgaggttgttatatcaagaaaagatttaatggttggtgatgacacagtatttacatgactaatgttgatttttttactttaagttttattcactaatactctattgccacaggagagttctagggctgaatattattcagatgaagtgaaaacattgaacctaatcaattttaaacagttcatttgaatatctattataaaccgtgtgcattcactgccatagttgtaattaacttagctttatgctcagttttaagcttttttatttaatcaaaatatacccattttctgtttgcatgatgaagaatacaaaatctgtctgttgacagtggaattttgatattaaactgttattttaaaacttttaagtatagagtaaaaaaaaaaaatatgtcttacagaaaggcagccaataaagctgatttcagcataaacatgaaaaggcttatgtgttatttatgttagggatattcattactggatgctggtaaaaatctatagagttcattttcttaatgtgacactttatattaactgaatccttttcttaaagaaggtaggatttcagccaggtatagaaagaggattttaggttcaaataggagctttttgggtcatgattacagcattaaactgtctgtatttcctctgattttgaaccaaagaaaattatttaccttatgtaatgatatggttgggcatatgaagtataaaagtgaattagtacagaaaattaaaactaatgtgagcctgttatgaactaaacatttgtcctccacccttcaaattcatatgttgaaatcctaacctccaaggtgatggtagtgagagaaggagacgttggaggttattaagtcataggagtaaagtcctcatgaatagaattagtgccttgataaaagtaacccagagagctctgtcgctccctttctaccatgtgagaatacaagaatgtagaagtctgcaatgggaagggagctctcaccagaatccaaccatgctggcaccctgatctcagacgtccagcctccaaaactgccagaagtaattttttgtggtttgtaagccacccactctacggtactttgttataacagaccaaactgattaagacagagtccttgaattttgcaaattcatttcgtattcagatcatataatttcattgctagaaatgaatatagaatatactcaactaatccctcaattttaaagatataaaagaagaccaccaaatgaccagggcgaaattgcacagagaggagctagttttccagagatgaagggcatgaagtttcctgtctagactccatcatttaacattgaactaccctgaggaagccatttttctaagtttttacattagtgaaagaaaaacgtaggtaagataaagtgattatgaagataaaatgagtggcagacaccctgtaagtatttaaatgtaatgacattttatgtatgaaactcatttaatttttacaataatcctgggaagtaggtaatattaacttccctgttttaggttaacaaactaacgcatagagaagaaactagcccaaggtaatagagctggtaggaaagagagtcatgattcaaatcccagctgtctgatttcaaagcccaggctctttgccattatatactatgacctacaaattggagaagtgtcttagcaagagaaataccaagaagccaggtatgtgtattttaattgtgactcttggtctgtcctttggaccgcagccttttcaacttcaggcttataattttctcccctgcatttcattctttctactctcctagcaatgatgtctcatttagttattcttttaattttttaattgacaaattataattgtacatagtcatggggtacacagtgatgtttcagtacatataatgtagggtgatcaaatcagggtcattagcatatccatcatttcaaacattgatcattttcttgtgttgggaacattcaatattctccttccagctatttgcaactatgtaatatattattgttaactatagtcatcctacagtggtatagaacattgaaaattatttctccagctagctgtaatttcatatcctttaacaaatctctccctcccctctccccttcccatcctctagtattctctgttctactctttacttctatagatctctcaaatcctatcaacccaaacctgtgcctcagcattttccaccaccatcaccctttcaaaactacctccttttatgctgggaaaacggcaaaaaaaaatttcttgaacccatcaaggacccgaggtcacagctaatcaaataatctgaattccaaagacaaacaagacactacaaggaaatatgaatggttccttcaggaagcgtaaaatcgtgtcaagtaaacaaaggtatgttcaacctccactgaagagtgaagcactgcaacttaagcaaaaatatgtcatctgttacaaaaatatatagctgtcaggctacgaagctggaatgggttgggttcctatataataagcgaacctaagcccaactcaatgcaaacagtaagatggaatttatgcttaaccaatcagaagctgccaaactaatctcttactagggactttccacttttatcaatcaaatatattttcatttgcgttttataaaattttccattctaccctcctcagtggagggctaaagcatttgaggtttggtactgccaggctcgtgactagttgaatgctcaaataaaccccttaaaattccaatgtacataagtttatcttttaataaaatttgtacacataagattggtaacataagaaagctgaataacgacaagtattgacagagaagtatgagaggtagaaacctcaggtactgcttctgggcgtttaggcagaaatagctacaccagagatgagctggctgaacttaggaggataaagagtaaagtagaaatcatggttcccagaatatgcccaagaaatttcaacaggaccataaaaggacatgtgtaaatatcctcataaaattcttgtttactaagaagacaattgatagacgtctatcacagagagaattaagaagatacaatagctgtttactcaagttagatggaatgggtataatataaaacctcaaatttcagtaaatcttaaatgactaatgtgtgaaaaagtaagacagataataatatttaccaattcttgactttctctcttttatagtgctttaatttctgcttgaatctttacaaaaactgcttttttcttcatcctaataagtttttgtttggcggtttcaaggcatttgttcatgaactaatttccagagttaaatgtgttagcttatttatttttattcatttttgtttaattttgtttaataatgaaatttattcaatgacttataatttgcctctggttgttggttttgtcatagtttatatgttttaatacaaaatgttgtaatagaaatattgtgtaattgcaaattaatttcttttttgaccatgaaattattttgcaatatgtttcatacttccacagggtaatgaagaagtaatttttagtctgttgctattttccaggtcttttattgtagtcagacaacatatcaaattaaaaaaattcacttctttagatttattggcttgttgaatgtgtgattacttttaaaaatatatttcatgggcttttaaaagaggtgaattcttgtaagaaactgaaattggcaatataccattaagtcgaagaaatagtttaatattataattctcaatttctcattttcttttttgatccaatgaaaatcaaaggtattgcattaaagtttaatatccagttgcattcctattcctttcttcttatattctaataacttattatgagaaaataaagtatacttagtaatttattatgtttgtaatagtttatttcctcaatactatgatttttcatgagtaatattttgattaaaaattgactttttgttattataaaaaattgtttttgatctagtttattaatactggcctataactccttgtaacattctgctttttgtttggtgctcttattttcatatttctatttttaatttgttttatcaccttattttaggttatttacattaaccaaatcatcagtaatgaaatgcatctattttgcatttgaaaagaaaaataatttgcttaagtcaatatattaattaccctagaaccaaaaggagaagaaatagatacattgatttgaaactctcctgtctaaccaataaaacacagaaacttaaccaacaagcacatacaaaccctagattggatactgttttctgctgaatatcaataaataaagtgatagatggttgcatttcaaagctgattacatgaaacttataaagtctggatatctacaagtaacttttatctacaaattacccttcaaatcttattgtgcagatgtaaatctgatacctaaatttttatttctcatcatggatcagcacatacattctttgtttctctgttcaaagacaaagaatattttcagactctagctcctcattaaagttcccaaattactttatgacttagaatcctgcttttcacactatctgattaaccaaatcatatcttagaaactcatcttgctacatgtgctaattataagttcacagactggttctagtcattattttattaaccatctttggaaaaggagagagagagagagaatgtgtgtgtggtgattatactttctatgttaggaaaatgtaggtttatgatgttataattgtttacctctacagctctatagtcttagacttactttagccccttttcatcattaccataccttaaactagatctgcataaaattatctcttttctgtctctgaggctggttcttccatcttatttctaaatacatagcatgtattaaatttattgcacttcttgagatacttcttgataatgtttttctaaaagttgctacttacgcaatgttctataatttatataagctctactaccacatacaatcaaactattacttctaatattactacacaaacatatgcatttccttaaagattaccaatgcataacaaatatatcctagctctcagcctggagtatcttactgacttcttttcaaatgagacttgataaaacatgagcaatatttgcactcttttattgacaataaatctagatccatgaaattttgtatacaatccatagtcttctttcttctttgtttctttgtttcttcctttctttctttttagacagggtctcattcttccacccaggctggagtgcagtggtactatcatggatcaccgaaacctcgaccccttggactcaagtgatcctaccacctcagcctcctgagtagctgggactacaagtgattgccatcatcccctggctaatttttcaattatgtgtagagataaggtcttgctatgttgcccaagctggtcttaaacgcctgggctgaagcgatcctcttgcctcggcctcccaaactgctgggattacaggcctgagccacatcacccagcctaccacagtcttagcgtccactgttttggaatgaataggctcacaaagccagcagagtcagtgctaaattgttttaaaataatagtatgttctttatctctatgcagttccatacattggaaatgttattacctaaatcattgctcttgaattataccatggctacaagccttcagtttgagtaaactggggaggtgatacatagctttcaataaattatttcagctttttgtttgtctcaaaatatcattaccttcacttttgaaaaataatttttctggctatagaatggtgcactaacaggttttgttttcaatattgttctacttttttctaacaagaagactcttgtaattcaaatattagtttctctgtatgtgttttaactatatcccccattctctttctcctccacccttctcctctcctttcattattttattttgactttgatttttggcagttttttctcctctgtaactatgtatctcaccagcagtatatgaaaattccatttgctctgcattcttgacaatacttgatcttgcctaggtatttcattttagtcattcttgtggttacatatagatacctcacattgactttaatttgcatttccatgatgactaatgatattgcacactttctcatatgtttgttgcctacttggagatcatcttttgtaaagtgcctgttcaaatgttattcttctcttttagattgactgtagttttctttgcagaaatcatttttatatatcgtttgcaagttctttgtgagatatacgtactgcatatgcatcctccaaatttttagtttgcctttcctcttttaatgttatcttttggtgaacataatttaaatacaaaaattatcgtttttcttttatgagtaatatattctgtctagtttcagaaatatttgcataatgcataggcataaagatatccacctatgttttattataaaagttttattgtttgatctttcacattcagatcagaaattgatttgtgtaaaagatgcagggaaagtttgttttttgtctgcatatagatagacatctaattgactcagctttgtttatcaaaaagacaatctttcatcattgccacttataaaacaggagactgtatttatttatattggtttctggcctctttattctatttgtttattttttgccaacatcatgcatgttaatatctacagttcttaatgtcttcatgtctgacacagtgagtattctagctttgttcttcccgaaagccaccttagacacacttgacctcctgtatttcctcatgatttttgaatctatttgtcagtttccacaagatatgattacaagtgttttttatacttgtagttgcaacttttacacaagttgcactgaatgtataaatcactgtggaggaaactgacaactttataatagcaaagcttttactacacgaacattgtatattattccatttaagtaggtcttcttcagcctctcagcagcaatttacttgtagttctcaatatcaacctctcaaacatttttattctgtttatagatatttggtattttctgttcctcacatgatattatttgtatattttattttctatttgcttattgatggtatataaaatatagtgtgcatccagcatactttctaaaatcactcaatacttttaagtttggaaattctttaatagtttagcagtttgaatcttctacacacactattgtgttatctgttttgtaaactgattatatttcttgctttctaatatctatacctgattgcttaacaagttttcttatccatcactggctggaaaatcccatacattattgaatagaagaagtgataacagatgtcctaattttattcttggccttagggagaaatctattaatattttaccactaagtatggagttggctgtaggtttgtttttaactactctttagaaggattacttcatttatctttctaagaatttttattatgaatgattgtcaaattttccaaatatatttttctccatctgttgatatgcttatatacttttctccattttctgttgaaatttggagttacattgattgagttttaccttttaataaactttgaattcctaaaataaaaccaacttggtcttgatgaattcaactttatatatattgctgaattaatttttctaagattcctttagatttttgtatccataatcaagagattttgatctgcagtttccctttcttgtaacgacttaagtttcagtatcaggttatagtagcctcaaaaatgaatttggaaactttttttccttttctattctctagaagatgtgttgttccttatatgtttgatagaattctcttgcaatgccatatggttttcatttgagaaaatttataagtaacagcttaaatttatttttagaaaaacacaggcttatactggctttcttgcatgattttaaagttcagttttttcagaactttgcccgttttatctcagttgtcaaatgtatagattgatgttgttcaaaatcagttgattgtctttttgggggaaggaagggagttaaatttttcctttaaataattatagcttcacaagaagttgcaaaaaaatgtacatagaagtctcgttgactctcacccagtttctcccaatggtaaaattttgcatatctatagtacaatattaaaaccagaaattaacatggatacaatccacagagattatttgaatattaccagttttacatgcactcatttgttcaagagtgagagagagagagagtgtgcatgtgtgtgtgtgtgtgtacaactttgtcacatagattagcgtcaccatcaccacaatgggggttacaaaactgtttcatgatacaaagcttccttgtgctagctgtttatagccatgcctatctctctttccccaattctaaccatggtgaccactaatctgttctctatctttataattttatgtcaaaagttagataaattgaattatatgctgtgtaacctttttagattggctattttcattcaaagatacatctaagttattgagtgttatcaatattttgtctcttttattgctaagtaatactctattgtatggaagtatcacaatttgcataaccattcacctatgacatggtatctgaattgtttccagtttttgagctattatcaataaagctgctatgaacatttacaggcaggtttctatgtgaatatcattcggtttctctgagttatatgcctaagagtgtaattggcaggtcattaggataagtttatgtttattcttatagtacactaccaaactattttctagaattctgtaccattttatatgattaccagcaatttatgagtaatctagtttctccacatcctcaccagtatttggtgttatcactattttaaatttttgttattttagctattctaataggtatgtagtgatatctcattattttagtttccatttccctagtggctaataatgtggaatatcgcttcatgcacttatttggcatttttatatctttttggtgaactgcctgttcatgtcttttgtatattttctgattggattgttttgtttattactctcaaattttcagagttctttatatgttatagatacaagtcccttgtcagatatatggtttgtaaatattttctccaagtatgtagcttgtgttttcatactcttaccagggtcttttatagagaaaaagcttaaatttttatgatatccaatttatcagttttttcttttttaaatcatgcttttggtgtcaactctaaaagctgcctggccctaagtctcaaagtctctttactcctctcttctaaaaatgttttagttttacattttacatttaagtccatgattcattgtaagttaatgttatgaggtatatttcttaagtcaagactttttttttttttttgccatgttgacctattggaccagcatcaattgttgaaaaggctatcctttcattcaattgtttttgcacctttgttaaaaatcatttgggcctgggtatggtggctcatacctgtaatcctagcactctgggaggccaagaaaggaacgttgcttgagcccaggagttcgagtccagactgggcaagatggtgaaactttgtctctacaaaaaattttaaaacataaaaaatagctgggcacagcagcgcacacctgtagtcccagctactcaggaggctaaggcaggaggatcacttgagcccaggtattttttgttgttgttgttgttagatgagtcttgttctgctgcccaggctggagtgcagtggcacgatctcggatcactgcaacctccgcctccctggttcaagcaattctctgcctcagcctcctaagtggctgggatcacaggcgcccgccaccacacccagctaatttttttgtatttttagtagaggcagggtttcagcatcttggccaggctggtcttgaactcctgacctcatgatccacccgcctcggcctcccaaagtgctgggattacaggcgtgagccactgtgcccggccgagcccaggaatttaagatggtagtgagctgtgatcacaccactgcactccagcctaggcaataaagcaagatccatctatttgaaaacaaacaaacaaacaaaaaacccatcatattggcaatatttgtgagggacacttattatgtgttctttatgctcttccattgatctatgtgttgatccctctgccagtattacttgatgctgttttgattatttcagctctacggtattttttcaattccagcagaatgtttgctcccactcttttattcctttttaatattgtcttaggtatgtcacttgccttttcatataaattttaggcatcatgtattgtctttttaatgtctgtaggatctatgattatgttctcatttttatttctactatcagtaattcgtgtcttctcttttgttctttattcattttaaattttgtattatatttaatatttcaatacagacttatatgctatattaaattaataccttagtattaattatttttatttatttatgccaaagttcatccattttatttgtctttttggagaactaaactttgattctattgggttatatattctttttaaaattactgattttacctttagtactttttatttcctttctgctttctttgggtttactttgcatgccactgatagcctcagtttattgctacataagacatctcaagtctctaatcctaactgggcatactatccagttcctgagttacctgtggtggctgcacagttgtcttagttttctcccattatctcaagtaactcagtgcgaaactttcctcggccctaaaaaatacatcccagcttttaaaattatcattatttttaagttttcattttttggtgggagctgtgaccaggactattttcatagccaaaacagtctctactttttggcaagggtcaatacacattggttccaattttctttgtaggagctgaattcctggcgatctatgcttatattcggtcatgtagaactcagttggttttgcacttcagtgcacacttactgttttgcacttccatttagactagtccactgacatgatttgtcatggaatttagcctttatgtcttctttaaattttccagtttatcagtcattgctgtgtgatagaagagacagggtggaaggtctgtctcttctatacaaaccttcagtgtttctggaccaactacttcaaagggtatttttgcagtcacacaatcttagggggaaaaaatgaagagaaaaaaataactgtcagaaatattatgaagttattccatataagtggagtctgtgttcccaatataatatcagacttagaggcaatattttacgggacaaaaatcacaatctataggagctgggccctctacattgcaatatacattcagtgtggcagggattttgcaagaggaagataaaaattttgttagttctattatttcttaaatctttaattttgttgatctagatcttgctgcctggttcattccagaagcaaaaggaagagggcctctttaatatttaagtcataaaatagagctcattcatccagaagtagtgatgcagaatgtgcagtgggaatagctatcaggaaacgcaatgatattacatttatcccttttaaaagataattccgatctacttgacacaattaggggagaaatgaaagtaagtacaggcttagaaattctatcagtaagataaatgctttaaatgaagatcaattaagagccaggtagagtgctcaaaacaagtgtcgggaagtgggcaaattgatagtatcaaagctatgaaaatcactaggaaaagttaataggttggcaaagataagcaagccaatatttggaaaagctaaatagttgtgctaagaacagagtgactcactgaagtacagaattcttatttcttttaatatttttctcactgtttgtttctattaatactggttagagaggaggcagatatactcctgggaaaaggtaagaggatctctggagtaaatgataggaaggagggccacatataggtagattgaaaaatggtttgaactactatcttagacacataaaatactgaatgtgaagttctgcaaaacattagtgacagttgagaatatattaaaaatataattgcaaaaatgattgctaacatttttaagaattagaaatgacaattcactgttaaataaaattatttgctaatttttctctaacttatcaccaatatgaacaaatgaacctactgtatatgtgagtataaacaaaaaatgctctgcctgcttaaggtaagataggcattgttcatatgatatgtttttcagatacctaatcaacttgcagcaatttacaccatatgaaagggaagtgctttggtgaatttataaagccctctaactccaaaacatttgtattttttctttattgatgtaggcaaagagttgcgttgctcatagcgataatttcagggcatacagtgagcattatctgagcaaagtcactataattttttacataattatttatcactttttattcccatacccatatattatccaatgtacagtgtttttttgttttttgttttgtgttttttactttaagttccaggatacatgtgtagaacgtgcaggtttgttacataggtatatgtgtgccatggtggcttgctgcacctgtctacctgtcacatagattttaagccccacatgcattagctatttgtcctgatgctctccctcctcttgcaccccccacctccaacaggccctcatgtatgttgttcccctccctgtgtccatatgttctcaatgttcaacgactcccactaatgaatgagaacatgcagtgtttggtttgctgttcctgtgttagtttgctggggatgatggcttccagcttcatctatgaccctgcagacgacatgatctcactcctttttatggctgcatagtattccatggtgtacatgtaccacattttctttatccagtctatcagtgatggccttttgggttggttccatgtctttgctattgtgaatagtgctgcaataaacatacgtgtgcatgtgtctttataatagaatgatttatattcctttgggtatatacccagtaatgggattgctcagtcaaatggtatttctggttctagatccttaaggaatctccacactgtcttccacaatggttgaactaattttcattcccacaacagtgtaaaagcattcctacttctccacagcctctccagcatctgttgtttcttgactttttaataatcgccattcactggcgtgagatggtatccaattgtggttttgatttgcatttctctaatgaccagtgatgatgagcattttttcatatgtctgttgccgcatagatgtcttcttttgagaagtgtctgttcatatcatttgcccactttttgatggggttgttttttcttgtaaattctgcatattggacctttatcggataggtagattgcaaaaactttctctcattcagtaggttgcctcttcactctgatgttagtttcttttgctgtgcagaagctctttaattagattccatctgtcaattttagcttttgttgtaattgcttttggtgaattcatcaaaaaatatttgtccatggctatgtcttgaatagtattgcctaggttttcttctagggtttttataattttgggttttacaattaggtctttaatccatcttgagttaatttttgtataaggtgtaagaaaggggtccagtttccgttttctgcatatggctagccagttttcccagcaccattcattaaataggaaatcctttccccattgcttatttttgtcagatttgtcaaagatcagatggttgtagatgtatggtcttacttctgagctctctattctgttccattgctgttttggttactctagccttgtagtgtagtttgaagtcaggcagtgtgatgcctccagctttgttctttttgtttaggattgtcttgattatgcaggcccttttttggttccatatgaagtttaaagtagttttttttttttctaattctgtgaagaatgtccatgttagtttgatgggaatagccatgaatctataaattactttggacagtactgctattttcatgatactgattcttcctatccatgagcatggaatgtttttctatttgtttgtgtcctctcttacttccttgagaagtggtttgtagttcttcttgaagtggtcattcatgtcccttattagctctattcctaggtattttattctctttgtagaaattgtgaatggaagttaattcatgatttggctctttgcttctctattgttggtttataggaatgcttgtgatttttgcacattgattttgtatcctgagactttgctgaagttgcttattagcttaaggagttttggagctgagatgatgggttttctaaatatggtatcatgtcatctgcaaacagagatattttgacttcctctcttttcttttttaataccctttatttctttctcttgcttgccttgactagaaattccaatactatattgaataggagtggtgagagacggcatccttgtcttgtgccagttttcaaaaggaatgcttccagcttttggccattcagtatattagctgcaggtttgtcataaatagcgcttattattttgagatatgtttcatcaatacctagtttactgaaagtttttaacatgaaggaatgatgaattttatcaaaggccttttctgcatctatcgagataatcatgaggtttttgtcattggttatattaatgtgattgattttgtttattgatttgcatatgttgaaccagccttgcatcccagaaatgaggctgacttgatcatggtggataaacttttggatgtgctgctggatttgatttgccagtattttactgaggatttttgcatcagtgttcatcagggatattggcctgaggtttcctttttttgttgtgtctctgccaggttttggtatcaggatgatgctggcctcaaaaaacgagttagggaggaacctctccctttcaaatgtttggaatagtttgtgaaggaatggtaccagctcctctttgtaatgtccagtagaattcagctgtgaatccatctggttctgggctttttttggttggtaggctatttattgttgtcggtctattcagggattcgtcttcttcctggtttagtcttgggagggtgtatgtgtctaggaatttatccatttcttctagatgttctagtttatttgcatagaggtgtttatagtattctctgatggtagtttgtatttctgtgtggtcagcagtgatatcccttctgtcatttttttattgtgtctatttgattcttctcttttcttcttatttcttgtcttctgctagcttttggattggtttgctcctgtgtctctagttctttccattgtgacattagggtgtcagtttgagatctttctagctttctgatgtgggcctttagtgctataaatttccctcttaatactgctttagctgcattccagagattctggtacattgtctctttgttctcactggtttcaaagaacttcttgatttctgccttaatttcattatttacccaggagtcattcaggagcaggttgttcaattttcatgtagttgtgtggttttgagtgagtttcttgatcctgagttctaatttgattgcactgtggtctgagagactgcttgttaagatttcatttcttttgcatttgctgaggagtgttttactcccaactatgtggttgattttagaataagcaccacgcagaaccgagaagaatgtatattctgttgtttggaggtagagagttctatagatatctattaggtccacttgttccagagctaagttcaagtcttaaatatccttgttaattttctatctaattttgatctgtctaatattgacagtggggtgttaaagtctcacactattattgtgtgggagtctaagtctctttgtaggtttctaataacttcttttatgaatctaggtgctcctgtattggatgcatatatatttaggatagttagctcttcttgttgaattgatcccgttaccattatgtaatcccttctttgtcttgtttgatctttgttggtttaaagtctgtattatcagagactaagattgcaaaccttgcttttttctgttgtacatttgcttgataaattttcctccctctctttatcttgagcctatgtgtgtctttgcacatgagatgagtctcttcaatacagcacctttctgtttgttagttttccttctaacagacaggaccctcagctgcaggtctgttggagttctagaggtccactccagaccctgtttgcctgggtatcagcagtggtgtctgcagaaccgcagattttcgtgatccgcgaatgctgctgtctgatcgttcttctggaagttttgtctcagaggagtacctggccgtgtgaggtgtcagtctgcccctactgggggtgcctcccagttaggctgcttgggggtcaggggtcagggacccacttgaggaggcagtctgcccgttctcagatctccagttgcatgctgggagaaccactgctctcctcaaagctgtcagacagggacatttaagtctgcagaggttactgctgtctttttctttgtctgtgccctgcccccagaggtggagcctacagaggcaggcaggcctccttgagctgtggtgggctccagccagttcaagcttcctggctgctttgtttacctaagcgagcctgggcaatggcgggcgcccctcccccagcctcgctgccaccttgcagtttgatctcagactgctgcgctagcaatcagcgagattctgtgggcgtaggaccctctgagccaggtgcgggatataatctcctagtgcgccatttcctaagcccgtcggaaaagcgcagtattcggctgagagtggcctgattttccaggtgccgtctgtcacccctttccttgaccaggaaagggaactccctgaccccttgtgcttcccgagtgaggcaatgcctcgccctgcttcggctggcacatggtgcactgcacccactgtcctgcacccactgtctggcactccctagtgagtgaacccggtacctcagatggaaatgcagaaatcacccgtcttctgcgtcgctcatgctgggaactgtagacaggagctgttcctattcggccatcttggctcctcctggttcttgactctttatccaatttgccagtctgtgtcttttaattggggcatttaccccagcaatgtaaagtgttgaataaatatttttgtttgtatgcagtcttcaaaaatatgtatggttgttttgtggacacataagtcatacccgtatgaagatatagaacatttctatcaccctagaaagttaaatcatgcccatatcacgtcaatcccacccccgcccacaaatcaattactgttctgctttccattatttgcctgttgtagaactttatagaatcaaatcatgcattatatatttttttgcttcttgtttcttccagtcagtataatatctgtgatattcctctgtgttgtgtttgtattagtagttcctccttttaatctgtgaattctattccactttaagactggattttactttatcatcatttccattttatccagtttgcatattccttttcttgctgatgcacctgagctgtttccaggttttgaatatgatgaacacatctaccatgtaaattgttacacaaggctttttgcatcaacatgatttcatttcttttagataagtacctagaagtgggaattcctgggtcatagggtaggtgtatattcagtgttataaacaatcacaaaacctttaggttttgtgatattttgtgtctctaataagaaaggatgagaattacccttcctcaacatttttcccaacacacggcattatcagtccttttaattttagatacttaaaacagtgtgaaatggtatctcattgtttcaatttaacttcagaacctatgaaaagttttacattcagttttaatgtaggtgtctgctaattctaacaactatacaaattctgagtcaattgattagtctcctcatattggtcttgttttctggtttcatttttcatgcctagtcatcactgaatggatataagacatcatgaattttaccttgatagttactggatttcaaaaattcttataaatattcttgagggttttttctgaaattcattttaaattactgagaaactgtctgatactcttgggtgttgcttttacgatttttagtgggtctggagtggtgctcagtgtagggttaattattactcaccactgacacaagatactctgcatagactacccaatgccctatgaattatgagctattaggtctaactgttgtgaataggcattattcccacccctgtgtgagtaccgggcactgacccttttagttgtttcagaattttttttttttttttaccaggctgaggctcttttctctaatgtatgcactgataatattcagatgaatccttgaagttactctccacagatatttggggttctttctgtgggcaactccctttttgctagagtttggactttttcttagtgaccagagaatagcaatgaaccatcattttataactgaaacaaaaaccataacccccaagtctacctatccatgatctgtagttctcttccttttttgattgctatttcttccccagtgactcttatactgtttgtaggcctagacgttttgtttgtgcatttttttgtcttttgctattttaatcccaggttatgagagccagctgggtgtggtggctcacacctataatcccagccctttggaaggctaagatgaggagattgcctgagaccagcagtttgagactggcctgggcaatatagagagacctggtttctacaaaaataaaaagtaataattagtgggtatggtggcatgcatctgtagtcccaactacttcagaggctaaggtaggaggatcacttaagcccaggagtttgaggctacagtgagctatgattttgccacttaatttcaacctaggctacgaggtaagacctatctctaaaaaaagagagcttgtcaccttcctctctctcactttgggacacttacaagggtgaatataaggaaagggaggtgttaacacatactaattcatcatcatgtcataaatcaaaagtctggcaagctggtttcaatgacaaaaatacattcacacctactagtctacattgtcattggataaaatccttatcgctcataaaacactaatcaaccccagctacatatgtgaaatatagctttgatcctaattctttttcatttttttctaattttctgcttaacagaagttcaataactaaaggtgccactatttctaaacaaaatattcattatagtctaagatatgttcagacttttgagaattctgactgccatattgagagaaaatatccttttaatgtgctattagaaaagtttattttctacaatatacactaaataaaagtataaggaatttatattttatagatatgacgaagtattattttccttaccttaaagccatctcttaattgtaggattagttcaaattagaacatctatttaatggcagaaaacagtcttaaaactagggatcttgaaaatacttctccaaatctctatttcaaattcctatgaaaagttgttttatgtatcttccaaagtatatttgttttattttttctaagaagtaggatatattttaaagttttcataaccacctagatttatttagtaacttttctctaagaaattaaagtgggcttactcttgtagatttaactcaaaaaaaagttctaataaatagatgcaatgagatatattctattttatttttattttatgtattatttagagttttgaacttttcatccagcaacattctgcctggctgcctctttgactgtaaatcagatcccctcagatagagcattgctccaatgaggacttgagagtgctcataggtacattacttactgaattgcactccagcgtcctgacagaacaaagcactggcaagtgtaacataaatttccacaaagaaataacttcagcaataaactctatttagggataagaaagaggagaataacagggcaaactacataaacgtcatcacaacacagcacattagatgacatttttacagtgacatataaaaattaccttgtagaatcttgataggaacttacagccaaactttcttacaggaacataaagccttcttgatatcatgaaaatctgttgcagttcttctcaggaaagtggcttttcaggaacattgtaattctgttttaatatggatgtaagtgctttcaattaatattcactataccgaataagcaggtctaaacaatgtaatgaaattaattaataagtgatgaattaaaccactgattaaacttatttgaagaccaattttactaagtacatataacgttctgacttacatgattgaacatatagatttaataggataaaaataaaatgcaatttactatctctacgtatgaaaaataaatatataacacaaattttgttagctgaaacaaaggaaaaataattcttttataaaataatcctcctgaatgagaaacatatatacataaactgggaaaaattaaatatatatgaatacatcattaagctgtagagacagtgaagaaaccacagagggctaaaataacatgtaaacagaagctgagaagcaaatgaaatgtgtgaaattcagcttttattctgaaaatttctgccaaattttgggagactaaagtttcccgttcccctaggactgtatgggctagaaagaacagaagtttttaatgtgacatgggtagtttaataaaatatgcctgataaatctggtaccccaaagtgccctatgataagccaaagaatgaatgaaaaatgaacccattataaagaagggacagcaaaaatatttatccattttaaacttgtaactggatgaaagaaaagaaaatctcccatgatattttgtaaccatgaactgagtgtcacatggatttttgcttgaatttatgcttacccacatgttcaggagtaaaacttggagcagaaattttaatttaaagtatggtaaggtttgcagtgctccctgatgactgatagaagaaagtaaaatcatctctagggatgtgcaacatcaattcattaaacaaaaactttccaaatataaagttccaagggaaatgagcagttcagagtcaaaaatcataaaagaaaccacataagttacagatgaccctcaaagaatgtaaatatcagaattatcagacgattttaaatatctgaagaaaagaaaaaaactgggaacaagagcctatagaaaacaagtaagatttgggagagaacactgcatttttataaataaagaagacttcaaatttaacatttaaaacaaagattgaacaataaaaaatagcttagctaatgaactagtagacagcttattctcaaaagctatgtggtagtaatatgttttaaaaactagaattgacattttaaggacaaacttccaatttacagtctggtaggtagagagcttagaagttgtcactcattcctaccaacaagtaaaaagctgaaccaactggcgcggtggctcatgcctgtaatcccagcactttgggaggccgaggcgggcggatcacaagttcaggagattgataccatcctggctaacacggtgaaaccccatctctactaaaaatacaaaaaaattagccgggcgttgtggcgggcgcctgtagtcccagctactcgggaggctgaggaaggagaatggcgtgaacccgggaggtggagcttgcagtaagccgagatgttgccactgcactccagcctgggcgacagagcgagactccgtctttaaaaaaaaaaaaaaaaaaaaaaaaaaagctgaaccaactgaaaaatcaacgactcttcttagatctgtcagagaagtaatgtcacagggaaaatcactggcctccaaattggagagacagatgaatacagagaatcacaacttaccagagcaaagacccacaagctgaaacctccatggggaccagtgctgggtaagaaaacctgagctgtaattaataaattactagaggctcagtatagattattttgagagtcaaaaagtccagggaaacccagttaaaggagtacccctacacttttgtgagctttagctcctagagctaaaccaggttttgacagtgaaagaggagaagagaaatgaaaaagaaagaagagaatttaaaaattccttcatgctccttgcaaggggaagaaaaaagtaatcattttgaaatttaccaaagtattctgctattgataaggcctgcccctagaaaaaactgttttcccagagcctagactactgttttgtttgggggcctaactaaactgggggaaagggaatacccaactctagccttctctagctttccacatagaagaagaaaaatacccaactccagtccaatctagctattctgtcccacctggggccagggatggggggaatccatgggagaagtgagaagcacatgtgaggttaacagtccagaggcataagctcattaaaacactgagacctaatcaggcaactgtaggacactttccctcctctgacatcttatcacctcattcctaaaggcctatttatcctgttacccaatacatcatgtccagctatcaggaaaaaattacaaggcatactaaaagtcgcaaatatagtttgaagagctagaacaagcataagaaccaaactcatatggcagagatgatggaactatcagatgagaaatttcaaacaactatgattattgtgctaagggctctattggataaaggagataacacatcataacagatgaacaatgtcagcagaagttctaagaaagaataaaaaagaaatgctagagatcaaaaacacactaatagaaatgaagaatgcctttgataggattactattagactgaacacagctgaggaaagaatttctgaacttgagaatactcaacgaaaatttcaaacactaaatagcaaagagaaaaaaggctgaaaaaagaacccaaacagtatttaagaactgtggaagaactacaaaaagtgtaacatatgcaaactaagatgaaagagaagaaagcaagggagagaaaagaagaaatacttgaagcaataatggatgaaaattcccccaaattaaagtcagacaccaaagcacagatgcaagaagctcagagaacaccaaacaggataaatggaaaaataaaaaaaccctagccatattatacttaaactcagaatatcaaagacaaaagaccttgaaagaaaccagagaaaacaaaacatcttattaaataggagcaaaaataagaatcatatccaattacttctcagaaaccatgcaagcaaaaagagaataaagtaaaatatttaatgtgttaagagaaaaaaaatcccagcaacctagaattctttgtcctaagaaattacccttcaaaagtgaaagagaaataaacacttcttcagacaataaaatttgaggaaatttgtaaccaatttatttgtatacataaaataaatgacagcaataataaaataatgagggttattttattactataaagtactcacagtactaaagcagcattaaagagtggattttaatgaattgtaaatctatattgctaactctagggcaaccacttaaaaataggaaaaaaaatataactgttatgctaagaaaggagataaaatggtattaaataaaatgctcaattaaaagcatcaagggaagaaaaagtagaattcaaaactgtgaataaaggacaagggtaacaaatagaaaacattagcgaatacagtagatgttattccaagtatgtcaataatcactttaaacatcaacggtctaaatataccaattaaaagacagagattgtctgagtgaataaaaaaacaagacctaaccatatgctgtttacaagaagcacactttaaatataaagacacatatatattaaaagtaacggattgagaaagatatatcatgctaacatatcaaaagaaatgaggatccagacaatggaatcttattcggcactaaaatttgagtaaggtattgagcgatgaaaagactactcagggaggaaccataatgcacattacaaagggaaagaagccaatctgaaaagactgcgtactgtatgattccaactaaacgacagtctggaaaagttaaaacttatagagacagtgaaatgatcagtgtttgccagtggttggggaaggaagaagaataggtggagcacagaggattttcagggtggtgaaactactctctatagtactaatgctatatatatgtcattatcaacttatcaaaacccatagaatgtttaacaccaaaagtcatataaaccatggactttgataatgatgtcaatatagattcactgactgtaacaaaagtaccactctggggcaggattttcatgataggggaggttgtgtacaagtgggtgcaggggatatataggaaattcatgtatcttccactcagttttgctgtgaacctcaaactgatgtaaaaaataaagtctatttaaaaagttaaaggaaaaagttttacttccagacacaaaggtgtaactgaatcagaccagctattcccccatagtcaaaataactgattgtcatgttctccctccctctctgtccttctatattactttctgcacagggatagtgttagtgccttctgggatgggagaaaggtccttcgaaagctcagaagattcaaagaagtctgaggaatcaaactggaggagggataaattcacccagataacactatccttggggtatggtgccaggttctccagctagggccctgactttgacatctcacaactacatctgtgcattgaactgtgttgaaagttcacctgctctgactcttagacaagggtttggtcttcagctctttctgctaatctactgcatgagataagggcttctttgtaagctgccaaagcactctggctctcatgcttagttttcaatgacttgctaattgagcatggcttgcattgtcaaaccactcctcatgccaactatgctagtcaggttctccagcaatcagacattgagataacattagatttacagaagttgcactgacaagtaacgtcttagaaaaaaaccaaacaccgcatgttgtcactcacagatggaaactgaacaatgagaacacagggacacaggaaggggaacatcacacaccggggcctgttgtggggtgaagggagggggaatggatagcattaggagatatacctaatgttgaatgacgagttaatggatgcagcacaccaacatagcacatgtatacatatgtaacaaacctgcacgttgtgcacatgtaccctaaaacttaaagtataataaaaaaaatagataaaagaaaggaaaggagaaaggcttacggagaagaactcatcagacggtgatataagatctcgcaaaatattggccaaccccatgggaagctctggaacaaagatttgcttttagaagagcctcatattgggttaagccattggcaagaagaaagtaacctcaactcaaaacctgaggtagaccctaatggagctagcagctagaggctgacagctaaccacactccttgctatgggtagaaccatttctttacaaaggatctaagatattctttttcatctgacacaaacactatcaaataagtagacataatggacatttggacataatggacatatggacatctacaaatggaatgaatatctacagatggaattccatgtattctaaagatacatggaatatttactaagatagtccacctgctgaggcataaaagatgtcaaattcagaaggactgaaattatatagaataatattcctgaacaaaaatggagttaaactgtgaagtaacagtaaaaaaaatcttaaacttgtaaaactcagattatggtaattagcatatccatcatctaaaatattcattatttctttgggaacaaatttaaggcatggaggcattatcctaagcaaattaagacagaaacagaaaagcaaatatcgcatgttctcacttattgtaagtagaagctaaaaattgggtactcatgggcataaagatggcaacgataaatactggggactactagagggagacaaagtgcggggacaaaggttaaaaaaataattcttggccgggtacagtggctcatgcctgtaattccagcactttaggaggctgaagcgggcggatcacctgaggtcaggaattcgagaccagcctggccaacatggtgaaaccccgtctcttctaaaattacaaaaatttgccaggcatggtagcaagcacctgtaatcgcagctactcgggaggctgaggcgggataggataattgcttgaccccaggaggcggagattgcagtgagccgagatcacaccactgcactccagcctgtgcgacagagcgtgcctctgtctcaaaaaagaaaacaaaaacaaacaaacaaacaaaaacgccacctaattcttgggtactatgctcagcacctggacgacgcaatcaactgtgctccaaacctcagcatcacaccatatacttacataataaatacttccaagcaactgctgattctaaaataaaacttaaaatttatttttaagaataatatgataaaaataaaataaaacatgaatgtaaaaaggcagtttatcatttaagaggtaatctagcttaattttttatgaaagtgtctctctagcctgttattaagcacatacaggattgaggaatttattctctaaagtagcctgattcattttaagatgttctttaatggttggaaattattttatgttaaagttaaattttccctcccattatttccacttttcatcctagttctctcctccagaacctctcaaaatcaatccaaaccttactacacatgagtccttaaaaataatcaaaaacagttatcaaatttctgattctttccttctgcagatgaaacattctcagctccttcaggtaccttctcatgtgatttacaatgacccagaaatattctcattccttgcccttcaacattcttcaatttgattaaaagacctccaaaggtgagctttccagaagagaacacaatatcttaggtgaggtcttccccgtgtgaaatacagaagccacatcccactctcacaaaaataaaataaaataaatttaaaaggcatgaagggcaggcaggagttagcttggataatttctttggtagacatacgattgattacttctaattataatctccttcttgggactcatcaggccctaaaactggctaaatagttttatgcctcatggcctttgcacaagctgtcctggtgaaactaatatttgtactaaaaatacaaaaattagccggatgtggtggtgggcacctgtaatcctagcctcttgggaggctgaggcaggagaattgcttgaacccgggaggcggaggttgcagtgagccgagattgcgccactgcactccagcctgggtgacagagcaagactctgtctcagaaaaaaaaaaaaaaaagaaagaaagaaagaaagatcttaccatactcttcatattcaccatcccaaaaaggctgttccttatcactttttccagggcaaccttttcaccattattctctgaccgagtctaatgtttattttcttcagaaaagttaccaaagatgcaattattaatttgcttgttatcttgtctttgtctctcccactagaatataaagtaaaagtttggtaaacaaacaaacaaaaaattaaaaactgcatctgttcatttcattaatatcctgccagcctttcgcacagtgcatgcatagtgtacaattaacacccaaaaatacttggtaagttaataaattaaaaaatgaaatggtgaccaacaggtttttggttttgcgactggatacataagccaagactaacattacaaaaggacaagtatgttgtggggggaaaaagagaatcatgaaggagtctaagttttttggggtctgtctaatgtctagattagaaataaggatctggatctagaagccacacctaaaaaataaatttatatagcacggtcaccaatctatttgacatagttaaagttgtaggattagatgaggaaataatcagatgttataataaagaaataagaaactaagggacacagaatgagaaattaatgtctaaggaaattaaaagcaatccgagaggtagaagtggaactacagcccaataattccattgtttcaagaagacagaagtgacagataccgtcagatggcaatagaagagacctgaaaaatgtttatgggttttgaaatttagcagttattagtaacttttgagagagagcagtttaatggtattttcggagcagaagcccgagagtcatgcagtaaacaggtcagaaaataaaagggtaaataagagcactctgtcaagatgattgattgaattgcatataagaaaatcaaggtagcaagcagagaagtacccaaggacaaagaaggtgtttttttttttttagtttgtttttagatgcaatagatttgtacatatttatcacctaagggaaagagccactggaaaggaaagcattaaaaatataaagaaaatggggacatttgaagaatgacttatgtgtgatcacaggaagacagcggaatgagtattcatgagtataggcattagatattaggtaggaggcacctgtacctcctgcttgtggggaactctcattggtgcacagaagttaaaagaatgataaatgtttaaaggcatttatatcacaaagatacaaagacagagtagacaagtaaacttattcctcaaaagcacggaggcccccttggagttggagatcatttacttgtagtggcacaaagtggcaccaaaaaaatgcatgcctatgttatgttctccatcactgttccactcacttggtaaaagatagtacaaaaagataaaaggattgaccttgggctggaagtctgtaaggcagatggagaagaataatttgagggaggaggattaaaggatactgcctttataaagatggaaagaggcctagcagtgtaatttgacaggatatgtgaaaaataacaaattaaaggagagaccacaaagcaagtggattgcagagagggataaaggtccatctgagatttgtgaataaggagatgtctaatctatgtccaaatcaaatacatagttggatacttgagtctgacataaaggaagaaatacggactggggttataagtttggtattcatcagcatcaaatagtacttaaataggtgagaatgatatgatcacctagggagtaaacaaagatagaggagaaaggagaaccaaagactgagccctggggctctggagcaccaagacgttgtagagatgagagaagaaggtttagaaggagtacagcagacagaattcttaaattcctgtctcctggtgtacaaaccccaaataatcccctccccttgactgtaggtgggacttaataacataattagatcttactcccatgaataggttatatcttatgggaaagatgtaattaaggtccctaatcagtagatttaaattactaaaaaaggaacttattctgtatgggcatgacctaatccagcaaggtattttattattttattctgttttattttactgagaaagggtcttgctctatcactcaggctggagtacagtagcatgttcactgctcactgcagccttgacctcctgggctcaggtgatcctcccacctcagccccctgaggagctgggactatggatgcacgtcaacatgcctgcttaattttttataattttttcacagagacaagagtttcaccatgttacctaggctgctttcaaactcctggactcaagtgatccacccgcctcagcttcccaaagtgctgggattacaggtgagccactgtaccccactaaaatgtaaaatattctcttcctgggcttgaagaatccaacagccatgttttgagaggtttttgagagggccatgtagcaaggacctgaaaacagccttaggagtgggagtgaccccgatctaatagccagcaaaacaacagaggcctcagtcttaaagctgcaagaaatgagttctgacaataatatgaaagaactcaaagtgaattcttttccagacaaacctctagatgagaaaatacccccgccaacactttgattttacccttgtgagaccctgagccagatttttggccagcagaaactgtaagataacaaatgagtattattttaagccacaaaatttgcggcaacttatgacacagcaatgggaaaacaacactgagagtaatcatagaaaattacgagtgctgttctggaagccaaatgattaaagagggaagaataattaactgttgtcaaatgctactgacaaatgcagtacaatgagacctgcgtattaattgttgaatttactaaagagaaaaattgtggaattatagggtaattcaagaggagatttgcagaagtatagaggtgaagctcaaaggagacaaaaaagtggagggttacctaagttagtaaatgaataaaattaaaattttccaagcatgttcattcttctggagtgtggcatttctgaccaaatgtaaatttaatactttgggttgccttcttgtcttcagaagaataacctcatctttcagcgcatctaaatgatgaataattaaaaggatcctcttgcccttgcagcatttccaaaacaagatgaaaattgagaggcatctgaacaacaaaatttccacaaaaataatgttttcaatatagttcatactttgtgtgttttataaattctccccaacacacacgcatacatacacacacacacataactgtaaattctcctacttttacaactctaattattctgtacaggtagtacagaaaagcaacttgaagatgaagtgcagaaaactatcttcagattaaggagtaatgtattatttctataggctatattcaattaacagaacatttagcataagcaattttcaaacacatacacacacacacacaccccccaacacaaacataaggtaaaatacatttattgcaaagacatacaatcaactacaacagtgtagttaaaggaatgcgtctttctgtagttactaacccagctgaagcaaatgcattttttcctaaagtaacaatcatttattgttaaataactattgtttatgtttatcgaaaaacaatgcagtgtaaagctaatatctctgttcctatttcttagtttatttcttttgaagattggtaaggtgtagagatattgattttattctctaataatcattccttaaactgtatttctgaatgccattacaaccccaggaaaagagagcaagaacaagtttagtgctctgtttgcccatttgtgtagcacaagtggtaccaatttctaataatgtgcctacatttatggagcagccgtttgagttttcagccttgctggaatcgtgttttagttataaaaaggccataccgatgagttttagagtggatatgcgttcatgtgaatctaccctagaagaggaagcactgtgtatccacaggagtctagtgttgaatctaaaaagagaagcaaatggtatctcaattctgagaactgtttctcacatcaaattgcattcacttgaacatagtgaaagttgttttggtgcatctattcccgtgattcagtaaggcacatgctttatcttctcatcataaaaggtgtaaacactcttatatgagtttcctggttactgaaagaagacaccagtgaagaggtatttatgctaaagtgaatatcctcattaacttagtcactgatctactattgtaagaggaagtctatgctagttgtacaataaatacattatgatggaacttatataaaataaactcttgccttttattcattttttgaatgattgttacctcaccttgggagaacaaaatacactctttgtgttgctgttggctggtacagaaagtattggcatgagttaatctaccattgttgtgggtagaaaaaaatactctttttctctgcttgaatcctaagactagttacaagttttcacaacaaataagatgatataagaatagtacttggctttttatacagtaaattacaccagtgacatgtaaaaggtgtagagaaaaaaatattctctgacactgaagaaatatttatagatttataggcacttgtattagtcagagttctaccagatatagacagagatgagacagagatagagataaagatagatagagatgatagagataaacagagatagatggaaagaaggaggaagacagaaagggagagggagggagagagaaaaaaagagagagatttcaaggaattggcttccacaactgtacgggtggcaagtgctaaatctttagggcaggttgacaaattggacagtctcccgcaggaggtgacactgtaatctacactcagagtttcttcttcctcagagaagccttggttttgctcttaaggccattcaactgattggatgacgccaacccagattatcaaggacaatctcctttactaaaagtcaactgattacagatgttaaccacatttacaaaacactttagttagtgtttaattgaaaaactgggtactatagcttagccatgatgatgaataaatctgaccatcataacatccatgacttaaaaggcactgggctagcataaagaagtctagattgagtaagccctcctggggcttagaagctgatagagagaatcatgtttggaacatgacataacaaaatttgttataaaaacagagaggagtctggaaatcaggctgcatatgtaatacacattataaagatatcatatgcctagtacaaaaataacacaaacaggaaaagttctgaatggaacctactacatactaaattaccacatgatataagaagcatcatcaatcaacccaaaaattgtcgattattgaagaaattgggctgggaaaattgagtactagggaaaaaaattgagtttgacactgctatcaaaaattggtttgaatagttgagaaaagttaaatgtggaaattctgataaaatggcaatgtaggaaaagcatgtgacactcatgaccaaacccccactataactccaactccccccgaccaccaccaatgcttgaggaaaacaagtgaatataaaaataagtaaaaccttatatcagcactgaaaactagcaaacttgtgatgcacttttaccagttttgaagaattgttgctatataaagcacatgcgggatcgaaataaaagaaagaataagttcaagacagctcactagtaaatgctcagtgctcattccacgatcagaaaaccttaacagaagatttcaagaccttctacctcagaaagttaggagcaacactgaaacaaccatactgttatttaaggctttcaccttccctgggtgcctacaggaaagcagttcagacaaaatatatcttatcatgtaaagtaagataagataaacgaataagaaaactgataaattagatataaaggatatgttagaaagtataaacaagtattttataaaactgtaagctaagtggctcacacctgtaattctagcactttgggagacagaggtgggaggattgctggagtccaggagtttgagaccagcctgggccacacggtgagacaccatctctacaaaattagaaaattagccaggagcggtggcatgcacgtgtattcccagctgctctggaggctgaggtgggaggatcacttgacccaaggagttcagagttgcaatgagctatgatctcttctcaggagaccaccaagaaatacatgaattattggggtaaaaggactatttcagggaaatccagaaaactaatgagttttgctttttaattaaattggtttgatgaatgggctctgtgttcagaaacaggagctcagcaggagaggccatgaagcagtgaagtgctaggaatgggaacataccttgcttgggaggccaaaggggcacacaccaaatcagtgaagataggaacaaaatacacctgggtccccaaagggcaagaggaactttgatgatatatgagttccacacatttaatatatgatgtgcccacccaaattaaggaaaagtaaagaaatggatgaattaatcaaaaatgtttgcttgggatgagtggttaacaaatcagttcataataatgataatattaaaactgttagaacccgaaacaatttacataataacttccataatcattgagaattttataagaaagcacaaacaacctagatgagagtacaggggaatatttatgtaaccttagcccttcattaaacaaaggcatatcagaaattcttcacagatttgatcaaaaaaattattaaaatcataagctcaatcaaaaggtaacagggaaaatttatggactgatttcttctggcattatttttaatttaattattgatatcaagcattatttgtatagcaagaatattaactgttttctgtaaaaactgtagcaatgaacataaacagttaattcccaagaaaacagccataaaataaacataacttttgatccagtgactacagttataatgtaagaaatgatgaaggatataaacaagggggttggctgcaaagatttacagtgcaccactgttttctcctccattggatacactgcccactgttcccatgatgtaggcacactgaaagctcagacttcactactatccaaagtatccctgtaaccataaaccacttgtacctcgaaagctattgaaatccaaataaacttttaaaaaacattgttttcaatggcaaaatgttataaacaaattaaattatctactaagacagaaataagtgaattatggtcatagaaaactcaataatcaaattctagacatctattaaattgaaattattaaagaatagttaaaaaacattcgtcaaaatatattaaatggaaaaagcatatcatcctacccaatctgaattttatgaaagacatttcctaagtaggatccatgaatttctatgaaaaatgagatttaagactttgtggggaggagccaagatggccgaataggagcagctcctgtctacagctcccagcgcgagcgacgcagaagacgggtgatttctgcatttccatctgaggtaccgggttcatctcacttgggagtgccagacagtgggcgcaggtcagtgagtgcgcgcaccgtgcgcgagccgaagcagggcgaggcattgcctcacttgggaagcgcaaggggtcagggagttccctttccgagtcaaagaaaggggtgacggacgcacctggaaaatccggtcactcccaccagaatactgcgcttttccgaccggcttaaaaaacggcccaccacgagattatatcccacacctggctcggagggtcctacgcccacggagtctcgctgattgctagcacagcagtctgagatcaaactgcaaggcggcagcgaggctgggggaggggcgctcgccattgcccaggcttgcttaggtaaacaaagcagccaggaagctcgaactgggtggagcccaccacagctcaaggaggcctgcctgcctctgtaggctccacctctgggggcagggcacagacaaagaaaaagacagcagtaacctctgcagacttaaatgtccctgtctgacagctttgaagacagcagtggttttcccagcacgcagctggagatctgagaacgggcagactgcctcctcaagtgggtcgctgacccccgagcagcctaactgggaggcaccccccagcaggggcacactgacacctcacactgcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaacactaaaaagcagagtgcctctcctcctccaaaggaacgcagttcctcaccagcaacggaacaaagctggatggagaatgactttgacgagctgagagaagaaggcttcagacgatcaaattactctcagctatgggaggacactcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagacgaaatgagtgaaatgaagtgagaagggaagtttagagaaaaaagaataaaaagaaatgagcaaagcctccaagaaatatgggactatgtgaaaagaccaaatctacgtctgattggtgtatctgaaagtgatggggagaatggaaccaagttggaaaacactctgtgggatattatccaggagaactttcccaatctagcaaggcaggccaacgttcagattcaggaaatacagggaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagataagaattttcaacccagaatctcatatccagccaaactaagcttcataagtgaaggagaaataaaatactttacagacaagcaaatgctgagagattttgtcaccagcaggcctgccctaaaaaagctcctgaaggaagcgctaaacatggaaaggaacaaccggtaccagccgctgcaaaatcatgccaaaatgtaaagaccatcgagactaggaagaaactgcatcaactaaccagcaaaatcaccagctaacatcataatgacaggatcaaattcacacataacagtattaactttaaatgtaaatggactaaatgctccaattaaaagacacagactggcaaattggataaagagtcaagacccaccagtgtgctgtattcaggaaacccatctcacatgcagagacgcacataggctcaaaataaaaggatggaggaagatctaccaagcaaatggaaaacagaaaaaggcaggggttgcaatcctagtctctgataaaacagactttaaaccaacaaagatcaaaagagacaaagaaggccattacataatggtaaagggatcaattcaacaagaagagctaactatcctaaatatatatgcccccaatacaggagcacccagattcataaagcaagtcctgagtgacctacaaagagacttagactcccacacattaataatgggagactttaacacccaactgtcaacattagacagatcaacgagacagaaagtcaccaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaatctgctcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcgacactgatcccacagaaatacaaactaccatcagagaatactacaaacacctctatgcaaataaactagagaatctagaagaaatggataaattcctcgacatatacactctcccaagactaaaccaggaagaagttgaatctctgaatagaccaataacaggatctgaaaatgtggcaataatcaatagcttaccaaccaaaaagagtccaggaccagatggattcacagccaaattctaccagaggtataagaaggagctggtaccattccttctgaaactattccaatcaatagaaaaagagggagtcctccctaactcattttatgaggccagcatcattctgataccaaagccgggcagagacacaaccaaaaaaagagaattttagaccaatatccttgatgaacattgatgcaaaaatcctcaataaagtactggcaaaacaaatccagcagcacatcaaaaagcttatccaacatgatcaagtgggcttcatccctgggatgcaagggtggttcaatatacacaaatcaataaatgtaatccagcatataaacagagccaaagacaaaaaccacatgattatctcaagagatgcagaaaaagcctttgacaaaattcaacaacccttcatgctaaaaactctcaataaattaggtattgatgggacgtatttcaaaataataagagctatctatcacaaacccacagccaatatcatactgaatgggcaaaaactggaagcattccctttgaaaacgggctagccatatgtagaaagctgaaactggatcccttccttacaccttatacaaaaattaactcaagacagattagagacttacatgtcagacctaaaaccataaaaaccctagaagaaaacctaggcattaccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaataggtgctggcgaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttagaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcacccataggtgggagttgaacaatgagatcacatggacacaggaaggggaatatcacactctggggactgtggtggggtggggggaggcgggagggatagcattgggagatatacctaatgctagatgatgagttagtgggtgcagcgcaccagcatggcacatgtatacatatgtaactaacctgcacaatgttcacatgtaccctaaaacttaaagtataaaaaaaaataagaataacaaaataaatccaaaaaaaataaaaaataaaaaaaatttaaaaaaagacctttttatctttttgcttttctacgtattatgtgatgaacatacagtatgtaaatatacattattaattatctaatgacaagaggaaataagctatttttgaaaccacctttccaatttataaatttttcttttaattgcatgcaattaatatgtattaggtagagtaaagaaatgattagaaagtattttcaaaaatgtatagagaacatttgcagaaagctaacaaattgagagtcgtagcttctacctagaaaacttgccttattgtgtatagaagtctggaccatcatgaaccatatccagacctcatggggaaattccatgtggttcaaagagctataatcaaagaggtaagtcattcacacacacacacatacactgtctctcacacacacagactcacacacatccacacacatatgcatacatatacacacatgtatacacccaaaatacaattatggagtagaaaagagaaaactgtgacaaagtgtcctggcttggagttggaatatactcagttctcggtttattctatgaaaggagcccccttacctgttcttttttgttgttctggactttactgtccatgatagtctttcttgtccattttcctccatggtcacatatgccatagactttgaagtcacgtcttggcgactgctttctattaatctggttttgaagcttagccatggcttcagaagtcaagtaacgagaggctactacaagccagacttttcatttctttggcgccaacccctcaaaagtttctgttctatttgcctctagatggttacatattcacgttaccacagctgaagttctcaactgggatcatttttaaacccgaaagctctgatcatttatttactggcctctgtgttcttactactcttatccctttcaatttagtggcagtcattttgacatgtcgtttacaataaggaaaaaagaatatcccttagaaaagtatttgttagtttctggatggtgtctgtggtctgtcaaagaaaaattcagggaagctgcttgtgaggagtttgggcttagaaatcttgtctccagcgacagtatctgttcagagccatctcatacaaaggcttcattttggaataaaagcagttggctttttcaacactggattttaaaacccagaggctccattattagatttcattctgttgacaaccttttcatctcagcgagcaaaatgatgtattacagcccaaattcatttcactaataggactttactataaaaggtaaaaataaccaacatacatcaaatttctgcatttttcttaacatgtgctctgtaggcatacaaactgacttccaagatatcacagataatggatttgccacacatactggtatgacatggcaagtgtcacctgctggcaaacctgcaatatcggcacccttgctattgccacccgaccactgagactatgcatcaagttttaggttctgttaaggcatcccatttccagacactgtactaaggctggtgattgttcaaatgttgctttggactccttagggaatcctaaaacaaacaatgtttaccttaaacaaaatagatgtcacaacaagcccaagaaagtaggtcaagtctcctctgctaagccctcagggacacagacaacttctgtcttgtgtccctttaatcttcaagagaagcttcttccatcttttgattcaagacagtggttccagtttctaccctgggaatggagaacaagaccgtatcacatgctgttaaagcacagcccaaaatgtcatagctcattttcattcagatgtcattgaccatagtttagccacatgtccatacccagctacataggaagctggaaaatataatccttagctgtgctgagtccaaaagtctatgatgtatgaaaaagggtgaatgtattgtgaggaaaaaactagcagtttgtatcacttacataagatgcatatttaagtaatcaaaatgatgagtgccccaaaggaaaaattggcagacagaagcaaaaaactctaaaaagaagaaagaaaagttattaaaccatttaaaagtaaacctacctagagatccaagaatgcaactggaaacagtgaacatatacatatttctatcaaatttaaaatagtctaaaaaattataatacctgttgtcatcatgatttcagtgagacatacatctccatattgttagaagtgtgtaaatgcgaacaaactgcaggaaacaaattggtcatctgtctcaagagtgtttacattatgcagtccttttgctgcagcaatttcatttctagaaatccaccttaaggtaacaatgatagatgagataagcgattttcataaaagaatgctcactgacactgtatttacaattgcaaaaatttaaaaatctaaatgcccaataaaagagaatgacaataataatcatgattgagacacatactagaatagtaatcagctgttaaaaatcatgtttcaatagaatatttggcaaacttccctaatgcaacactcgaataaaagtaaaactaggatatgacattattttataaaatggagtctaaactgtgagtaggtattaaattttatatcaaaatacctcaaaattataaagcaaattgtattttttatgattttttgcatttccatgttatctacagtgtacgcgttttaatttaatagatcagaaagtcaatgatgttatattcaaagttattcagatgaagatgactatgttcctcaaaactcaaaactaaacctcagcagattatcaggaaatcgtcttcatttgctcagttcataactgactctaacagctgcttgttcatttatattttctttacttctctttttgctgaacttgttaactcaatgaattgatagatatttgaaaaatgagtttcatatgaaagaaaattcccttactcatcctagtctttctttggctaatgtattttgttattcattacagtgtcctgcccacatgcgtagtggcataaatgtctgctctttgagctcagtcagaaattaatacttttacctttatgctgatttttcataatatatggaatgagttaatgggctcaaattttattttcaccaactaaaattacggagaagaaaattaaaggcaaaaatattgtttaaattgacatgaaaaatatattttaagtaatcacagaatagcaatggttaaccttctctgattgtgccagataccacactaagtgcttagcagttcttggcctattgtgtcctcacatcaattctctgaggcaagtgctatgattagcttcattttacaggcgaggagtctgaagcacaaggagttatatacttgtccaggattgctcagcagtgaggggtggagttgcaacccaatccaaggcaatgtggctacagcgtctgcacatttggccagatcacaacactgtctcatcatatcaagaacgatgatagaatcacccataagttttcaacagcacagcctctggtaacaagagaaagttatgtcctcccttattacagctaaagaaaataaattgcttctatgttgataccatcagagacagtttctcatttttacttttagcagatctgctgtggtacatttgataactcggcagaatccaataaagggaatgacagagggaatatcagattcagaacagacatagctggtcagtggcgagaacaataataaaacatttgatcaccttgagtagtaagcactacataacatcacgatatgcattcatgaatgtgtgtgtgtgtgtgtgtgtgtgtgtcatgtcttgatatgccatatatctgtcctttgaagtatcttcttcaattcatcatccagcttcaaattcagacctgcaaaaatgctctaggcaaaaggtgtcctttcaactgatctgtttgttattgtaatgagagcacattttatgtgcatagcccaatattttagaattaagagcatatacaaaaaatgatacaatattcagtgaaatgttcatcaaatccatccagctgcaccagaggcagcttttatgattctcaaaaggaaagtcggattccttggaacaataaaacaactgcacttatgtaactgacatttgatgaggtgagacaaatgttccttcagatttccagagctggcatatccaaagtagcaggtcagtgtagagcagtgtatgcgtgtgtgcatgttgtacatgcacatcagctactgtttggtctaataattggagcccagctattgtgctggatgatgctctgatctaattattgcattctgccatttcaggtaactctgacaagccatcctgtgcatatgcctcatgactttaattgcaaggagctgaaaataaagctatttctcaagttttttgtgtcttcaagtgccacagcatccagctctcagaactctttacattccctttatgctctatttagggtttcattgaaatctattatatttcacatcataatgagaggggagcaatcaagttgttttgaaagatatcagcaaatatcttggaccaaattccagaggtagttttaatgctcccaggatctttttaacattaaaccctattgacctaggatctagcaatcactcctttcacagtggccaaaaaatatacatgtatctgagatctgggggaaaaataatgactcaaaaatatgaaaaaaataaaattttaaaaaattatgtaatttctgccaacacagcactgtgtcatcctgtgagctacaactcaattattagttacatatgaattttgttacattcattttgatgttgatatattttaaagagtgagaaataatgtacaattgtcatcataaattgaaagaacctaattgcctaaaccctattttaattaatagtaggattgtcacaattctttaccctggttctccagatgttcaaatgtatgagttaatcatttaacataaatgatatatatcattacggtctgttgaaggttggctagtttgggttaaaaatcagcttctaagtctggtccctaccaccagttacacaagggcaattagaaataagcagttatgaaaattctgctacaaaaccagaagactcttttggcatgctgaactttatcttatattcatagccaaaggagaagcctctttttcattaacaattatcacttttgttatagccctggttcataaccttggctgcacatcagaatcccatatagagttttcaaaattacatacacccaggcatcacccaacacctctgaatcagaatctcagaggaaggcccaggaatttatttatattatatatatttttttaaaaattacaggtgatttagatgtactgctgctgtgggaagaaatagcctaacaagttaaaatgggcagatgtcactgatgccttatcatcaaaatgaacttcaatgcggctgacggtgtcgttaatggtgcaatgtgtcaaatttggtcatgttttcaagtgccatttctggttacgttgctgccttgttttaaatggactgaggttttttgtaacttcagttgcagacaatattttctgagagtgcacgagaaatatcaattttctgcagagattataccaccccctaacagagtggaaagccactattttacttctttaatgctgacaaggcatctaaagggagaccatttatctttcctgatagttcaggaaaaagacaaatgcacgtctccttactgtattatcaaaaccaaacaaacaaaaaccaaattaactcaccaaatttgtgaaacaatgacacttgtaatgagagccttttgagataatagaataaaaatattacctgttaaaatgtacacactacactttgaacagaatgacagtttattctcttacattctataaccttaagaatgatttgctttctcttcatcttcactctgtaagaatgcttaccaacagacaaaaagaaacttcccgaattccaacaacaaagtaacaatggatttgaagaaagggaaaacagtaatctgacaacattcagtctttccactgatgacctgaccctttcaaagttgtccaaaataacaagtcaagaatcacttgaggtcaggagttcaagaccagcctggccaacatggtgaaaccccgtctctactaaaaatacaaaaaattagccggcgtagtggagcacacctgtaatcccagctacttgggaggctgaggcaggagaatcgcttgaaccggggaggtggaggttgcagtgagccaagaccgcaccactgcactccagactgggtgaaaaagcgagattccatctcaaaaaataataataataaataaattttaagaataaaccttttgtgttagggtcctggggctcctgaaacaaagtaccacaaacagaatggcttaaaacattaaaaaaaaacaaaaaacaaaaacaaaaaaaacaaaacagaaatgtaatctctcattgttctggaggccagaagtccaaaatctagatgcccacaaggttggttccttctggaggctctgagggaggaagtctgtttcctcctggcttgtttgctgctgacaaactttggtgttccttggcctgcagatgcataatttcaaactctgcctctgtcttcacatgtgcatctctgactctttcggttgccttcttataaggacactggttgcaggatttcagacccatcctgattcagtgtgactgcatattaacttgatcatatctgccaaaatcgtatttccaaataacgtcacattcacataaggtcctgaaggttaggacttcaacgtatattttgggggaacataattcaatccacaacacatgctttcattaattacacagttttaaaaaataacttgctaactttgagtttgagtaaagtaacatttcatttacattcctgaattcagccccattcaaaacaggcgatcttgagtaagctacttaagcctgctcagcctcagttgactcatttgcagaagaccatctcatagaactcttatgaggtctaaatatgacagtgtatataatgcacataatactactacttattgagggcttattatctaatccaaaagtattctttaaatgaacaaattgacacactaaagatttgaatgacttcctaatggcaccagagctaggagtgaaacacctaaatctaaatcctaaatctagaatactttcctaaatctagaatactttccactacatcattttgtgcttatgaaattataaaaatactggatcatttttccatttatttctcaatgttatctatgttagtgagcctcagtcagaagaacgacaactttaaaatttgctttgcaatacaggaagcaagcagatatgctatgtgtgatcttatttcaataaagttgcaaagtaacacaaaccaagtattcacacatacacagatacaatgcctctgaaatggcacctaaaaacaacatgtgtgtagtgtgtgtgtgtgtgtatgtgtgtgtgtgtgtgtgtgtgtgtgtatacttggtttctgcctctttgcaaccgtattctcttctacttataaagtagtatcctcatttcttcagttttcttcagctacaaggaagcctggggcatcaccagccacaagcttggccaacttcaatggaggcagccagaataaaaaatttgacagggctcagttaaccagcactctttcaccaggaaggcatttaaatttgttaactgcaagtatggcaagtataactctgccagctttacttatgcaataagcttagtaccttcaaataaagtgaacttaactccattactagaccaggcaactcaactatttcaggtttcaataaaccacatttaactctcacaatgtcaacttagctataatcaatgtcagcagaaaaaatggttttgttattaatataagagcattttgagctaatcatattatttactaattaattcatcatttcttggctactttgtcttttaatacttggttttaatctttaaaattgtattatgatcaattaaaatagcctgatttaatttcgtctagctttttttgaataaacataattgtttttaaaagaactgttttattgtgtaagtatatttctgcatttctagatgtaatgggaactatttactctaaaggaattaagagatttattgtcaagaattctgctgtgtcataaactaaaacataaaatggaaaatcactgtgaacttactatgaaaaagtgataaactttgttgtctaatgctatgattcataaagctttactcaaaatcctctggctcaattttagaaaccttataatcagtttttctgtttaaacctataatcacttccatttttcatgtcagcagtttgtgacactcagaattccttccgaagtattttaatttcatcaaaaatatgtaacacagataagatccccttctacagcacacaggataagctttctcactgttagcaggattgtcctgtctttttcaggtaaatcttctcaaaatgtaactcacctgatacttataaaaggtataagcattattataaaggtaataattttgatatttttgtataacatgcaataatctgacatagaggtattagtaccaccaattattttaaaagatctatgcatcaggcaggttttgtagataattcaaaatcatattcaaaaagattaaatgaattaagatttaattacccaaatattctcaaaatgccaggcagtatgatagctagtatctattcctcaaatcacccacctcagtgattctaaaagaaataaccccatagggaaatggcacaagaaacatcaatttgatgttcaagacttggttgatcttgccatttatgcccctataatttctatcttcttaaaagcaagaaaattttgtgcttcaaatagcatgagttcactcttatacagcggagggtaattcaatatgtggttttcttccaattcaaagcaaggagagaggacagcaagaggaactttgcagtaaagaaacccaacagacactacttctgccagttggtcaaggtcaacatcaattatcacaagtcatgtcgatagtatgcatccttgatataaggagatgaaaatgatgctatatctgttcttccttccaataactatagcaccagttttatcataagaaaataatcagacgaattccaatattgggcaacctacagaacatctaaccaggattcctcaaaattgtcaagggcatcaaaaacaagagttgtctaagaaactgtgacagctaagacaagcctaaagagacacggcaacaaaacgtaacgtggtatcctgaatgggatcctggcgcagaaaaagaaacactacgtaaaaaactaaagaaatctgaataaactgtggatgtatatgttaataacaatatacaaatattggttcactaattgtgacagatgacccacactaatgtaagatgttaataataggggaaagtgcacacagactatatgagaatcctctttactggcttcttaatttttctgtaaatctagaaatgttctaagaaaggaagtccattagaaaaatcccaaaagtccacccagaaaaaaaaaaaaaggcgagtgaaggcataaaatgcattcacacattttcaacaaaaaaatctactgtgaattaataagatatccttaatcatttgccaagagaatatattgatattctttatccatgcagagattttctcttttttttttttttttttttttttttttgagacagggtcttcttgctctgtcacccaggctggagtgcagtggcgcgatctcggctcactgcaacctccacctcctaggttcacgtcattctcctgcctcagcctcgcgagtagctgggactacaggcgcgtgccaccacgcctggctaattttttgtatttttagtagagacggggtttcaccgtgttagccaggatgatctcaagctcctgacctcgtgatccacccaccttggcctcccagtgtgctgggattacaggcataagccactgcacccggccttccctttctgtcaaacaaacaatgaacacatgtgcaatgatattcagcaaggcaatttagttagaagaggatacaaatcaagaattatgcagaaaatataggccaatggggctagtatcattagtagttttaattagtagtttcttgctattaacctaggtatgtcatcagatgggctccttaatgaattggtcctctttcttgctttatgccactgggctcaactcaatttccctcttaaaaatttgccaaaaacaaaagcaactgtccatcacatgacacgtaaatgggagtacatacctatttcatttaagcaaagcacacttgttaaaacacaactatttttacatgtcagcgaagatggcattgcgagttggcacactgctctcagcttctcattaccacccttcttgcttgcttgcttgctttctcttccttctttttaatgtaaaattctttgctgaagcataacaaagaaataagaaagttcagcccaatggattttcaaagtgaatacatccacgaggtaagcacctagaaacagagcattactgaactcctgtagccccagtgtgtccccttccagacagaagcctccaatggtaaccactatctcaagatctaaaagaattggtttgttttgcttgttttttgaaatacatataaatggaatcctatggtgcatattttttttgtgtgggtccttttagccattattatgaatcctatggtgcatattttttgtgtgtgggtccttttacccattattatgtttgtcagctttatccatgccactgcattttaaaaatttttctgtgattgaattatgccattgtatgaatacataacgacttacccattctactgggttgggttgtttccagtttagcactgttgcaagtagtattgctatgaacgtggctataattgactgttaccctctggttaactttgctgcacctccatggcctagaatctccaggaaggaagtcaactaaatatttcctgaaatcacaagcccatgtgtttgtgcaaaatcacttttaaatttctgcatacctttaatgatgccattcaaaaagggccaaggccacatttttctcagtctacctggtaagtgatgaaagtgttcctctaagtgtaggcaagcaaagaagaaggatggtggtattgaaaacagaaagggctacacttcaggcaggagagaagcttagcattagctgatgtcaatgcagtgtaacgagtgggcatttaatgttatggttatggtataatacaagaaaccaacagagtcctgaacaaaaataaattcctgctcttggacactttacccagctattgccacacaataactttggactaattactagacctgtttctttggtctctgatgacaaagttccccttcaagaggatttccgctgctttccagccactaaaaactctaggtggtaagtgtatatgtgcatgtgttgaaatcctcatacttgaagtagatcttgttaattactacataattgagttaatccaatgtcgcagcaaaatattcttctgaatcccaagttgtctgaggtacaaatttgtcactgaacatcatctgaaactctccatgcaaaattcgtttactgaagcccaggtgagaatctgtaaggaataatttaagcatatacagacagtccccaacttaagacggttcaatttacaatttttcaactttacgatggtgcaaaagcaatatgcgttcagtagaaaccatatttcaaatacccatacaacccttctgtttttcactttcagtataatatttaataaattataggagatatttaacactttatgataaaataggcttcacattagatgcttttgcccaatggtgagctaaggtaagtgttccgagcatgtttaagataagctaagctgagctatgatgtctggttaggtgtattaaacacatttttgacttaatgatattttcaacttaccatggatttactgggatataaccccatggtaagtcaaggaacatctatatatttattttcagcatgtattaatcataatagtattttaagagacattttacaagagagatgaattatagattctgaggctatgacatggccattaaataacctctgctgacaaataaattcagaaaacccttagaaaagaaaaaagttattctccataatttcctctaatgttgactaaaggaaaagaaagtaatcaaggtaccaactttttctgagttgaagtaaaattgatcacaaggtctttcatctgtttatacccgaggctaaagattgcaatcaagctaagaggtttcctttacaataacgtgtaaaaaagatgcttttgtagagagaatttagtatagcctcagagttgcacatttttctaaacctccatagtaggaacatctctgagatagagacaacattggccaaaattttaagtcctcaaacctttagcctacacattacctccctaaaaggggccaaagaataaatgcagagggccgggcgcggtggctcacgcctgtaatcccagcactttgggaggccgaggtgggtggatcatgaggtcaggagatcgagaccatcctggctaacacggtgaaaccccgtctctactaaaaatacaaaaaattagccgggcatggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaaaaaaaaaaaaaaaaaagaataaatgcagaggaggcgagtgggcagagagacatttctcaacactaatcatgattgggctccaaattcttgtcttctctctcactcttgagagaggactggatcagatgggtcaagaatgccatttgctcctagagcacacataaggaagatgagaccaagtttttggataattaaatattttaccaaatgggaaaggcttagaaaattactagctggtaatgagcatgcaataaacatgagctttcatttgtatcattccctaggctcactacttgatcctgaccctatagcttttaatattctgatggtgataagaggcataaaaacataaaccaataaaaatagttttctcactagagcatctcattctgtcatttcttttgtgtcctaaccttaaccatatttggcttctaaagttgcagaaaacttccccaggctcatttgaccatatcgatgtcatggagttctgagagaaagaattcagggagaagcatgattaaagaagggagtgatccctgcaaaagatgcctaacaaatatcaaaacttccccaggataatagcctcaatgtgtattacgtattgtgattaacagctcttacagtggtgcaaggaagcaaaaccaaggggaaggaacaaatcccaccacaatgaagagaggtatttgggccatacaaactcttataaaagcctggttctctactcaagagtctgaggcagaaggattgcttgagcctaggtgtttgaggttacagtgagctatgatcgtgccactgcactccaacctgggcaacaacatggtgagaccgtgtctctaaaaaattataataataataacattaaaaaaagttctatgagctgggtttaacatgtgctactcacaaagtgctttctgtagtataaggataaaactacatccttagaatcttcaagacagaatgctatttatttcccattgtctgtcaacccgaagttgcccccacaaaaacggaggatctaaatgtcagtttaaaatggggcttacatatgtatacatgtgccatgacatgtaccctaaaacttagagtataataataaaaaaaaaaaaaaaaaaaaaagaaaaaaaaaagaaaaatggggcttacaaagtgtgttccattcctaatcacttttgcgaatttgctaaatagtccaattaattggttttcttccagatattttctggttctgcaattccattttgaatgtttctagcatactttgatacaaaccaatcagcaactaagcccatagacaacaataaaataactccaggaaaaaaaaataggcatggttggtgttggatatgaacaacaaacaatatgtgaacataagcaaatcattagggaaaatcttcattttctccgatattttcattttgatttaataggcacagaaaacatatgctacaattatggaaggtaatacatcaaatgaaagatacatcacataacacaatgagcctttggagatgtgtgaaatgatagcacaaggccctgaaaactttaaaaatagaggcattctgagtctctgcaaacctttggagaattaagagaaccaaataaggcaatttattactttctacagcttacaatcctaagagatttagggaatgtacatttatatgcttcttgtataaggttggttaacacaggaggtcagggtattttctttacatttcatttctgtagaactcttgaaattacatagatttgaatgccagagggaaaatagaagtttccgttgcatgtttgataagaagcatttcaagttaaaggtcaatggtcaatgttctgatgagtggcctacaagcccgagcttttgcaaataatggcatgtgctttccttctccaaaaataatgacaagcagatgagaagggactcccagatggggaggccaattgaagggcaaatgagcctgtcctgcacttgaaaatcagagcatgtgacagagagcaagtaacacttttcagagctctagtgggctgatttgcatccaaatagcaactcgagacaagcaatccattcttttaatatatattatttgtcttttggggcataggaggctatactaagaaaccatgaatttcattcctcaaaaagtttaccatcaaagaaaattataggaaataaaaattactaggtacctaaacaaacaaacaaacaaacaaaaaacagcaaaaaaagaggctcaagaaaaataaatttgttggatcaaaattttacatattagaaaaatatatatttgtgcaaatagtaaacccaatctaatgtacaaaaactttaaaatattaaggacatccaattggtaacacaatatgttgctattaaaaataatagagtacttctagactaactataactttggtacgaggatcttactgtttccttcaaatcccaataaaagtgatgaaagaaaaataaaatagaggagtaattgcagaacattgaacagaaaatcaaggtgacattcacgtggcgcaatctttgaggtagttccacataaattcctaaagatctagcaaattctttgaaaatcatacatttacataatgaatcctggggggacaggaagaatatggaactgagagcaaacagttcaaaaccttgttgacatctgctgtactcagaggcaaatgctgtgagataggagttcagcagactccgcagataaaacaggatgcagtaaagaagctggccaaacctcccaaaaccaagatggcaaaaaaagccacctctggtggtcctcactgctcattataccctaatcataatgcattagcatgctaaaagacactcccaccagcaccacgacaatttacaaataccatggcaacatccagaagttactgtacgtggtctgaaaggaagaggaaccctcagttccaggaattccacaccccattcctggaaaactcatgaataatccaccccttgtctagcatgtgactaagaaataatcataaaaatagtcaaccagcctatggagtagccaccctttcattcttttatgtcttaataatttgctctcacttaactctgtctgctcactcttgaactccttcctgtgcaaagcgaagaacctatatgacttctcaaactgaaccccaactttgaggttcgccctgtgacacaactatgtgaaataagaagcccagtggtggagcctttccctgacatggtaggccgtcctccaggatgatggtggacaccatccttgcccgctcacattctgctgagaatgaaggctcagtaaaaaattacatatgaaagctggcctttgccaaagaagcatagctgtctacagagaacaaactgtactaaaataaagtctgtttatttccccttatcccaggcactggatcatagaactgataacgtcaccttttatcaacaatttcttctgcaaaacatactagaaaagaattttaataacatccttatggacagtgagaggacacaaacaaagcttctgactacgtttctgatgaataccaggctgcaatggtgtaccaacaaaatccaatatcacacctggattttactgtgcgaagttgaagaagcaaaagaatattgcttggtattgatctttcctaagaaaacagaggtaaattatgatgtattaataagtttacagtaaaattctatgaaagatgaagtacttaaaatagggaaaaagaaaagatgataaaatagtaaaacagagctgaataagacacagaaaaaaatgtaaaaaattagaaatgccatggataaaagcagccttacagaagccaaaatacatcggaaggtttcatctaagatatgaaattaaccaatttactacaactaccagaatgcactgaaataagacagagatgaaaactgcaagagaaactatgataggctatttgacatcactgaaaaagagactgcaaaaaaaataaatatatttttaaatatatgatatatatatttttaatacatcatatttcataaatattatataacccctgagatgaaggctacaatcttcatatctcaaaaaactttcaactttccagaaacaaaatttaaaaaataggggaaaaaacctaacataccctggtaaataaaactttagcatcaaatccaaaaaaaagtcatacaagcaaccatgcagaaaaacaaaagaaaaatataaaaactcgccatagactcttctgctttattatttgtaagaacactatgaaacaagactacagatttgtgagaagtaaaacgttataaacagaaattctagaacaaacaaaactgaatgtttcacatattatacaacaaagcattctcaaataccctcataaagcaaacatatgttacttacctttaaaaaacaatttagagacatattctaggtaaccatgagacagattgaaatcaggaactcaggaatagagaaatcaaggtggagaaaagttacctgacagtgacgtctcatcacctccatacacagctaagtctaaattgttgtaaatgccattatttaaaaagaatggaaactgtataaataattattgaatagtaaatacatactacaaaatattatataataaactgggaatattttgcaaagtgcataatgaagatagtattttatttgtaaatatctcttacaaattttaagcataaacactactgttaaaaccaaaaagaacacacgaaaaccacacacacacataaacaggctaaatcccaaaagaaaaacaaagccacataaccatttgtttaagagatttctaaagttataattttaatcatctcatcttggagtgtaacaaaaagagaaccagctatcagcctgtgtatcaggaattttccgcagaaaatttgtattactttctcttcctaaagagacgtaacagacaaaattattatgtgtaggttacatattgagcatatcttatttttaaatatataataaattattatcattgtgtacttacctgtaagacttggccagaagattatatgactgaaataaaaacaattgagtcaattagaatttccagtttctacctggcaattctaaggaaacaaaccaacgacaagagccaatgctgatgtaacaacatggtagaaatagaacagtcaagaacactgtttatgggaacgtaaattagtatagccattatagaaagcagtatgaagggttctcaaaaaactacatatagggccgggcgcggtcgctcaggcctgtaatcccagcactttgggaggccgaggcgggcggatcacgaggtcaggagattgagaccatcctggttaacacggtgaaaccccgtctctactaaaaatataaaaaattagccgggcgtgctggcaggcacctgtagtcccagctactcgggaggctgaggcaggagaatggcgtgaacccgaaagtcagagcttgcagtgagccaagatcgcgccactgcactccagcctgggcgtcagagggagactgcgtctcaaaaagaaaaaaaaaaaagaaaaaaaaaagaaaactgcaaatagaactactatataatccagcaatcccactacggattatccaaaggaaaggaactcaatacatcaaagggatagctgcaccccatgtttactgcagcactattcataatagccaagatatggaatcaacataaatgtccatcaacagatggtggataaagaaaattgtggtatacatacacaatggaatactgttctaaaaaaagaatgaaatactgttattcacagcaacagggatgagtcatgttattaattattaatgacttattaagtgaaataagtcaagcacaggaaggtaaataccacatgttttttactcatatgcggcagctaaaaaacaattgaactcatggaagtggagagtagaactgtaggtattcgaagctgggaaggggaggaggagaggatagggagaggttggttaacgggctacaaaattgaagctgcacaggaggaatgagctctggtgttctgcagcactgtaagatgaagatgattaactgcaatttattgtatattttcaaaacgctccaaaagaggattctgaatattctcaatgcaaagaaaagaatgaattctttgtgatagagatgctaatttccctgacttgctcattatgcattgtatacacatacggaaatatcactctgtatgccataaatatgtacaattatgacatgtcaactaaaaataaaaggaacaaaataacaacacttttaaaaaatttaaaaaagaatcagccttttctgacagtggctaaggaaaagtcaacaacctcaaacggctataggtaggcagatctgctaaagtatagattttcagacatttgctaggagaaccaaccaagatttccccctaagaagtacctgcgaccaaatctcagcctcaggagggcccaagagaggtcgtcagggccatattctttgccagccacactcaaagacaaggtccacactgtgagccctgggatcataagtggacaaaggggaataagggatcggtggtactaggattgacttttttattgttttcattttctccaatgaacatacataatgtttccattcaaaaaacagaataatatttttcaaatggttgttgcagataatatgtgatatgggccacattcatgacataagtgctaagtgtaaattttatttacaactctgaggaacaaaataagcttggaagggaatatttaaaaacaaaatgacatgaacagtaagattatgaattattaaggtttgtcctctaatgtctaaacattccataagatggttatatgttttaatcattttagatattttaaacataattggaatccaatcattctgcaacacatatatattaagacatatgtaccagaatagtatcatatcttctagcctttaaacagattacaggaggatcaatgaatcttaatatatattagaaggccttttttgattcgaagcattcacaaataataaaataaacctggagatttaaaacggaggtgattttcaaaggaacatttttttttggaacccactctttttagaaactgtagtagtaatcattgattaattattggcattgctggaattttacaagtgacaaatttcacatctaatcatggatgacagaatctccaaagactggatatattgcaactaaagcaatcaaacaaatacaagttattttggatacagcaaagaccacagaaagactttaatgaaatttcagtaatccttgctaggagagaaattcacaaggccagagaaccctaacttctgaaactattgttcttcagagcatttgaagagcccattgtcagagaaattgaagtggatctggcttttgatttaaaataagttcctatcatgaactgtcacttccaggcattccaacctcaggcacatgatgagctgtggatggcagaagctataatcagaggtaaagcaactggtgataaagtacaaggtgccataagtttcaatataaatcaatagagaaattccatctctatccagttaaatcatttctaactttactgtcttacaggaaatacaacctgtgtcaaaagaaaggcaaagtcagaatctactgctataattcctataacgtctattttcttaacagtgcttcagcaaactcttttggtgctgttatgtgaaaagtatctccccttaaccctgggtgcaagggtagaatcccattgtgttggcaggtaagagctcacagctgctcccttctccaggaattgccctcagctggcaaaatctgctttaccacagcctccttagtcatagccaccagttaatgactgagtgattttggagtacaaaaggtcaacaaccttgccattcatgcagtgaatactctaaagttcccagctccccacgccccacacacatacccagcttccatgtatcagaccatgcccagccttcatctgataccacatccttgcctggctctttctccttcccttcttccctctcttctctttccttcttcactccctccactaagggatttttcctgaagatcacttcctcagtaaataaatcactgtcacctgaattcctatttcaggcactgattctacagaaccaacctaaaacagaacaaaaatgaaaataaacatacttaaaaatcaaattaaattttaagacttaggctgcacaaatctctggatattccatcaatgtgtatttgaccttctttattcctctcccgaagagaacttctccagtgtatcttattccccactgcctttaagacactgacatcggttcaacaattgtatgttgacttcccaggtgtatatgacaatgcttaagactattgctaagcacagccttaatgtttggaataacataatgacagcaagattcaactcctagctctaaaaaaaaaaagaaaaaagaagattccactcctgacatactcggactgcagttttgtatccaacaactctgaaattagtaggagaagaaaagatacactctctgcccctcaaatatttttatcctttacaaagcagaaatgcagaacacctttgatgccaagtgttacttaccctacactgcccttcctcacctttctgtggctcctaaaccacttaacatggtgtgtggtggctcaggcttgtaatcccaacactgggagataaggcaggattgcttgagcccaggagtttgagactggcctgggcgacgtagcgagactctgtctctacaaaaaaattcaaaaagttagtcaaccatggttgtgcgtgcctgtggtcccagctacatgggaagctgaggcagggggagcacttgaaccaaggaggttgaggctgcaattagcagttttcacaccactgcactcaagcctgggcaacagagaaagacccgtctcaaaaaaaaaaaaaaaaaaaaaaaagtgagagaatttgttttgatttgctttaattcctcctaatgagagttttaatttccatttcaatcattggggaaaaattttttgaaagcatctgctctgtaccagggcctggagattagggtaatgaaaaaacagacaaaatcctttttttttttaaatgatgcttacattctaactgtggaacacacacacacacacacacacacacacacacacacacacactaaaacaaaacaaattgtgttatatccagacaatgaaatatagttcagtactaaaaagaaataagctatcaagccatgaatagaggaaacttacatgcatgttactaagtaaaagaagccaatcagaaaaagctacatactgtatgattccaacaatgttacattctggaaaacctaaaactatggagacagtaaaaaagatcaagggttgccagaatttcggaggaagaaggaaggaataggcaaagcacagaggatttttaggacagtgaaactgctctgtatgatcctacaatgttggtgcatgtcgtacatttgtccaaacccacagaatatacaataccaagagtgagccctaatgtaaattatggactctggatgataatgtgacagtgtaggttcatcagttgcaacaatgcaccagtctggtggcagatgttgataatagaaaaggctacacctgtgtgtgggcagaggctatatgggaaatctctgtaccttctgcttagtttagctgtaaacctaaaactactctacaaaataaaacctacttgaaaaaaaaaacagaatgcaaataaaattataaattctagtaaagaagaacatccaaaaataactttgtctctaaattttaatataacattttaaacaaattattttttcctccataaattgcattctaggccaaggagcttagtagtccttggaatgttttagtaaaatatagattgatcaaatatgttaatatgaccttatttccattacaactcagagaagggaagagtatattcatctaaagaaagtaatggtttctccagtaaaataagttgaataatttcataatttaacagtggcattatttgaaatagcaaatacttgataaaagatttatctataaaatgcacacttaaactataaaaatattattagtatttttggacaattagctattgttctgcacaatttcactaataaaaatttcactagcaaaaattaaaatggctataagtagctaaaaggtgcagactgtgaaatcattcctcaatagtggtcacttaaatgaactgttctctcaatgtagatggtaggtttacccaacagttgcattgcccaattatttgcatactaaccgtgtcttgtgaacactgcagcatccatcacagcctttgtttcatgatccacattgagactgtgcttccaactggaccacaggagtaatggtaactttgagattactttgagattaacaaccagatctgaaaaaggaatcacacacagctctagctgcaaaagggactgtaaactctatgagatggtacaatgcttgaggaagatatgacatatccccagcatagaagatactaaataaatgcctatggaatgaatgaataagcaaaaacaacatacacttatattgtgaaagctcgaattttatgctccttcgtgttcccaattaactcagaaggaatacttcatggaatcatagaaaattatttccccagtgataaagaaaactaggttaaactagaaggcatactataagtcattttgtaactttaatatataggttaatgattattgactggagtttgagattaataggtcacacttgctgtagctgtaaaaataagtactgtgtaaaatatgtaacatctaaaatgtatttaataaaggaatgtgtctaatataaatattttcagggatattttattaaatagatttttctcacatctttcaataaggagtcaggcaaaaaacatactattctatctatctatctatccacctcactccttttcattgctgaatcccaaatttgctctgattaagtggtagcattgattctatagctggtttcctttcttgactatttgaggatctcctatagttcactcttaagaactttgcaagatattgcttaaattctccttcagtctagccagttttattctgaccttctataccttctagatatttacattgtcttttcatgaacctacatttaagtttcacaggtgtcttttttttcttgcaatagcttcattgactttgcctgtcagttatgctatgaaaacttgcaacagactttatatacttactatactcatacttaaaaattaaactaattatttaactaagattaaacataaaatttattctttatcaaaaaattaaaataacggaaaaaataaaaataaaatagaaaaaaaatagaacatgtggaaaatacaccaaaaatataaaaaataaaaacataataaaaatgaaatttatgctcatcaaatgtacagatttcagaaagctggaaagtagaataatatatcagttaggtacaaaggtaattgtggcatttaatgacaaaaaccacaattacctttgtaagaacctaataataaaaccaaaattaaatatcactatgagagattggatctcaaactcaaaaggtgaatttaaagccctgtatttatgttcaaaaaataattacataagtacagaatgagaagataggtaacatagctaaaattcacttggaaaaaacataaaagttttaactgtgaactcactaggatcaattttaggatgggacaacttgaaaactaaatccagtctagctgcattgatagaagtcatatgaaagtaaaattctactgcattctagtgcttctcaaggttttctcaagaatattttccatctaaatacaacttttaagaaaaaatcaccagtggtgttttcaaccttaatgcttcatcaatttgactcactgaactgtgtactgaaactattggagctacttaggagtgagataaagtgctccactgagaaaatccaaagagtgggaagtcaagaatgagacagcaagtagaaaatgtgaaatcattggggtgaaaaggaagactccaacaaaaggcaataaaatagcattcactcaaatactgatgaaatgttctccattatccatatgccagcagctgaatgacaccaacaccatgccattacctaagtaattgcacacatttgtaattcacaaagaactaaatggatatctgaatttatcttattttcatctgccttctattcgatttgtcattacaagtatgtgaattgttactgtttgtgtaactgctcctgatacatgaaacgttaagtagttagcaccaagaagatcctaacacatttcaacattacatcatggctggtggtgaaatgatattacatttacttttttttagaaagtttgacttatatagtgtgcatttcagtgaatctgttattaatgatattttcaaacattatataattatctatttcaagaatcataaccacttcccagaaaatggttctcctattcattgaagaacatatgaagtatattctgcatatgttgatatgtacttgagagataggagaaaaaaagtactatttctgtatcacatctatttactgatttgaaatactattattattattattgcccaaatgtttattttgcaataattataaccacactaacatctacccaacaactaaaaaatgaattcttagtcttctgtaaacacaataagcatcacaccattttaataattaaactgaatgccttccctttacatttctcctacttctccaagtcatctcagccccagccactctctaagtaaaaagaggagaaagaaatagcaggtatttgggcaagtaggtttttttacactaactaacattgtttccctcataaaagcaagctacagataattctttcctgtattcttaatttctcagcaccactagcaggactagttcaaaaccatggtacaatatcaaattcaagtacgctaatatcataataatgaggatccctgttaaaacatcactgaacattagaatgtaatttaatggctgagtggcttgaagaatttaatctccttcctcaacatggcacaagaactgctgctactttcagcataaaagtccagcagatggtggaaagtctagtctgataagtataacaggcttcatcaagtacagaaggatctgtatgaattaaatgtattacacttaaaggtattacataaataaagtcactatttcccttcttagaaatgtcttgtcctgacttttccaactttccttttctcccaaagggaaaaataaacaaaaatccaacgagccgtgttggttaaacattcacatcattcctattgccatgagtacacagctcaacacacacatgatttttaggaatatataaagtaagtcaaaagggaacagacaagagagattgagactaacttccagacatttaatataattattggatcaatccagacaataataaaactaatttgattcttcactgaatgatctgaagaaatttctctttgatatcataatctctaaagggaagaaataatgagaaataggtcagtgaaatttaacactggatatcacaagaatgttatggattataccttccaccaaaacatacagagcctttttatgagtatccatgagaaaaacttcactatgattttagtaccagaaacatttctcatttgaaacttatggacatcatgattatttcaactgcttatgtttctctgtttgttctagctactgaaaggtccaagccaaagttttaatccccttcttacaaatgaaaatgactttctgtgatgcttctgtccctgaatctttcatttggcattagattatcttactatttctttccctatacctcaggtatgtccaaaagtcaactccggttctctaattctctttttaaatgtatggatcaaagtttaggtcttactccattttgtgttgctataaaggaatacctgacgctaggtgatttatgaaaaacaaaaaaagcattgtttgtttggctcatgattctgatgcctagaaagttcaagagtgggcattggcatctggtgagtgcctcaggcgtcttccactcatggcagaagcctaaaggaagccggcatgtacagatatcacatcacaagaaatgtggaatccgccccatcaccaaaacatacggtttggaggggataaacatccaaaccatagcagtatgtataaacaagtaaattgtatattgggattcttattgtttttttaaaagataatcagtataatcctttaaaagaaacaagcttttggccgggcgcggtggctcacgactctaatcccagcactttgggaggccgaggcgggccgatcacgaggtcaggaaatcgagaccatcctggctaatacagtgaaaacccgtctctactaaaaatgcaaaaaaaaaaaaaaaaaaaaaaaaatcagctgggcgtggtggcgggcacctgtagtcccagctactcgggaggctggggcaggagaatggcttgaacccgggaggtggagcttgctgtgagccgagatcgcgccactgcactccagcctgggcgacagagcaagactccatctcaaaaaaaaaaaaaagatacaagcttttcccagttctactttcagtggaacgtcctttggctttatgcgcaaaattcatcaagcaatacgaaagaaagtatcttccaagacaattttatagacaatgagcagccagttttaaatgattatttcctgtttcaatctttgattaacagttgaattctttgatttcagaatattccccttaattgaattttcttctaccatactaatctacagattcccagtcttccctcttgttccttaactggtaattttggtgcgctcagcccttggtccattctcttctctgtgtactgtctcttccttggatcacatccagtctcatagttttaggtaccatctatatgctggccagtcccaaatttgtattgccagcctagactactctcccgatttcaagattcatacatccgacagctcaacattgccccctgaatgtctaataaacattccaaagtcaaatttctaaaatcagactcatgatctcatgattttcctcccaaacatgttccacttatagtcttccctgtctcatttgatggcaacactatccttccagttgttcaggccaaagctctggaattatctttgactttttctttcccgccctgtatcaaatccattcgatattctcttggatctagctttaaaatatttccagaatccaaaagattctcaccacttttcactgctacaaagccaccaacctctcttacttaaggtttacagcactaggtcttctcatttctttttacatatatttattatactttaagttctagggtacatgtgcacaatgtgcagctttgttacatgtgtataccatggtatctccacactctatttttcacatggaagccagactgagccttttaaatcgtcagttaaatcatggcacttctcaacccaaaaccatataatgattcttcattcacttgcagtaaatccaaagtccttacaaggtcccacaagactctacaactactggcccctccattacttccccgacttcatctccactttcacctccccaacgctgctcagccacactggcctccttgttgtgagaacacaccggggcactctacttgccttaaggcctgagttctaagctgttctctctgactggaaagctcttctcccaaatatcctttggcaacatcctcacctgtttcgaaatttgttaataattgtatctgttcaatgactactaattcaatactacatccttctaagctctttccccacaattttccagccctcctaatcccccttacacttctaaaaattttttgtatatcacttatcaccttctaacataaaatataaatcactcatgtattatgtttattgctttttgtctttatccccttgctagcatgggatacccagaaagataaggatctttgtatggggctctgatatgctctggacacatagaacagagccaggaacatagtaggatggtaggtgctgattatttcttgaatgaattcatacaggctcataattcaattgaaggaagatattcctgggagaaccaaagtaacaaaatatagtaataaaattgagaaattctggttcctgccctttatcaagtgagtttcctggatatcattaacaaaaataagaaacatcagttctacagaacttgtttaataaaaatacattaagcacaaattttctgagaagtttacttgttttgttttgtttgttttgtttttgttattgtcttaagtgaccatatatatatatatatatatatatatatatatatatatatctcctttaagttctgggatacatgtgcagaatgtacagatttgttgcacaggtatacacatgccatggtggtttgctgtacccatcaacccgtcatctacattaggtatttgtcctaatgctatcccacccctagcctcccaccctccgacagtccccactgtgtgatgttcctctccctgtgtccatgtgttttcattgttcaactctcacttatgagtgggaacatgcagtgtttggttttctgttcctgtgtttgcttgccgagaatgatggagaaataggaacgctttcacactgttggtgggagtgtaaattagttcaaccattgtgcaagacagtgtggcgattcctcaaggatctagaatcacaaataccattcgacccagcaatcccattactggggatataaccaaaggattataaatcattctactacaaagacacacgtacacgtatgtttattgcagcacttttcacaatagcaaagacttgaaaccaactcaaatgtccatcaatgatagaatgaataaagaaaatgtgacacatatacaccatggaatactttgcagacataaaaagatgagttcatatcctttgcagggacatggatgaagagaagtttacttctaatactctgagaacatgcttttcaacatagaaacatcagctgtttttcaacgaagtatgagcccctaagtttctaactggcaatgtccttctccatctgcagtttgaagtatttgattggtatcaactaaagcaaagcaacattggaacaggcactagtgcatcatgatgaagaaatgtcagttaagagtggtgttataaggaaatattcagctgagacagccttgagcacggttgagacataggggagatcctcggcacaagagaacacagaaggcagtgttttcaagcattcagtcttgaatattgcttcaagactttttgcgtcaggaaaagaggtgcttcagactagtctttttaaaaacttttcaacctcaaaaagagaagtaaagtttgttactgaagaactattaacatggatgtttacataaacataagcacatttaaacaagaatgaatagatcaaaatcactttgcaagaagctaaatttacaaagaacacatactctatacactcaagctttgcttttttgtttatttgatctactttctgtatttggcagaagaaacaggaggctggaggctgggacagattttattagatggaaggagcagaggtcaggaaattatactcctcagttcacagagaatattgacatctttaatcctattttttttacaccattcctccttctcaattcctgttttcctcccccactcccatagtcaaccattttcatatattcaacatatatcattttcttgatatgttcttataaaatatatgggcttggttggttttcatgtattttattttgtacaaatagggttgtgttatatatttcaatttgtttcttttttctcagaattttattttcaaatatgctacggtctgaatgtttgcatcctcccaaaattaatacaatgtaactaatccccgtgtgacagtattgagggatgtggctttggagaagtgattagatgagataagtgtcatgataaaaaagaccccagaaactaattagccatctccaccgtgggaggatgcagtgaaaaggcaccatttatgatgagtaggctctcagcagacactgcatttgctggcaccttttattggatcccctagcctccagaacgggaagaaataaatttctgttctatattagccatcctatttatagcgttttgttatagaagcccaaaaggactaagaccaaatatctacccatatttccatgtatatatctagtccactcctgctaactgctgcataatactccaagatggacacatgctttactgttcatccctctgtaatagacacccattttgtctccaactatctgtagttaaacactgcagtgaacgtactcatacttgtacccctgtggagctctggagctatgtgactttgagatatatatatatatatatatatatatatatatatatacacacacacacatatatacacatatatatacacacacacatatatacacatatatacacacatatatatacacatatatacacatatatatacacatatatatacacatatatatgtacacatatatacacacatgtatatacgtatatgtgtacatatatacacacacatatatgtatgtgtatatatacacatatatgtatatatatacacacacagacatgtatatatgtgtatatatacacacatagatatatgtatatatgtgtatatacacacacatatatgtgtatatacacacatatatgtgtatatacacacacatatatgtgtatatacacacacatatatgtgtatatacacacacatatatgtgtatatacacacacatatatgtgtatatacacacacatgtatatatgtgtatatacacatatatgtatatatgtgtatatacacatatatgtatatatgtgtatatacacacatatgtgtatatacacacatatatatgtatatacacacatatgtgtatatacacacacatatatgtgtatatacacacacgtatatatgtgtatatacacacgtatacatgtgtatatagacacacacgtatacatgtgcatatagacacacacgtatacatgtgcatatagacacacacgtatacatgtgcatatagacacacatacatgtgcatatacacacacatatatgtgcatatatacacacatatacgtatatacgtgcatatatacacacatatatacgtatatacgtgcatatatacacacacatatatacgtatatacttgcatatatacacacatatacgtatatacgtgcatatatacacacacatatacgtatatacgtgcatatatacacacacatatacgtatatacgtgcatatatacacacacatatacgtatatacgtgcatatatacacacacatatacgtatatacgtgcatatatacacacacatatgtatatacgtgcatatacacacatatatgtatatacgtgcatatacacacatatatgtatatacgtgcatatacacacacatatatgtatatacgtgcatatacacacacacgtatatacgtgcatatacacacacatatgtatatacgtgcatatacacacacacatatgtatatacgtgcatatacacacacacatatgtatatacgtgcatatacacacacatatgtatatacgtgcatatacacacacatatgtatatatgtgcatatatacacacatatgtatatatgtgcatatatacacacaggtatatatgtgcatatatacacacaggtatatatgtgcatatatacacacatatgtatatatgtgcatatatacacacacgtatatatgtgcatatatacacacacgtatatatgtgcatatatacacacacgtatatatgtgcatatatacacacacgtatatatgtgcatatacacacacacgtatatatgtgcatatacacacacgtatatatgtgcatatacacacacatatgtatatatgtgcatatacacacacatatgcgtatatatgtgcatatacacacacatatgcgtatatatgtgcatatacacacatatacgtatatatatgcatatatacacacacatatacgtatatatgtgcatatatacacacacatatatatgtatagtctgacttttaattatgtgtttatgatttatacattggattatttgcttccccttttgttgaattatttacctttctttgatgggaacaaaactattaaggcatttccctaaaggctcttcttatacctttttaagacacaagttttcaacattataactttgctagaaacatactaacttagccatcaacatcacctcactgtggatggcagcaaagatggatgagggaatctggtctgtaaaggaatgtatccaatgctttaggctgggctgcaaaccacaagcttgagaacttcatggccacctaagccaagcaaatatcctcatccttcaaatatatatatgtatatatattcaatatactcctacaccaaacaagaacaagatgaaataggtctatttaagaactttctgaatactcttcttatattagaatgtgattatgtatagcaaaaaaacactctgaaatatatgctcagtctctaaaatcagaaaaaaaaaatcagaggggaaaacatgttgtatatacttcaatcagggcagttcctttaataccagtatccaggtcaatcccataagaacaatgacaagccccatatgagaccttggctagggtccccctcctgccctggaatgtccttggtagtctcctcaccattgcatccactcatccaaatctgacattcaggacctaacccatctccatggaaaattatttcattctgcagattgccatccttcagccatttacataggtctattaacggtttttagttttatttcctttcgttatatttagcttatgatcttttttttttttttgcttttatgagatacatggccctgaaagaccatatatatcttataaatatgtccaaatagatatatggcctaccatcagtaatccttaaaagcttgtcctttatattaaagtactaatggacagttagcgaaagtattagggtatacatgttatagcccaatagaagtgtataaatgttaaagtttgttcctagggtcactaattttgccagctataattttcattagtctagacctgttgacattggcagtgaatttgacaatctgaatttctttgtgcacattatggaacacattaattccctaatatcatcagcttcataaagtggtacaatacgttgtctgcccaactattaagaagttctctctaccctcaataagcttgcatctagaaagaataatgcaatatagatattcctcagaaatatattgaataatttattccatatatgcgtgtatccgggaaaaaaataacagaaaatgttacatgccacaggaatgctatatttagagaattttttcagaaaaaatattttgattatcctaatatatttaataagaaagcatgcaatgataattcaaggcatatttgtatttttaaaacctgaatattactgtgtgccaagtgatacttgaagaaattaaaaacaacttaatcctcagaataatcccatgacataggtaaatcttcccgttttgtgtttgagaaagctgagatataaccccctcaaagtctcaaaactagttagtagctgagcaaggatagaaacccagacagtctggctccaaagtctatgctttcagcaactatgcaatgttgtcagtctatctgagactttatttttaaaataaaaaatgggaggctgaggcaggaggatcatttgaggcctggagttcgagaccagcctgggcaacatagcgggatccctgtctacaaaagttacaaaaattgttaggatgtagtggcactcacctgtagtctcccagctacctgggaggcagaaatgggaggattgcttaagtccaggagttcaagattatagtgagctatgactgtgccaggatttcaaggttacagtgagctatgactgtgcactccagcctgggtgacacggcaagaccctgtctctaaataaataaataaacaaaaataaaatatgcagtgtaacccaatgtttaatacagccttttcacaaaatgtaataaatgcacgtttctgactatgctgtggggattttttaagttttgagactcacatagaaaattgtactgagttttctacaagtgaaaagtggttttgaggatttaacagcccagccctcttaaagtgcaagaattctcttaatttccctcaacatgagagaattcatgcattaaaggtaaaccaatttcagcttgcatgattaggcaaatgctaccaaaaattcctctgagccttgtttttttcctcttatacttccagtttatacactgagcatctgcaaaataattttacccaagaagatacatttcacctgatgataccaaactgagatattctaagagaggttaatgctttaaaaccagaggaggagcaatacatttaatcccaaatagagcagaaaataattatttaaagccatccctatcaaactagcaaaaccattatgttacctaattaatcatatcttcgcatttgcacacactatgtgaaatagtcagaaaccatttactgtttccatccatattcctttttgctttcaacaatttattttttcgtttctgaaatacaagtcaaaatacatttttgttacataacatgccctaaaataattttaaaaaaacagcccgtgtatccacgtatttttttgatgagctctttcctccattcacactcttcgtctatgctctttggctagaaaatactatttgttatacccagcagtcacctccaccctatcccaatcttccttgttaacagatctccaattttgttgagatgccaacatgctcagggaaggggcccacctccaaggaattattcgtgattgttctcaacctgtcacaagcctgccctccccttccgtggaccgttgttgaagcatactttggtaggaggcttggtatctcattctgggcagtgacatgtaatgagaaatctgctaggaccttccaggacagaatttcttccctggtagaaaagaaaaatacagaaacctgataccactgagcatcaaatcagttctgaaactgcctgtctctgaacttatatgaaattgtaagcctttattaccaaagttgcatttagtatgctattatattacttgtagccaaaaggatcctaatttatatctgatttggcttgttctccaatccctaaggccattatcataagtatgtccatgctactacatcctaacagctacattagcagaatttctcctcatagatacctgattctctttgctttcttttacatgcaaactgcatttatttgtgtgaaatataataattagaagataaaataaatgttggaaaatttttgatgtccaaaatgtgatgatgaccactatcgtcaattaagattgattaaactgttcctgataacaagaaatctagcaaataccctgattatgcacattgaagctgtggaagaattcagaaataagatcatattttttgtcaagcacttgcacgaatccctgtgagcacacaattttccttgcctgaattctgaagcatacttaccacctgcagatactgagaaaactgacaaatagtttctgacaaataggcaactattctatagcaaaatgacactgggaaacatccactgtgccaagtagcattttatattgaagaaaatacactaaattttcacattgtaggtcaagtttatatacttcatgatatcgcttttggggaaaagctttcctcttccctcttttataatacccttgtaacaacctcaatcagaaaaccatgggaaaactaaaccatatgcagtgacaatcttaaattagaaaattgttccctagctagacctcttactgggtttgctatgactacgcacttcaatttgaagagacagcaatggtcaaagaagacgggcaggatgctataatgagcccacgtttcagaaacaaaatgtcaggaaggagaatacgaggtcattcaaacatgaaataagtatagttagaatgtatatcagaaaggaaatgatgcataacagaatagcaggataacatagtttggattccaaagagatgaaaatgttggctaaaatccataaagcataatttataaaataaacaatatctgaagaaagatgggttgctaaaggagaaaaccactttgcagtcaaaacactcttattggacggcagtaaccaggcaggggtgagcagagattcaaaagagaatttgactggggcaaacacttcactggactcaatccccactctatcactttggtatacaacttcagaaatttaaaatacagtactccaacagagacttaataagaactgaaatactaagattgagccctcaggcttagacaacatttatgttactgtcgcggtaagcccctctcatagatccagaaacattaaacattcattaaaatctttctatcaattgcctacatcttcaaaggggatttcatttttattttgaacagatggcgagcccattgcagggcgttctttatgaccagagcataaacactgtctgattaaatcgttcacaaaccaattaaaaacagcatttgctttagtaagtcatatctgcaatgagagagggaacatgagcaaacctagtcaattaactatccgatcccctgaggaaaatttgacataggacgtgggttaatagaagaaatcaggtacctccatgtagctatttatagccatataagctctcagttaaaagtgcaattggccagaaatgttggaagtcctttctcatacatgtattggaattttccaatgataaagtcttcaacacacatacacatacaaagaaaacccactaatttagaaaatttgatcctattacagaaagaaaaaatgataagtcagtgtagatattactctcgcacaaggctaagttccacttaacttgtagccaaaatattgaaaactttctctctagtaaacaataaaacacatgactaccttacattacagtcagacctcacccaatatcattgagaagttcctggaaactatgactttaaggaaaatgacatataatgaagctaattttgccatatactgatataaacaagagtgaagttcctaaggcatatttctggtcacaaaaacatcaccaaacttctaaatgaagatccaaaacacttgtaatattaaacattgaaataaatgtgagctatacatgcatttaagaaagattaattgaaacgagtaagataattattaacccaatttttggtggctctacgagtgatagcagtcatagtggtggtgggcaaaatcaaggaataaaatgtttgtgaagtgaaaattgtcaggagcacctccttccactgtgcagctcaaaaacaaacaatcacaactggggcagcttgctgagcactttgcacggcatcgtttattcttatgcacttgtgtgactatcagctactcgtaaaatttttatttgacaatgtttttcagggcgtatgttcattcattttccagcctgcttattccagttcagggtctcggatggctgcagcctgttctgcagttcaggacacaagtcaagaaccagccctgtccaggacttcatcccatggcagggccactcacacacttatactctggcagatggggacaacttagacagctgattcacctaatggcacagctttgggatatgggagaaaacctaggcaggcatggggagaaagtgccatctccacacaggtggtggccccaccgggaagcaattttttttctcatcaaccttgtaaagaaaagacacgacatggctgggcatggtggctcacgcctgtaatccccgcactttgggaggtcaaggctggtggatcacgaggtcaagagatcgagaccatcctggccaacatgatgaaaccctgtctctactaaaaatacaaaaattagctgggcgtggtggcacacacctgtagtcccagctacttgggaggctgaggcaggagaatcacttgaacacaggaggcagaggttgcaatgagccgagattgcaccactgcactccagcctggcaatagagcaaaactctgtctcaaaaaataaaaaagaaaagaaaagaaaacacacgacgttatttgaggtcctgctatacataatttattcttcataacaacttattagataggtactattataccattttacagatcaaaaaactgtgccttcagaaaaataaatatttttgtcagtgggatggttcaggttcttgacttcggcacacaaaagaatttgagaatgagtttaaagcaagggtaggcaaagaagtttattgcaaagtgaaagtacactcttgagaggcacagggagctgctcagagggagagacagcagctagtgccttcaggggaattccctttataggagctgttcattcacattcataaaataccaatgaggtcaagtatgcaaaagaagacctgtagttggtgcatgtactcagcgcctacatgctctcacatgcattgcatgtatcattagcatacaaaatctccaccgaggggtgtgcatttttactattaaaatgaggaaaaggtcatataagctaaaccttgagcctagctgcacatgtgggaccctggagaagttctgagcctctctctgcaaggcaagaatttgtagctaatagcttcctgggcttttggtgctgattggctggagaatgagaaagctatatcaagaataaggacttggatgggcatggtggctcatgctgcaatcctagcagttggggaggccaaggcaggagaattgcttaagcccagcagtttgagactagcctgggcaacatggcaagaaatacaaaaattagccaggcatggtggtgcatgcttgtagtcccagctactcaggaggctgaggccagaggatagcttgaacttggtagatagaggctgcagtgagctatgatcacacgactgcactccagcctgggccacacagtgggaccctgtctcaaaaacaaaccaaccaaccaacaaacaaaacaacaacaaaaagaagaagggacttttgttctctttcccgagccatgcggggtattaggaacttggaaccatctggcaatccactggtccacagggcttcacaaaaggggacaagtcagtatggcctcctagccttacttattctgcctcaatgttctcactcatatgtgagagctaaaaagtaactgaactcagagaagacaattgttattattagaggttgggaagaggggaggggcaaacagggagaagttggttaatggatcaaaaagcacagctagataggaggaataagttctagtgttctgtaacattgttggatgaatatggttaccaattaactgtataatttcaaaaagctagaagagaggattttattctgctttttcattttgttttgctttttatttcttcgaaaaaaataaatgggatacatgtgcagaacgtgcaggttagttacataggtacacgtgtgccatggtggtttgctgcacctattgacccatcctctcagttcccttccctcaccccccacctcccaacaggccctggtgtgtgctgttcccctcgaagagaggattttgaatgtttacaacaaaaacaaattatacatgtggagatgaatatgctaattaccctgatttgatcattacacatcatatacatatatcaaaatatcactctatttcccataaatatgtacagttattacatgccaactgaaaattttttttttaatttaaactgtgccttcatgaagttaaacaactttctcaatatcacatagctaaatacatggaagagcaaaaacttggcattgtacccataagttttgataccggaagatgtgcttgaaactactacctgctatttcctctgtaagacagaacagtttttctaaactcttttagagaaaacaaaattaaaagctaaaacttccaatctagcagttgctagaactaattattttcaggcattgcatataaacaattgaagtactcatcacaaatcattctcatttcttcattaaagcaaaatgaggacatctgtgtagtccaaattactatacgtacttaaataaaatgactttataaatattctataagtcagattagttaaaaggatagattttaaatattcatattttaggcttttcatgccatactacaaaatacgaactggaaataatacaaatgttatattaaaatgtaaatgaaaatctaatatatctggaattcatcatcaaaagggcatgtattattggtaacctaactgtgcctgatcttaggtggctgactaagcatcacaaacatggaatagtactaagtaccaaaaaagtcactgtttcggtgtgaaaggaaattaaatcttgggaccccaaactcattaagccaaaggtaaaagttaagatggaaactgggtcacacacacctgcctcctgacagagcaggagcatcaccaccttagacaaacactgccatttaaaagtttcccttgatcaaaaactgcctaaatccaaagggcatcagccccaatggctaaggtcaccatgaccataaaccacaaatgacatctccgatcagaaacattccaaccctaagataaacccctccccaaccagagatatgccagccctgcgataacttccctccagccagagagatgtcagccccaagataacctccactccaacaagagacattccaatcctgcaataaacttctcctccacacagaaacattccaagcctgtgataagttctctcgccctgaacctttaaatactcttactctgtaagacagagcgctcctgatcaaaattggccagaagcccctctcaggtttattcaccaaaataaacctgtctttgactgttgagctgctttttgtctttctttcctctttctttaactcttacacctccccttttggttcctaaataagatatctacgagatgaaaagttacacaccttccccatatttttcccagaaagaaattcctggtgagctccaagatctttaccctaaaatactcctgttgaaatttcaccatggaaatgtaagtggatagcttatctttacagatgcagccacaccccctgcccacctgacgcaaatgcatatctgatggttccccccgtcccattatctctatgttatcttacgtaaaaatacagataccctgcatctttccttggccccaattgtctatgtcatcttatgtaaaaaaacgcagattcactgagcccgacaaaggcatgagtgactattttccctactccccttccaaatgaaaactgtgtacatctcaaaatcctgccctttcccctttaaatttggagccctcaaaatcatcttcagagggaagcatagacctggttcctggcagcatgtccttaactttggcaaataaacctcctaaaatgattgagacttgtctcgtcattgttctcaattgactcgggaaagacagaaatattcaagaaaacattcttatgatgtgattcatactgggaaacaatgcatgtggaattatatactttcttaagaaattgagcaattataattgtttcagcttaggcccaaaagtccaagacttttagggtattttttttttaatgtttgaatggtcaaatattacacattttctctagtaagcttgattaatctctggcagattaaggtatcacacaaaatttcatctttttttttttttttttttttttgagacagggtctcatttagtcacccaggctggagtgcagtggcatgatcatggctcactgcagcctcaacctcctggcctcaagccattctgccacctcagtccctcaagtagctggaatcacaagcttgtgccaccacacccagctaatttttttattttttgtagagatgaggtctcactatgttgtccaagctggtattgaactcctacactcaagagatcctcctgcctcagcttcccaaagtgctgagattacaggcctaagccactatgcctggcccaaagtttcatctttatgtgcagctgtaactggcacatttatttactactttaaacatacttaatgtttattctggttagggggatgatgactacaaattcatgaagtttatgatattttgctaaaattgtctcactatggtgcatctgagaaaatgtcctaccatattaactaaaaaggctacgtttatatgctattactgatatatactagatagtagcaaagaactttcaatcaaattaaggttgaatttaacacaatctactatttcacaatcatgtcaaagaagacttagtttggacccagccctctcacagatttcctgcagtggcagttaactaaactaggcaaataaattacttaatttaattaaatcactactgggtcactgtcacgttcatcacagctaaaagaaaataattcaaaatgcaaaaagaaattgcatttttaaaaatgtgagatgaatcctagcaatacaatgttaaatgagagacaacaagtccaaacattacacacagcaaaatgccttttaaaaaaggtaaaaacaacaaagaagtacatatttcttaaggaatgcatacaaatgcaataaaaccatattaaaggggaagaaagaaatggtgatcacagaaatcatttgggaagaagtagagataccagatggttgtgggggaccatatgcttagtttggggcctgtgttcgtagtgcttataatattattttaaataaaaataaataaatgtatgaatgaataaaagcagggagccatgcatagaaaatgagccatgcatagaaaatgagccatgcattgtctcatgtaataatgattacaatttttccaattctgtgcatttgaggttctttaaaatcatatatgaatttaccaccccatttaaatcctggagggcagctagaaagacccaggttagtctcctgcctccaatgttgacttctccatttcacttacatatttctaatacatcctctcaaaatttcttcatttaaaaaagacctggtcaagaggcccgatgatgcaaatgggattttccttctccatcctctcattaaactgttagagtaggcagctagtcagacataagcagagcagcagagggctccccccacaactcagacacagaaggaatgtcaggcaaccatcaggtgatggtcagaaggttgttaactgtctctttaaaataataattggtcacattcagtgccagggaaaggcagtttcccaataaacagaaatacctgaaactgacaatcagcagcttcccaaaaagatcttaaaagttgggtaagtgggctcaagcatgcccatcgatgtggtttggctgtgtccccacccaaacctcattttgccttgtagctcccataatctccacatgtcgtgggagggacccagtaataggtaattgaatcatggcggtgggttttcacatgctgttcatgatagtgaataagtctcacgagaactgatggatttacaaagggcagttcccctgcacacactctcttgcctgccaccatgtaagaggtggctttgttcatccttcgccttctgtcatgattgtgaggactctccagacctacggaactgtgcaacaattaaacctcttttctttataaattacccaatctcaggtatgtccttacagcagtgtgagaacggactaataccaacattaagaggcaaaatggtgcagtttaactggtatatgaccttctagggacatttgactggtaagggaaaaacgcctcaagtaagcatgcatacaactccagtcaacgctgtgcatgcagcccctcccaagtgctagcaggccactgggtatgtgaacaacccactccaaggataaaatcaggggagaaggattgcaagaccatggaagtatgccaatttataaaaccccaagtcaaaaggtcaaactgaacacttgatctctccagttgcccacgtggccctcttccaagtgtacgttacttcgttttactcctgctctaaagttttgtaataaactttcactcctgctctaaaactggtctcggtctctccttctgccttgtgctgctcagattcttccttctgagaaagcaaaaactagggttgatgcagacccgtgtggattcactgcagggaacctattttggtgccacaggacccacgtatgttccgctcctaacagaatcaggcactccggctcatgctagacctggtcctggactgcttccctggggtttgcacctcctccttcctgaccaagccctacttaccttgtaagcactagcacatgggccaccacattcacaaattacctagtctacaatctgttttcactctataccccagagcgtagtatacatatttttataaatgaacttatctacagtagtctatttcatctttttaatttagcaaaaatctactgacttctatgagtgaggcaataagcgagtttgggggaaaaaaggtacaaggccctcaaagaatttatggtttagaattatttatatttctatttcacttttcctatttgataataaaagaggcagtatcaatacatttcacatttgtatgtttcctagtgcttaccacacagaaggtaattaacaaatattactttcagatttactgatcttattttctttaacttcagagcccactaacctaataaataactcccaaattatactacattttataactttccgatgatcatgtctgaataaatatcacaactcctgagtctcttctatcttccaaactctgaaaacgttttctgctagcagtaagagttaagaagttgaggtaagaatcaccatcctaggcaattcttgtcctctacctcagagaagagaaactgggtctgcttccccgggtggcatgacttagtccctttttttttttttttttttgaggctgagtctcactccatcatacaggcggctggagtgcagtggcttgatctcggctcactgcaacctctgcctcctgggttcaagcgattctcctgcctcagcctcccaagtaggtgggattacaggtgcctgccaccacacctagataatttttgtatttttagtagacacagggtttcaccatgttggccaggctggtcttcaactcctgacctcaggtgatccacccgccttggcctcccaaagtgctgggattacagttgtgagccaccacacccagccaccttactccttttgggctactataacaaaatagcataaactggggagctcgtaaatgacagaaattcatttctcatacttctaaagaggctgtgaagtccaaggttaaggtgctggtagatttggtgtgtggtgagggcctatttcctgattcattgatggtgctttcttgctatgtctttacatggtctgagaggaaagagttttctggggcctttatataagggcactaatcccattcagaagagctttgcccaaacaacctaatcaccttgtgaaggccctgcctctccacatcattacaatggtgattaggtttcaacctacaaattttggaggaacacaaacattcagactaccacatggccagagaccatcctgcatttgatagttttacatatattgccagtgagtcaaaacggcgaaggcattttgcacctgcaaatattgaatttttatccccagtgttttaaaaaatgcaacaaattatactgtgagcatatttccaaaagtcagagattttcatttattgctgggaagactataactatagaacactatgaattatccagaaataagtaacttatgactatgagaacaagacatgtctcttcagtctagcaccaagaagtgatcaatggcaaatgaaaatacaaaacttatctaggggttgatctaccagctctaaaatttaacattgacaagagaacactcataatacaagagagagactgtatcagcacctgtatccttcacaacgtctattttctctatcttctttatcaattaatcccaattttatgagaacacgaggattagcaccaatgaaaaatacacatgtctattgcagctatgggtagccacatgacacagttcttagaaatgaaatgaaaacagaaatgtcctgagtggagcaacttttagtttgcagtgagccaagatcgggccactgcacttctgcctgggtgacagtatctcaaaaacaaaacaaaacaaaacaaagactctcatctttgtctcttgcccttcccctcttcaatacagatgtgatatagacatgatgcctagagttggtgcaccattttgcaaccattaaagtcacactcgggctggaggttgggaaactagaagaagccctggacttcagccactttcttgatcggtcgtgttcgcttcgctttgggctacctagctcttgactttggtcatgtaagaatgaaggactttgtatggttaagccactgtggtactttttctttcctcagccaaaagcaattccaaccaacacaacatctctgtttattagtcacaaccaggctggattttcttcctgttcagaaaatgaataaaaaatgcaaacaaaggttggagattggaaattttttctttaacattaaagaacctagcttcaagaatggacttcttacagaacactacagaaaatgaaattttagaaatagtcttctgttcacaataaaattcatagtgtagacctgtgaaataagagctaacgaatgagataacatactgacatgaagagaaatgtggttaggaggtgatatggtttggctgtgtcccctcccaaatctcatcttgaattgtagttcccatattccccatgtgtcatgggagggacctggtgggaggtagctgaatcatggagcagttacttccatgctgttgttgtgatagtgagtgagttctcatgagatctgatggttttacaaggggcgttacccctttttcgctctgcactcctccttgctgccactatgtgaagaaggatatgtttgcttctttttctgccatgattgtaagtttcctgaggcctccccagacatgctgaactgtgtgcgttaattaaacaaacctctttcctttaaaaattacccagtctcaagtatgtctttttagcagtgtgagaatggactaatacaggaggtgagttgaaataaaaaggaaataaattaaaagtaaaatggtaaaattagtatcttcacgaaattagaattactcaaaattagattcactgaagaacaaagctaacactgctgaaaattgaatagtaatgtgtacatttgagcagctgcctcccatatatgagaaatgagcagagattaaaatgatgacagaagaaaaagtagacatggttgacagcgaaatgatatgtaacataatatgcattcatgaaaagaaacagttttaacagaaatttaataaatctgaattataacaggagaatatactcctacgcgaaagaaaggcttgagtctatggatgtgattaacaggaaacattaatgacaacagtagcctgaaatgatcctgttgaaattcataaattcaagggtaaagaaaaaagccaatgatttgttttcaactaggcagaaaagtttgctgataaagaaaaagatctgactaatgtcagactcctccatagcaagaaattccaagaagcaattggcaacatccacagagtttgaggtagcaaaaattataaaccaagaaatccatacataacatgtttcttatacacaaaggttaaaggaaaacatccaatatgcaataactcaaatatatattaattctatttttgaatatgaaaaatttaaacatcaaattttaaccacttaaaggataaatcaaaagaattaaataataaaggcagacccaacaaaacttcctaattatcaaacacatgcacataaatttcaacacatacttaatcatcattacgttatttctaacaagtaaaaattggaaacatccaaatgttcagatacacaaaattaactaaatggattatagtaccgtaaatgatggactaagatatagctgtttaaaaccacattcacaaaacagtgaaaaatatagagagtcatcacaacacattactaaataaaataacaatagcaatatatgcagagagattttgttacaaaaacacatgtatttgggtagaaaaatattaaataaaatacaacaaaatgcttactctggcttaagatacgctgatgtattttcttccaaattttctgtcttttctctacctaaataaaaataatacttttaatttcctctctcccttttggatggatttatagtatatcagccctagtgccttccttgtggctctgaaagcttctctccacatgattttagtaatgtttggagtttagaaagaatttagaatgtcatattacttattaggtacaatgattatgttataatctgttttattacaactgacaaattcacaaatcaaatttgccattttgcctataagaagaaaatattgggcaatatatgttttcataacgttccttaaaaaccaaaacttcagaatgtgagcatctgttttcaatatgcacactattcagtagtgcttttagtttttaatgtaaagccataaatattttggaactgtaaatttgcctccagtcttttatcatctcactttagctttccagttttgctgaattttacttaactgatttacatcttttttatacctaatatagactcatttttaagaaatatatagtagaaatgatagacatttttcagtaagcattgcacttttctagaatacacagagcaggtttaactgaagacaaaaatatcattttatttttgttcagatgttttctacagtgataaaaattttcatggtgaagctcagcacagtactagcctttggcagttaactagggagatgaggctgtcagctcaaagaattataggaacttgaaaaaatagattgtttatgttatcatctggaggttagtttatgggctcctgagtccttaacaaccccaagacacgtagaaattcacagtgagagcctcaagcagactcaggtatcactgattgttggttccacctttgcttcccgatttgccatggggtttgcccaggagttggtgagaatcttttgactaaagccaagatgaagcatccagagtttgacattctaattcctgctctgcccctggcttgctaacgatctctgataagacagttatcttgtctgtgcctaaagcagcctgcaaagtgagaataatatttgatccgaaatctctaggacgctatgatggttaactaatactttactgtgaagccaaaaagaagtgtagctatgcttgaagttctcagtatattcaaataaactttttaaaatcctaggtatcatgactttctcatactcagttacccacagtaaaaatgaggaggaaataaatcaaagaggaacagagtccttaataagcagaaccacatgttaatattctagatcaacaaattcctactaaaccttattgtataaaagttatttcacttcatccatgggtaagcttgctttcatttgatcagatgtaaaatttattttaattttatacaaatttaacacactaacatttgcattagtttgtgatattttttggtatcaactttgttgttgcagtagcttaatcttgaatgggacaatgaattaattaatataattctataaccttaccatggtatccctttattctaaagtagcccccttatcagttgttatattgatgtagttcctcaatcaacaattgttcttggctgggcacagtggctcatgcctgtaatcccagcactttgggaggccaaggcaggcaaatcacttgagtccaggagttcaagaccaggctgggcaacatggcaaaatttcatgttatctactaagcatacagaaactagccagtatgctggtgcgtgcctgcaatcccagctactcaggaagctgagatgagaggatcccttgagcacaggaggttgaggctacagtgagcagtgattgtgccactgcactccagcctcggcaacagagtgagaatatgtctctaaataaagaaaattaaaaacaaaaacaaaacaaaattgtccttctaaagaagtcatatactattaagaatatatattcccctatgtattttttctttagtttctcatagaaacatagtcagctgtacattacattacagcaaataccatagctgacaaaaaaaaataaagtacacaaacacagaatcagaatactatattttcattgacaacttagcatagagaggtttaatttctttatttgaaattgaggataataagaatagttatcacatagaattgtaacaaatattaaaagcgctaatctttcaaagttatttattaccacaatgtctaccagacaataagtaatcaataaatgttatcaattactattattctatttcaagaatacacagcagactagtcgtgcttaagttctggctctttaataagtaaaattcaaatttttctctaataagtaaaattcaaaattatttgtattttcaactactttagaaaactaatgatataatatttctaaattccttgatttaatttgaaaacaaatttttaaaagacagttatctacaatattttgattactattaatattattttctttttttaagaaggagtctccttctgtcgtccaggctggagtgcagtggcatgatctcggctcactgcaacctccgtgattctcctgcctcagcctcccaagtaagtacctgagactacaggcgtccacaaccatgcccggctaatgctcatatttttagtggagatggggttttgccatgttggccaggctggtctcaaactcctgacctcgcgatccacccacctcggcctcccaaagtgctgggattacaggcatgacccatcttgttcaatgttcatttttgtatacagattctatgatatggggatacaacgacctcaaatacattgttattccctacaggaaatatacatctgggtttgtctgttactgtgcctagcacataatgaacactcagtacataatatctactattattaattctttaatatttaaacagatatcataaactgcctagtgtaattaagtgccaaatacatattacagatggtgagagagatgatctacagagattcgttcaaggaagactttgggcagaattaaatttgagctcttcctcatttaataggcaggaaggattctgtgcattattttgtgctatattacactattttacatcatattgtattatgtatatattgtattatatataaacatacatgccatagtgacataatctatacaataattatctcaagacctgcccccacgtttaccactattttttaaattcagaaaaaacataaaaatataaaaatttaagacataaacacacacgcaatttctcagcagtgcaaaaacaaaagcaattagataataagtaggtcttctgtacatttcacaagaaaagaaagataaaaatctagggcagagcaaattgtcaagaaggagaggacaactaaactggcaacagaacttggataccacctgttactcactgctatagtttggatgtttgtccctgtaaacctcaagttgatatttgatccccaatgttggagacagagtctaatgggaggtgcttgagtgatgggggaggatccctcctgaatagactgatctcccccacctagatcaggcagggatgagtaatttcttgctctattagttccctccagagctggttgttaaaaatagcctggcacctcccctacccctctctggcttcctctcttgccatgtaatccctgcacagcttgcttccttttgcactctgccttgagtgaaagcagcccaccttcaggctttcaccagatgcccaatagtccagccagcagaattgcgagccaaataaatctcttttctttataaattccccagcctctggtattcctttatagcaccactaagcagactaagacactcacactgtgttttcttgtcttggtcttctgcgcttgactcaagaaaatggaaagagctactcaaacatgttgagagatcactcccaaacccagccttcatttcttccatacctgaatattatttccttaaacactgaaactgccttgtcccacccgaacactgttcaagtgaaaacaaattacaaccttgttccaggcaccacctcatataccatctctacgatgatatttaattcaacaacatttttgaacacttaatatttaaaaagtgttgaagaaacatacctaagagaccgatgaccatgactttaagaaagagagatggaaagaagtataagtaggtcttctgtatgtttcacaagaaaagaaagataaaaatctagggcagggcaaattgtcaaggagaggacaactaaactggcaatagaaacctggataccacctgttactcactgctatagtttggatgtttgtccctgtaaacctcacattgatatttgatcaccaatgttggagatggagcctaatgggactaagcatcttaaaatctgtgatgggaggagaacacagtccaggaaggaccatgtatctataagtaatgcccatgtattttttgacctgtaaagggaatgagtaccaaaatagatacaggaaataactttcaccctgaacgacctttctactggggagaagatactttcaaatatttaacagagtacaaaacaaaagatgatgtgtgcaacatcccttaatttctaggaagcatggaggccttgtatggctctgcatcccagcatataacagtgttcagagattggaatgcattagttattcagtgcatattttttgaatgaatgagtaaaaagtatagttagtagaaggaggaaagaaaaatattcccttcaactattcatttcatcaagcctttcttgaattcctatgtttacagttcagggtcagattatttggggatacacagattaatcaaaaaagaatcctacctttacaatgtcaaatttagcggtcatagtcgctaaacgaagtgaaaatttgcaggaccaaacaatatttagttgacaaggaaaaagggaagaaaagacaagtacacctttgaagactgcccacagctctaggtgagcctctataccagctcttcagaaaccattctggagctccaagagcaagactatcatgtctccaataacatgaggaaacagtctaacagaactgaatcattacatagaaattctatgacgagctgctcacattaatgttgatgcaattgaatgaaatggaatgtaaactatgaaaaattttcataaataataaagataaataaatgtttttaaaaacctgaagaaccaactctgtataggacaaacattttcctctacctaaaaataaaaatattccatttcaagatggcagactttatacctgtgcttctgtctcttccttctgcaatcttgataaaatcacgataggagcacaacaaagctataatttaagaacaataaagagaaaggaatggcataattcaaccaagttccagaagactgaaagtatttcatgcaggagtcagaaaaaaagcagtatcctatagcaatggagaccaccagcctgctcatcggaaacctcagaaagatctgggcatcagctacatgatctaacagaccatgacagtaagaaactgagcatgagagcctgggttaaaggtctctataaaagatttttaaccaatactgacttaaatttattgcatgcagagtgccaggagccaaacattcatactccagggagaaataaacagcctttgctaataattatataagagtagaatgaattatctgcagacatctaggacagctagaactagtattgacactcattgaggtcctctgcactttggcattagtgctctggaattcagaccagctcccagtctactctcactagaacaaagcctggccgaccactagccccacccacatacccagaaatccccgtcaggctctctactgagtctccctttctatggacgaaataaatcccattgttgcaagtaccacagatacgctggtatcaccaaaatccatgtcacaatgcctgtttcatatgcttctcaaaactcaaaaagcaaagaacttttaccacccaccgaatctcttccccactctattctattttagtaaataaaatggcaaaaccagccactcaactgctcaagccaaaaccagtgagtttttcctcattccaaaggcaagttctgtcaactctgaccccaaaatctatcccacaccaagccagctttccttgctccactgaaaccactaaaattcaaaccaatgtaattttttacctagattcccacaactaacttccctaccactatccctggctttcattctgattttctacaatggagtgtctgttgagaagccagagttttctttttaaaatgtaaattaaaacttgttaggccaggcgcagtagttcaagtctgtaatcccagaactttaggaggctgaggcaggaggatcatttgaggccaggaatttgagaccagcctgggcaacagagtaagacccagtctacacaaaaaataaaaatgaaaataaagtagcaaggtgtgatggccatgtctttactcccagctacttaggaggctgagatgggggatcacttgagcccaggagttcaaggctgcactgagccatgttagcaccactttactccagcttgggtgatagagtgaggcctcatctctaaaactaaaaaaaaaaaaattgtcatgcccctggagtccatccaacagaatttttctttgtcactcgaaatgaaacccaaatcctttcccaaagccataggtgttactgtccctgccaccttcccttacttcatctcaggtcattgtcctctttctcacactactataaacacgttagtcttgggttcattagagatttccgaagactactccaacctcacgacatttggaagtgttcttctttctgcccggtattttttcatttgggtctcggtttccttagagaagtctttcctgactgcccagactctctatcccatggaaaactcccatagttgcaattgcctttatgttaaagctatatatacttagtatgcttatttttatttgcatactaatactcatatattatcattctcttgctcaaggatacaagttccaggagcacggttgtctcttttgtttaccacagtgtctgtactgatacacaatgagagctaaaaagtctttgctgaataattatttgaatatgtcataaagtggggggaaaaaactccaatataaacaaaagtaaaaacaaccctagaaaaaaaaaaaaagaactaccaaactaattgcctagcaaaaccatgacttttagagtattgtcattatttactcaggggattttgagaataaaatggaatcatcagaaagcaaagttcgcagaaatgggaaagataatttcaaaactattaatttaatagcgttagaaggtaaaatcaaggcaccatggaaatgtgctatcaaaaaataagagatagaaaataagaaagaaaagataaaggacacagacaatttctccaggaggtacgagattcaatgaatggaaattcccaaaagagaaacagagaaaatggagagaaaggaagcatattagtgagttcaggctgccataacagaatcccacagttatgggatttatttgaacaacagaaatttgttttttcgcagctctggaggcttgaaacccaagatatagatgccagtaggtttggtttctggtgaggcctcttatcctgacttgcagatggctaccttcacactctgtcttcacatggcctttctctatatgtccacagagagggagaacaagctatgatgtctctgcttatatcaggacaccaatcctattagattagggccccacccttatgacctcatttaatcttatttatctcaataaaggccttatctctaaatatagtcagagaaggggttatggcttcaccatatgactttgaaggagacaacacttcagtccataacaggaagtgaaacattttttaatgcatgcaagaaatttaacaaaagttaaaaagagacataaattttaaaatttaaacaacttagcaaatgccatgtaggttttttttaagttctacatctcatagtaaaatttaagaacaggataaggagaatatgttctcatcttccataagacattgagtaggaagttaaaacaagtcacatacaaaggaacaagaattatacttaaatttaacgtttaagtataatcactgggtatcataagacaatgaagaaaaaattcattttcaacctaaaattgtctacccagctaaaattataaattacacaggtaaagtaatatttcattttcaggtataacaagggcacctaaattttacattttacacactttacttagaaagtcggttgaggataccacccagccaagtgaggagcaaaccaaacagtatcaggaaaagaaagatcagtagtgaagtcaaagcaaaagacaataaaggggagaacattaacagtggtgcagcaggtggatagaaatcaatccatacaggaagaacagaagaaaagaagacttcagaagagaggtcctagggttaaaggggagtgccatagatgagacaggttagaagagattaaaaattagaaaagagatagaatgaacttttaaaggcataagaattagaaatttcagggaaaaattaacaaagtttaaaactgggctgggagtcgtggcccacgcctgtaatcccagcactttgggaggctaagatgggtgaatcacttgaggtcaggagttcaagaccagcctggccaacacagtgaaaccctgtctctactaaaaaatacaaaaattagcagggtgtaggggtgggcacctgtaatcccagctacttgggaggctgaggcaggagaatcacttgaacctgggaggcggaggttgcagcgagctgagaccacaccattgtactccagcttgggcaacaagagcaaaactctgtctcaaaaattaaagaataaaaataaatacaaactgtatgagagaacatatgattaaggcataatatttaattccacagagaacaattttcatgagttcacagtattacaaataaaaataaaattaagataaaatattttataaataaagttcaaaggtatgcagagactaggagaataatacatgcaacacgcagaaaaaagaatttatgcccaaggaacaaatacagatctagatataaatgacaaacaactcaatagaaaaataggaagggcataatgaggtaatttatgaagaggaaatgccagcaaacatttgaaaagttgctcattctcacttccagcctaagaaatgcaaatcaaactagctaggagagatcttctttttatccataatattagcaaaaataaaattttataacatctagaactggccaatagacgtggaaatgggcgctcacatgcaatgttgatgcaagaatgaagtattatgagctttcaatccaatagtatctgccaataagtaaatgcacataccctctgccccagtaattccccttttagagttaattcaacggatataaaagcattagtatataagaatatctgtacattactatctactaaagcaaaaaagtatatagtatacagtaacagaaacaagaccattacccaaaaatccatactctgtctcaaaaaaagtataattgaatatagcctatctatctataaaatagactattaagcagctatttttaaaaaatgagttagatgagtggtttgaaagggtatttattacagattattaaattgaaggaagcaaatttttaaaagataaattcgaagaagcaaatttcaaacaagcaaatgacagaatttaatttgtaaaacttaaaaataaatttttgaaattcaaagaagcatatggagtaggaccctaattttgacagaaatagaaaagcatatgtgtaagtttacatacatctgtatgctatgtgtgtgtttatgtgtgcatatatatattaatatgtattagtaagcatatttaatagcacatagaaaaatgtggaaatatgtacatgaaactatcagcaatagtaaccttgaggctggggagacaaaaagaaattctttatacacctctgtagttttctctaattacaagaaaagtataattattctatttttaaattttaatcaaattaaataaaaataaaaagataagcaaaatattttttaaagacaaggaacaaaaaggaagaatcaattatggaactaaatactacttaaagaatagtgggaaaaagtctccacaatgagtcatttgtattttagaagaactcatgggcaacgtgaaatcaataaaataagacactcactaaaaggataagacaacagaaggaaggggaaaaacaagattgcaaagtttttttttttaaaaaaagagaaactggataaaaacactctaacaaaaataataaataaataaaaatagcagaaaacaacatatggggccaaatattgaattagaggacaaacgaatgcagagagtaaagacagacactactaatcgcttagaagagagttagtaggtagatcagacaaataatttggatccagcaaaagaaaatcaattgttcttccctctggggaattcttgtgttctattctataaatggaatagggaaaacagttcatttttatatatcacaagaaaatttccatgaggagcaagggaaaaaatgggtccaccaattaaatgagcctacgatgtttgagaaaatgaactgattatgagaaagaattatcaaaactgagacatgggccgggcaccgtggctcatgcctgtaatcccagcactgtgggaggccgggagtttaagaccatcctggccaacacggtgaaatcccgtctctactaaaaatacaaaaattagccggacatggtggcgcacacctgtagtcccagctactcaggaggctgaggcaggagaattgcttgaacccaggaggcagagattgcagtgagccgagatcgcaccattgcactccagcctgggcaacagagagagactctgtctcgataataacaataaaaatcaaattactgcttgatattgtagataactttcttttaaaatttgtttccaaattaaatcaggaatcttagaaatattatatcattagttttctgcttctaaaaagcaggacttcgtctcaaaaaaaaaaaaaactgagacatatcctggaaatttttctgaaattcacaactgaattagttcaacaggaatttttagtcaggaaaagcagaaaggagaaagaaaggagaaggaagaagcaaggaaaaaagggaagaaagaaaagagggagggagtaagagaaacaatcaggcataaatatagtgagtacaagtgaggagaaagtttgattgtaagaaagtgagagtgagtggtttccatcatcacccttcctaccagatctcttataaaacctgccctgaggactaggagttgcaaagcatataacgcttgcctgaaataattgggtacatgaattacaggcatttgtattttaactgtgaataaagctttaaatcactgaagagaaagttaatggggaaaatatcagacgataaggggttagtggagaaagtacttgagaaatttaagcagtctgaaacattcatatagaagctagtattaaccttctcaaaagaaaaaaaagttaaaatttttctttcacatactgtattcttttctttcccaccctactgctttttgagaccaaaaccagaaatctggtcaaaaagttgagaccaaaaccagaaatctggtcaaaaagttgcaaaagcacttgcaactgtcatcaagaagagtatacaaagtttccaagtccaaagaaagactttctagcttctgatatttaggatttgagaagaccctaaaaattaaatatcctctcaaaacaaataaaaacaaagaaacatccctgccaaatcctaattctctattaaattcctgtatcacttggcttacctgatttgctcattccagtacttattcatattcagtctcacatattacatgatggcataaataaacataaatgtggtaccccttttacctgtggggtattgttaccaagtttagcctagctggcactaaatgctaaggaccacaaagaaagttgaaatcatgagtccagaacttgtcttagaagcctcaggaagcaaggaattctatctgcaagtacagttaaggagtagagaagtctgtctaaacctagctggcaaataaacactgatggggatttaatggaaaaagaaagcaaagaagtttccataacaaatacagactgtcataagctgccttacttcttttatgtaatctggaaggaatataaatgtataaaaatgcaaataaacaactaaatacatttttaaatgaaatgccatcagcaagaggttgcagataattgaatcaaattgtacctcagagattgttcttttgtctgaacaatataatcactacaaacatatttcagtgaaatgaaaagattattgaagtaatattaaaagtcatcagcacacattagaaacccacacgtttctaacaaatgagatgtatttaaagttgaacttaaacctataatatcaagcaagaaataatgaaaagccattgatctgaataaactatgattttctagatcagagtgcaactacttatgtgcaatgaaagtaattccaggtcatgccgtgatcctataaaaatttgtcgtctgtgatattggattttgcttttgactctaaaaggtcagaagaagagcagaaaagctatggttctagtttatccataaatcattttgtattcatggaggtactgcttcattgcaaagagaactgcctagaaaccagattgaaaatgtctatgaattgagtaggttccagatgggcagtgagctgcacagtgaccacacatttcaaaactttgaaaaaaaagaaaaaatagatatatatatatttcaaagttagttgagatgaagacacttttcaaagttctgcatttttacagattcagaactgctgtcatcaaccatgaatcactttctcatattaaactcttaaaaaatcattaccagtcatcaaagccatattttaatagagatgaggtaggatcatgtattatttcttattacctgccttctagaaattctacataggttcaataccccctgctatggtgatacagtactactctttctttccacaaagcatattaaaacacgcatacacacacacacacacacatgcgcaaacacatacaacctatgagtttacagtcattcccatggccatttcagactttgtcactagcaataacagcattttctttacaatctcaatgtcaagattcctactgttttattaccaccttgggtctttctagctcacttcctctaacaccccaattcacacaatccttagaattcaccagcacttccaatccattatcctcaccaccatgatattttgaacaccccctacattctacatccctgttttatttttattgttattatttattgagacaaggtctggtgatgttgcccaggctggtctcgaactcctgggcacaagcaatcctcccgccttggcctcccaaattgctggaattacaggcatgagacactgtgccctctttattactcaggccactttactcaggcaaaattccaccagcaattattatcatcaaattgttgcatacaccttcgatgactttactcctctttttccttgtctttctctggcaaaatcacataccagttaaatccaactctctgcttactctctcacctgcacatgggtggatgaatccagataaagaaaaaccctcatttaagttgctttatattcatgaccatgaaccaagcctttaatgcttctggaaaccacattatactttctcttttccattcatactccactctctcaagacgactatctcccatcatcaaaccttcaacactttctcctcatttcattctcagcagacaatctggcttcctactttattcaatcagaaaagaactcccacaatctatggaccctccaaccagcatcttcacccattctgccttcccaccttttccctgagattaaagattccctttcctttccaaagagacttattggaattgtacactataacccatcccctttaactgatatgaggttagcacttagatgattctttcctctctttgctataccatcaatttgtcctcactactggattatttctattagtttatattctattaatgctcagtctttaaaaataaatcttgatgtcatctctttcactagatagtaccacatttctttgctttcctttgctgcaaagctcctcaagagacatctttatccctggtctccaatttctctcttaaacctactgtaaaacctcaggcctcagtctttagtcccatctctatctgcatttctttccttgacaatctcatctgtctcatgattataattctcatgcacctgcagataactcccaaatgtataatttgtatctccagtctggacatctctcccaaattccaggcttatttttccattgcccactcaacatccatgttatgacctgaatattcgtgtccctcccaaaatccatatggtgaagccctaacccccagtgagtctgtgtttggagatggggtctctaaggaagtaattaaggttaataaggtcatacaagtgataccctgatacataggaatagagtccttataagaagagacatcataatcccagcactttgggaggccaaggcaagcagatcacaaagtccagagatcgagaccatcctggccaacatggtgaaaccccatctctaccaaaaatacaaaaattagcttggtgtggtggcgcatgcctgtagtcccagctacttgggaggctgaggcaggagaatcacttgaaccagggaggcgtaggttgcaatgagccgagatcatgccgctgaactccagcctgggtgaacagaacaagataccatataaaaaaaattaaaaaaaataaagaagaagaagagacatcagagagcttgcttgctctctgtgtagtccagaggaaaggctgtgtaagaacacagcaagaatcatctgaacctgtaaatatgttacctcagctggtgttatggtttggctctatgtccctacccaaatctcaccttgaattgtaatcctcacaggtggagggagggacttggtgggaggtgatgggatcatgaaggtggtttctcccatgctgttctcatgatagtgagggagttctcaggagatctgatgggttgatttgtttgcttgcttgtttgttggcttgtttgtttgtttgtttgttttggaagagagtctcactctggcacccaggctgcagtgcagtggcacagtctcagctcactgaaacctctacctcctgggttcaagcaattctcctgtctcagccttgccagtagttgggatcacaggcacaggtcaccatgcctggctaatttttgtatttttagtagagacggggtttcaccatgttggctaggctggtctcgagctcctggttcaagcgatccacctgccttgtcctcccaaagttctggcattacaggtgtgagccaccacactaggctgagatctgatggttttaaaactggcaatttcccctgtgctttttctctctcctgcccatgtaagatgtgccttgcttaccttcactttctgccatgagtttcttgaggcctccccagccatgcggaactgtgaggcaattaaacctcttttctttttaaattacctagtctccggtagaatctttatagcagtgtgaaaacagactaatacacctggcagaaaggactttgccaatgcaattaggcagaaaggactttgccaatgcaattagagggagataatcctgaattatcctaggggaccaacctagtcacatgaaatcttaaaaatggataacttctgctggctgcaggaagatagagagatgcagcagaagagcagacaggagagaggaggcatgagatcaacatgctgtaaatggctttgaagacacagaggtccataagtcaagaaacttgggcagttatgaaagatgagaatgactcctggctgaaagtgagcaagaaaacagaaacttcagtcctacaaccacctaggactgaattctgctaaaacctgaataagcctaaaagcagattctcccccatagctttcagcttgcagctctgcggcatccacagcagataaacaagctgagcctaacaaatgtccagcctaaagaattgtgagatcataagtgttgttgttttaggccactaaatttatggccatttgtgatggcagctagtgataactaacaagtcctaaacagctgcctctgagctcttatgtttggcacacattgttaatgcttctcagaaaccacaattcatcccagtgggaaaaggaataggtaggaatttgtctctgatggacccaggccccttctgagaggaaggccaagtctgtacctactccgggcttctgtcctttgagtcgttactgcgccatgttttgtaagacttacattatctgccttgacatatgtaagtcaaccctgtgtattactgcacaaactaataagagtgagtcattctctacacattcacacattcatttagttttccaggaagtctcaaatttaaaaaaaagaaaaaaaggcctcgtgatatttttggccaggtggggtggctcatggctgtaatcccagcacttcgggaggctgaggcaagtggattgtttgagcataggaattcgagaccaacctaggcaacaaggcaaaaccctgtctctacaaaaaataaaaaaaaaataaataaataaaaagaaatataaaaatgagctgggaatgttgacaggcatctatagtccagctacttaggaggatgaggtgggaggatcacttgagtctgggaagttgacgctgcagtgagctgtgattgtgccactgtactccaggctgggcaacagagtgagcacctgtctcaaaaaaaagtggtgggcggtggcgatttggaaaaattatataatttactatatgtctggcactgcacaaatttcttacatgtattattattttcaaatcttcataatagttccatgagacaagacgatcaggacttcctatctaacccttagagtgaaggtgagaaaccccactactctgtgaacagaattctgtccaaacatgcttcatatctccagcatattaactagtcttttttggatgcattgttagtccaaattggtataacaacttaaactttaaatgagtattcacctccttttgttgtttcaagtctcttattaaaggtcaaatttgatcgacgtgagcaaagaccaacaaaagatagtgaggtggggatcagatgaagactcagccctggagtttcccctctgttgctcaacccctgaacttattctgcttccaatttaaaagtattaaatctctagataatcttttgaatggcttccagtcaccgaaatatgttttatagcttccatagaagtgtaacattgattataagtaagatttgtgaaacatcaagtagcattagattctcaaatttaaaatgaagattcacattccacaaggctgtttgagatagccttatcaaatcagctgatttgactccaggtaggtctgccacagaattattatgaatagatagctaacttgggagaactttcacggtctggtcagcaacttgtgcgactttctaacagctttaactcataccctgatcactacagctttgagacagcgtgccaataagaataaaaggttccaatattaataaaataatatgaataatagctttaatttttaacacttgttagaatgctaggcaggtacaattcactaaacagtgacttattcaacaaatattaattaggattcgaaaaacgagtacagagttgaactctgcagctactctcctttaggctaccatttttaactaaatgaccttggccataatattcaaattcctatctgtaaaacagggtaaaaataatacctatcccacaagttgtgagaggcaaatgagtttgtgcacataaatcccttagaagagggcctatcacagagtgagttctcaatatgtcctagttgttattgcgcatgacagctacattccacgtggttactgggccctggaaatatgatggtgatcaagatatccatgtttccttacctcaatgaagcctacattcctatggggaaataaaacacaaacaagaaagcaatcgacgttcaaatgtaagtttatattgcactaaagaaaattagcatggtggttagattggcaatagctaggtgtgtacaagtgagatgaaggagtaaggaagaccatcatttgaggtgggcccagcagaggacaaagagccacacataataagaactggagatagattaaaaaagaaaaaattccaggcagaaggggcaactacaaaagcctagagaaaattaaataaaagagccaagatctcttaaatcctttcaggccaagaaaaagagttcagattttattctaaccacaaaaggaaaatgctgaattattttaattgagaaagtaaataatctgatctgtttttttttctcttgattttctccatttcttacccacttgcacagaaatttacttgcacaggtgtagagcttagaatgggaagtactgaagtatattaggaagattctcaacagacagcactgggagtgagatatttctggaacatatctaggaaaggtgagttttcctgataccttctccccaaatattctgaagaatatcagttttgagatttttttttatttaattaggagaaagaaaattctgatacaacacaagagattttagtaagtggaacaaagttcaaaatgaggaaagaggagaaaaaaatgagtaagctcccttagtaaaaagtattactataacaattcatttttagtagacatcttgagtgcaattttacttctcttttccagaaataaaattctgtgcaagaaatggagaaaatcaagagagaaagagaaagactagcaggaaattatcgcagtgttccaggtaagagatgattgacaactgggctaagataatggcaacagatatgaaaacaagtaaatagaatcatagtatggcttggaagtaaaaacaaaaataaacaataatgacaaaataaacctgtgaaataagcatcatcgttatcttaattatgttatatatatatatatatgaagaaggcttatagaatttaaaaactcagccaaaaagcaactggagttcaagcaccaggaatttctgactgccatttagatgttaggataagaagtgtggttgtgagaaaaataagcattcactttaatgcttcctatgtcagcatatctagagtcaaactgaacaccatgaaatgttttgtaagcatgcatctgttgagtatttgctatacggagcatcttcaggtttcttttatttaagtcttgcaagttgtcaaagatttttgttttcattcttttcctttctgcctttcttttagtctcttaagacatgctctgaaaggaagcactgcaggaaaacttgttactgtttggatttttacttgaaaaacggttgtttgtttttattgctatattctccaaaaggtggattgctttctcaaatgtgtgaacttccacttgagaaagaggagttgaactcttacctacctccaacccttcaaaagaatcagcattccaggattattattttgccatgtgctgatttgcacctgacgtgagattattgttgcaaggagcaaaccttccaaaagaaaaagttatttcagtgctgccaacattcccagtctccctaacgaagcaatcagctttcagaatttggcactgcaactccctgaacacactgtcacccccaaattctcttaaactatatgactgtccacagttgtagagctcagaatgggaagtactgaagtatgttaggaaggttctcaatggacagcactggaaatgagatctttctggaatatatttaggtaaggtaagtgagttttcctgataacttgtctccaaatattctgaagaacatgagttttgagggttttttttttaatttaattaggagaagaacgctaatacaacacaagagagtttagtaagtgggacaaagttcaaaatgaggaaagagaagaaaaaatgagtaagttcctttagtaaaaagtattactataacaactcattcctcatagacctcttgagtgcaattttactcctcttgtctagaaacatctctaaaagtaatgttatcagagggcaattctttaggctgacagcattttacatatttcatattgaaattgattggtctttctaccttagcaaaacatttgtagaagaaagttgacaaggaagaaacagaagagaggatgtgaaataattcataaatattcacaatctatccgttaaatttcctacagtccctcaattttcccagcttcatccacttttcatttcctgagtcaagaaaagattgaagtcttcgaaatgagggaaagtataatgatagaaaaacatagacccagaattaagactaaaattaaagacagtagtgaactacacctaatagaaaggagcccttagccccacaaatggtataatgaacttgagctcacttttaggattgaaaagggtgcatattttttctatgtgttgtcaaaccccaccataaactcacacagggtttactttgcatggctatagtgcaaagtcatgtttaagttcttcatctcaacgttctccatttacatgaaaggatttggcaatggttgtaattactagagtgtcccaaataagatgggtcactgacaaggcttggctgcagctttgggatgctccaactttcattataaattcctttaaactcttcataatggggggtgtatttatataagaggcctacaaataattgttttttaattaattttttttgagacagtgtctcactctgctgcccaggctggagtgcagtggcaggatcatggctcattacagactcaaactcctaggctcaagtgatcctcctgccctagcctcctaagtagcttgaactacaggcacacaccaccatgctgagctaacttgttgtatttttgtagagacaaggtcttgctatgctacccatgctgttctcgaactcctaggctcaagctgtcttcctgcctgggcctccaaaatgctgggattacaggcctgagccaccacacctggcctaaataattatttaaagcttaccatcaagcctatacagacaactgtggaacattttgactcagactttatttctacctgattggcaaatagaacactttcagtggaaatgaggggacaggagtagaaaagaaatagctccctgatctcctgtccctggtgcttctgtccccaccattacaattagcacagagctggtcacctctgtatctagtagtatgctgttaagtgtttaacaaccatctctcccaaaataaaacagccttgatctgtagcatttgacaatttcttggtctacatattcccaacatggccaatttcaagctcccgacatggtatcactgaacatggagttgataaaaggtatgcagtcagctctggtcaaccatcatgaacactccagcacaccactgacagtgtcttctttggaaacagggagaatgaggatgacagtgaatataaagataagaaggccaaattgttagccaccacaatgcttgctgttatcattttgcaaccatgcttacacaaatgcaaccttcatgtattacggaatgaaacctttaacacctagataatgcctacatagtgcataatgaaagttcacaggaatagaaattcatttcagtagctcacgtttatatttgcatcttttgttagcatgctataaattatctattatgaaaaagtgttgacagctatatgagatcaagatagagtatgttctatctatcatcctaaaagagagaaatttccagttcttgatgtgagctgatgtttcgtctctcataacatagttaatacatgaatgcaaaagatcacataacagaattcactgtaagaataattagtgaaaaaagtattaaatatctactattgacttcttttacaactacaactgcaatacaaaaagtccatcccttgttaaacaaatacaattgtaacacaaaaagttcagagcgcctgaacacttcacctgatacccttcacctaatagtgacagttctcctgtcctgttgaagaaagcaagtctaatcctgaacaaaactgagatattgcaactttcagacaattcatgttcaattaccactgagtgtcatgatgtgtcttctccaggagcaaagagttccctttacatgactcagagatcaatttcctatgccaaataggagaagtaaaattgttcatgaaagcatattcactgaaccgctcatctgatctgaaaatgcatgttcctctcttggtttaaaaagtaaaaggcatagaaaatttatttttgtgaagtgacaacactacgtgacattttaataattctaatgctagcatcgaagaagcctaatcagtgtagatcaatgcgtcattaatggttttattccactcttcagatctttctgtcaatgctatagtatctagccacatatggttattcaaatttaaatcagctaaaattaaataaaatttaaaatatatttcttagtctcactagacacatttcaaacactcagtagccacatgtgatgagtggctaccatagtggacaaatgcaggtatagaacgtttcagtcatcacagaaagttctattggacagcactgactaaggtactcagacatcattacaccagcaaaccagaaaatgaagggaagagaaaaacattgaaactgccatttgccttaacccattgctatgttcttatagaaatgagtttggtccaggagcgtcttttgaattgttggatgatagggcaccttaatctgaaacccattatccttgagtgaacatgcaacctttctcttgcatatataattataatagggaggactggaaaaagcatttattaagtttatgcttaacataataattcccaagcatcatatgtgcccacaggagaaataaaatctggctgcccaaaaatgattccttcctcttatttttcaattctccttgaccctaatataatagaaatctttacaataagcagtgttttagtccctgggaggaaagccctcaatccctttgcagcccagatgtttctctgctgaatcctgactctaccagctggatgttaaagcaagttcagagagcctcctctcttgggtctattaatgaagcagaattttccttctttgacaggcaagggctaattattatccttgagtaaaaaaaaattcactcgctgccccctgaaaaaaaagcaaaattcatatttaaagccagcagtttccaaattaaatttcacagaacctcagattgattaatttccaaatctagttgctgaagcaacaactctgtcctcaggcataatccgtgctttttcaatatagtggttatcacagtaatagaggtatcagcaaaactaatgttatggaggctaaaacataatgttttgtaattatatatctgcctgtcagaggtgccttgggttgaataatctcttgatgatagaaaatagatttgacggcacacaaaatagcggaaaatatcttgcatgcacctgcctgattgttctagataagctaagcagaaaacaacacatagcagtctatctttttttgctgctgttgttctgtttgtttgtttttttgagaccaagtctcactctgtcactcagactggagtgcagtggcgtgatctcaactcactacagcctctacctcactgcaacctccgcctcccaggttcaagcaattctcctgcctcagcctcctgagtagctgggactacaagcacatgccaccacacctggctaataaaacaacacgtagccatctatcttgacacatagggttagaaaatgacatttctttaaaaaacaaacaaacaaaaaactacacaaaagtactattgtctcatataaaaagcctcgtcagatttatttttctgctcatcttttttctatttttctatcttatgtcactaccacccagtcatttttcactgattctctttttttgacagtcactcatttgcccttatctagaggctaggcagcatcacagccagaatctgaaaatgccggttcacaatgagatttccaaaaaaatatttctcccaatctcaaaaggttctatccaagatattatcatgaatgtgtcagccatttaaaaaattagattaggaagaatttcacaatagttcattgtttactttagttgaactggtgggggaaccacgggggatttgagtcatactttcttttaatattttcttttttcttttcctgtgttaacttttgtatctcacatttcttagttattttcctctgcttcctttttctaatttaatgctatttgttctcatagaattaggggagctgagcactttctaaggaaatcctagaatgcagagttaattttatacttattactacattttcaccgcaaaaaaaatcatgagcacacattgtagggtacatttttaagaacaattcgattttctccctgaatatcatttgcctgggcaccctgaatgcagttcactcgcctgtgagagtttgcaggttggtagttgatatggtttggctgtggccccacccaaatctcatcttgaattgtagcttccttaattcccatgtgttgtgggagggacccagtgggagacatgtgaatcatgggggcggtttcccccatactgttcttgtgatagtgaataagtctcacgagatctgatgattttataagggatttcccctttcttttcgctctcattccctcttgtctgctgccatgtgtcttgtgtctttcaccatgattgtgaggcctcccctgccgcgtggaactgtgagtccattaaacctctttttctttataagttacccagtctcgggtatgtctttatcagcagtgtgaaaacggactaataaagtagtgaaatgaggttttttcacctcatggaaaatagacattgtatgacccatcagtttcctgttattttaaccttcactagggtcatgaaaaaactcagagcaagttgtatttcttctctcctacttgctctgtcatctgtagaaattagctgaggtaaagaggcaccttcttctcattaatcattgtaagttaaggaataattttattgctgtgaatgttttgggccgcatgcccatttcaaagttgaagatgttaagccgacccattttctcataagatgtatgtttctgcatcttcaaccaatattccttggtctgctaaaatacattagaaagtaggaaagataaatagactcacatagctgttttgaggcagcagattgaaccataaggcatatagaagttatagttttatgtctgcttataccataataaataacttcaaaaatagacaaattctttgcaaaataaaactgtaggataaaccagaaggctagaaacacaaaatactgaatgatcaagtcaaaatagaatcctcactttgcttagtgaccaaacctgattcagaataaagcaattatgcaaggtataagaacatcaggtgaaaatgcctctaaataaataaaacgcagcatttgtttcacaaatatttgaaatttcaatataatagaacacaaattaaaatggcttcattacagaaattatagccttaagtttgcctttttgtaaaaaaaaaaaagaataattatattctatctttaaatagattgtaaacaccacaagcagggtgtgtgtgtgtgtgtgtgtgtgtgtgttattcactaatgtatgtccggcatatagaaggtgtacaataaatagttgttggatagattttataaaagagtttcctgtatataatctcatatgatttcacctgatccagcagtcttaatgtatagtagacactagtcatatgtattagcccataggcacagactaaagagtgcagtacccatctgtgtctgtctacttgatagacaccaaatctctcagtattcattggatggtgatgccttctgcaaagatttggtcagactcaattcagccccctccattcactaccgcaacaccatattttattttatttttacttatttatttttgtttctatttttttagagacagggtcttactctgtcacccaggttggagtgcagtggcaccatcatagctcactgccatctcgaactcctgagctcaagcctcaggcctcccagagtgtgagccaccactctcagctcatactttattttcttaataatttttacaattagaagaaattatattattcagctacacatttactcgtttattgtttctcccatcccactaaaatgtaacttccatgaacaaagggtccttgtctgtcttagaccctaaggaagtacctcatacccagtagacactgcaagatttctatgtataaatgaatcagtgggtcagccatctacttggaattatttgtctggattatcttttgttcaattattctctctctttgcatactttacttgagtggcacaactgtttgtctgtttttgtttgtatgcttgtggcttttctttttctctctttcctcccccgtgatgtggatttcctccttggtgcacgggtgaggcaccctcgaagacctagcaggatcatggtagaatctaagaaaaaacaaccgtgaattcaatggcttaagctagctcttctctattatctcaaaaaaggtatgttgtttctaccttgtattcatcttcatgtttcctctaatctcatcagagaggtaagaccacaggagtcaagaataaggaaatatgtgccacattttctttatccagtctatcattgatggatatttgggttggttccaagtctttgctgttgtgaatagtaccccaataaacacatatgtgcatgtgtctttatagaatgatatataatcctttgggcatatagccagtaatgggattaccaggtcaaatggtatttctagttctagatccttgaggaatccccacactgtcttccgcaatggttgaactaatttacactcctaccaacagtgtaaaagcattcctatttctccacatacaccatggaatactgtacagccataaaaaaggatgagttcataccctttgcaggaacatggatgaatctggaaaccatcattctcagcaaactaacacaagaacagaaaaccaaacaccgccatgttctcacttacaagtgggagttgaacaatgagaacacatggacacagggaggggaacatcacacaccaaggcctgtggggggatggggggcaaggggagggagagcattaggagaaatacctaatgtaggggacgggttgatgggtgcagcaaaccaccacagcacgtgtatacctatgtaaaaaaactgcacgaaataaggaggccagtgggcacatctaagccttcagctaggcaagaaaatgacctttggagtctcacattcattctgttccttctgtttaccataataagatacagcacagggttgttttttttttttttttttttttttgagtcggagtctcgctctcttgcccaggctgcagtgcagtagcacaatctcagctcactgcaacctccacctcccaggttcaagcaattctcctgcctcagactcccaaagagctgggattatgggcacatgccaccatgcccagctatttttttgtatttttagtagagatgggatttcaccatattggccaggctggtcttgaactcctggtctcaagcgatctgccctccttggcctcccaaagtaccgggattacaggtgtgagccactgtgcccagccaacacagggtaacacggtcaaatcctcagcaggcaatactagcatgtacgtttgccttaactgtcctttgcatcacagttattccttggcaacccatgtgacaaaaagcagctggcaagttattcaaatctctgcattacacagtcacctatcaaaactaacagcacagacattacagatgaggaaacagcctcagagtagtcatgagacaggactgctcttccccctacatcctgtttcaattacttttcactcactgagaatgtgaaaaataaaatgaatgttgtaatacacattttcattattatttattccttggttgggtggcaaactgttaaggtaaattgattgtaagaccaccaggcaatgctaaagacataaaccagccttaacatttaaataataggaacatcctatgaccacttcgactcattgatttgtcatgttcacttattgcttctttttctccttccaggcaattttctggaaagactgaaaagtttttgttctcattttcttcaatatggcagtaatcctaaatcttaaagcaataaaaatagccattataaattcaaggaaagagttggaatatttttttataaaaatctgactatgtcctctcactcaagtcacttaaggagttatttgtacagctcctgctgctattcaaagtagccagagctctaattcaagtaatatcctttcttcttcaattccgcatacttcctcacccctgtgggtcagcactttgttcagtatttgtgactggattactggtctttccccaacaaccactatttttcttccatttctgggtttcttctcttctcacgttatgaaagccatacttttgtacttagcttttacactttcgagaacattcggtctttaaaagcaagaacactgtcttagctatcttttgatctccaacagtgattgtctttacaaatggaagcaatggtgaatatgcaatgattatcctttcctctttgctccactcatccccaataatttaatatgtttgtgataattagatttgcattgaaaatggaaatttagagaaaactttaggctaataatggacattgtcctctaattggacattagctgtaacaagtctaggctagatcctaaggaattaaccaaacaccctaagcactttcatcttcaatcctattacatttaaatgggtatctaggtcttttgaaattttaatcacctagaaagctgctgttagtttcctagagcctgctgggtgaaattattatcccacagcatttgtactgcaagtcctagacactcttggagaaatagcaccacataactttctcttcccttacagtcaaaagtggtaaaatctccaaagagatgactcaaagcctggtcaaggaactatatcagtaaacacagtaatcacatgagtttgtcaagatgaaaaattggctccttatgtgaaaccaaacagcttttttttctgtgtcaccattccaggcgaaaaagagaatgatagctttgtacagggtgggtagagagggtcttgttctgggttctgatatataggcttaaaatttaaggggaggaatttagttttggcaggaaaaagttctcaactgtaacagttatttgacactggaatgtaatataaaagaaaatcacaggttgcttccataagattttagatttttaaatgttgtactgaatcctctgagggctactaggagcaaagaaatagcatcttaaagaagagacctgtgattctataaatgtatttaaatataatgaagagtttgctaacactagtgattttcaaagagtggaacaagtaattggaaaagtaaagaatatcattctaaaggtttaaacacaaaaagatgtatacttcaattagacatggtttctaaaattaattcagtattcaaaaatgtaatcccaaacgtaagtatctctggagtcaacaacatcaattaacactttacactcacagaatacctggcactaagtaaaacattcccaaaataaagtgtttgccctctctgcattcacattcggcacgggatggtacaacctgaatattacaaagagtcagtctgaatccattttaaagtttgaattataaatcagttgtagagtcagaattatacaactttaggggagaaacatgagtcaccacggttgtaaatcagaattatacaacttctggggagaaacattggtcactatctcataaaactaagattctttttttctcatttttgttttttaaatagctgtcttctttttaagaagaaaaaaaaccatacactcattaactttctcaatatctgtcatggtcacattttaagagatggagaaaaacaatccaaatcatttagcgtaccacaagtgaattaatccacctttctcagagatagttgggatattttcatcccagtgttactaatcaattacaaagcctactctggagaggaaagactctaatttaaatgcaagcagcatgtgaagctcttcttttttattattatttcaagtaaattgtttcattaaaaacctcaggaaggagatggcttcctgtgcttgtacagagaaaagtgcccgggacagataaataagtcagcagagcccaaattaacttgcttcattatctcatccactcacctacacagaagaatctacctttctggatctctcccttcctccgcgctctctccccacgtcattgcttcccatccgggagaaaagactagagaacaagtttcagttcactctctctgaacacttccctggagacggctctaactttgactattatgcacttcaaatgttatgcagcagcagctgccgggcatcacgtcggggcaatatttaaatattatgcctaccagctgtgttttcttaaatagtacctttaaacgtcagtggctgtgtttgtgatagactctacaaggcatggaatatgcattgcaaaatcattttctcctctagagatttaacagttccaaaaatgtctttacatcggtaagaaaagtttgcctttcttcaacgcttccccccttatataactgagttaatgagtgttccttgcttgcagctatctttccaaaggcaggcaccaaatatgaaaaaacattcatcagtgaaactttaagcaagagaataagccaatgcattgaaacctgggtaatgggttccggatgactgaagttgaacaagagtcgcagtcaggactgggggccattatgataactataaatagaagtaaggttagcgctactggctctttgatcatttttcagtctatagctcacaaactcctgtcgttaaaaattctaagaattactatgcaattgagcaggcaatgaatgttttttaatacacaggttttttttgtagaatgtgtatacctgaaccactctttttaggtaatcctggaaactgtatgcaaaaaaaaaattttaaaccgaaattagaaaatattatcacaaaatagtggctcgtgtacaggattctctgaatccaaatgatcccaaaccacatcacaaaacagttaaattagtgtaaaaatttatgtaggaagacagattgttatttccacactgtaatagacagagtgactcattcccctaagggtaagcatgcatcctgctacatttttcaaatgttataaaggtaacttatctctagtccatattgtctccaaaagtaacagtcagggtagcaatactgcagataagcaagaataggacaattggacaagaccaggggcttaagtcttgtcacctgttatctagaattggtctggctttgacgtattaaattctcattctaccacatcttttaatttctaggtctactgcctcctctattttcttggatccttttcaaacccatcctgccttcatattctatactaattacttagattctattatccatcatgcatcactttgttcacactttgtcaatattttcaacttttttgagccagtgttcttccttctctccaaagtttctattacttgttaaattagagagatactagaacaagctagtgattacttaaaacatgaatatttcatgtttattcaatctttccataacccttgtttagaatacactttagccactccagaattttgcaattcttctgtaccctgagaatatacatttgcatttttacctttttttcaattttctctttgctggcagttaaagattaatttttctctttgctctaatagccttgtgcgtttgatgttggtggctaataaattcataatgctaatgatcttagacatatctaagtatcttttggtcttcaaagtgctaataattgaacttccaacacggttaagtgtagaggatacaccctcaggctctgacagcagttccaaatatcatcagacaactgagaactcttgtgctgagtgacctgggatttcttaagcagattcaactgaaccttacaatatttaagggacacccagaaagacgataattccgctacaggaagcgggaatgccaacaatcataaattggcaacataatgcagaaaaggacagctgagtttttgctaatgccaaggcagaagcagtagagggttgactgacactaagaagattatctctggattttcaatacagcaggcaaatgaatactgcagataaacacactatcaactttattcttacaaccctgatattgactttaatcttgaccttggaatggcttctctgtacacacaaagcctgtttgaaatgacatttttttaaggtgaaacaataatttatctagtgatgaacttgtatttagatgtttacagctggccagccaactaagtgctttacatacatcttgtctgatttaatccttacaacaacatgatgagctcactatgaactcccataatttacagacagggaaactgaggcttggtgcagaatcaatccaatatcagggcctgagcaattatatcccattcctagactgcaccccagtagtttgtgtttcagtattctggcttcctatagttaacaatctggacaattaccgataattataaaaaacaagggctgataattataaaaagcaggtactaaaaacagtgcagagcaaatgacagtgggtaattgacaggattcagggtataagaaaaaagaaaagcacaattcaccgcaagttctagccttctctatgggaaaagcaggccactgactatgtagtgatctttacgaccttgaagctttctttagccagaaattgaaggtctttgtctccagtcttctttagagccaggcattcttatccttaactactttaggggcttttttaaggacacatgtatattaactaggctgttacgtttcctaggaagcggaacacattaattaagtgaaggaattatttcatctactccagatcattactatctctttttcgttttttttttttttttttttgagatagagtctcactctgttgtccaggctggagtgcagtggcacaatctcggctaactgcaacctccgcctccaaggttcaggcaattctcctgcctcagtctcccgagcagctgggattacaggcctgtgccaccaagcccagctaatatttgtatttttagtagagaaggggtttcaccatgttggctaggctgctctcgaactcctgacctcaagtgatccacctgcctcggcctcccaaagtgctgggattacaggcacgagccaccatgcccgtccatctcttttcaattaatagacacacacatataaagatttctgtgaagagacgttttacacttcacttattcaagtcctagatccgttcccatcacttcagtaaagctcttttgccaaggtgacctggtggttatttttagttcttatcttattctctacagtattctccattcgacatctttctccatttgaagtagtccctttctttggatatgagcgcattactctctcctcctttccttgttctctgactctcacagctccctctctctgcaagctactattcttttaccgatccatcaagtgctggagtttctaggggctctgttccaagcgtcttctcttcacactctacatattcagtctgggcacctcactcactcatgcagtttcagtttccatatttatgcagacaaccctgaaatctctatcttcagctcagaattctacacagaagttcaggcctatatatcaaaatgtataccagctctcttagacaccctgcagacaccttacattccataattcgcaaaatccagttgtctttctccaactgaaaaacctgttcattttctgtatctcagtaacctgagtgtcacagtcctcatcccccatatcctatcaaccaccatctcctgtatattctacgtattaagcacatcattaccctctgtcctccttatcgctcatttaatgccagatgccatctctcctctggattatacaaccaactacagaaggtcttcatgcttcttggtcccatagataggacctgccatgttgcccaggctggtctcaaactcccgaccacgagcaatcctcccacctcaacctcccacagcgctgggattacaggcataagcctcctcacctggcttcactctactattaataacctcaaatttgcatgctgctctttactgctattaataagcattaaaggcttgcagttggtgtcttctcagaaggctcttcttctacttcttagaaatagaataacaaattctacattgccttctattttcaagttagatgctacatccatagcaaagtttcttctaactccaggatctggctagcctactcccgctgtgtgctgccaacattcctaatgtgtctggaattggtgggttcttggtttcactgacttcaagaatgaagccacagaccctcgtggtgagtgttacagttcttaaaggtgatgtgtccggagtttgctccttctgatgttcaggcatgttcagcgtttcttccttctggtgggttcgtggtctcgctggcttcgggagtgaacctgcagaccttcacagtgagtgtcacagctcttaaggcagcacgtctggagctgttcattcctcccatccggagttgttcactcctcccggggggtttgtggtcttgctggcctcaggagtgaaactgcagaccttggcggtgagtgttacagctcataaaatcagtgcagaccccaagcgtgagcagcagcaagatttattgcaaacaccgaaagaacagagctcccacggtggggaaggggacctgagcaggttgccactgctggcttgggcagcctgcttttattccctcatctggccccacccacattctgctgattggtccattttacagagagctgattggtccattttacagagagctgattggtccattttgacagggtgctgattggtgtgtttacaatccctgagctagacacaaaagttctccaagtccccactagattagctagacacagagcactgaatggtgcattcacaaaccctgagctagacacagggtgctgattggtgcatttacaaaccttgagctagacacagagtgctgattgctgcattcacaatcccttggctagacataaaggttctccaagtccccaccagatcagctagacacagagcactgattggtgcatttacaaaccttgagctagacacagagtgctgattggtgtatttacaatcccttagctagacctaaaggttctccaagtccccactagactcaggagcccagctggcttcacctagtggatcccacaccagggctgcaggaggagctgccccctagtcccacgccctgcgcccacactcctcagcccttgggcggtcgatgggatggggcgccatggagcagggggcggtgctcctcaaggaggctccagctgcacaggagcccaccatggccgggaggctcaggcatggtgggctgcaggtcctgaaccctgccccacggggaggcagctgaggcccagggccagcactgctgggggacccggtgcacccttcgcagctgctggcctgggtgctaagcccctcactgcctgggccggcggcagccagctgctcccagtgtgggccgccgagcccacacccacctggaactcgagctggcctgcaagggctgcgcagccccggttcccacccatgcttctccctccacacctccctgcaagctgagggagccagctccggccttggccagcccagagaggggctccctcagtgcagcggtgggctgaaggtctcctcaagcgccgccagagtgggcgccaaggccgaagaggtgctgagaaccagcgagggctgccagcacgctgtcacctctcactaatacttattcctctccatgtagtaccttaattgcttaatgctacatgaatgagaggaatgaatgagatgctagtgctgtaaattttcaacatttaaagtacttaagacagagaagtgactagatgatatggtggataggggagttatactgaagctgcatttaaatagcaggcgtaatgtttctgcttctatttattgtttatttggtatgatttggaggggttcattattactatgagagtaaattgggtctatgagggtctaaaatttctcacaagccacccattagtatcactaatgaaataaaccagtggtttgcaaacatttttcatttaagcttctatcagtaaataatatgagcatgtacctttaatgtgtggattttataatttatagattatacacatgtacttatatataatataccttttaaacattctcagaaacaaagttttaaaaaattttaagataaatggagattctaaatttttctataccttggtcgaccatctattgatttctgtttaaagatcatctttacaaatggtttgtttttcatttctgtgggtacatggtaggtgtatatatttatgcggtacaggagatatcctgatacaagcatgcaatgcataataatcacatcagggtaaatggggtacccatcccctcaagcatttgtcctttgtgttacaatccagttgtacacttttagttgtttttaaagtacaattaaattattactgactatagtcaccctggtgtgctatcaaatactaggtcttattcattaaaaatgggttttgaagacaggaaatgtattaggttggttagctgctataacaacatcaaagatgggtctagcacagagctcaggatatagtaagcacccagtagttatcaagcgattgaaagacagaaagtttgcgctaaagagtagagtagcttatggaatgcggtctaaccaccagtgggatgcatgaacactcacaagataactccttcaaggaaaatttctcaaaaacatataagaaaaagtgcttgctcgccaagatggaaaagacaaccatacatagacaaacactccatcatttccttttaaatctaagcagctttttgatgggttttgtaaaactaatttcaaacattttcaacgactctcaaaatagttgtgactattaataaggtttgagggagagagataagaatagattcattttcataagcaaaattatcactgtatttgtgaatactattttacttcaaatattttccttgaagatttctatcttaagtggtttttagaactaagctatgccaaaattctgcatctgtgatgtcagaaaatattacccattgttctggccacataagggcaaagtacaatttcaaagacatactgaaaatggtggccaaggtttcacagtttgtcagaagttagctggaaaaagaaaaaaacattattgccagccacagtggctcatgactgtagtttcagcactttgggaggccaaggcgagaggatcgtttgaggccaggagttcaagaccagcctgggcaacatagcaagaccctgtctctccaaaaccaaacaaacaaacaaaaaacgttttaaaattatctggacatggtaacatgtacctgcagtcccagctactttggagactgaggcaggaggaccacttgagcccaggagttcaaggctgcggtgagtcacgatcatgccacccagcctgggtgacagagtgagaccctgcctctaaaagaaataatcattcttttttgtatgcacttcacctcccaataatagtatttaattcctcaagataagcaaacaacatggtgttcatacgccttgagagaaaggactgtaactaagagagtctcgtcgagttcagagagtggtagattgtaagagttaaaggaatttttacaggtcacaggcaaacacaagtgctatagcttgaattctgaggctttgatttagacgcatttggctgtttttctcaaggtgacagaaaaaaaaagtcatgcattcctactcttttctgattcttgaagacaaaacctggcctggcctgggaagctgaaatatctgatgagtttgatttcttccctacaaaatgttcatgaaacatttgatcttctgattcattctattcgtttttaatagctttaaacatacaataagttttaggtgtacaattcattggctgctaggaagtgtacagagctgtgcaaccatcactacaatccaattttaaaacatctccatcactccagaaaggaacgccatgtctgtctgcaggcactccttatgaccactgcaactcccaggttaccattaatctactttctgtcactatcaatttaccttttctggacttttcctttaagtggaattctacaatatgtggtcttttgtgtctggctgattctacttagcaccatgtttctgaggttcatagatgcagcagcgtgtgtcagtactccatgcctttccattggccaatagtattgtgttgtgtggttatacaattttttgtttctctactcatcagctaatggacatttgagttctttccattttctggctaatataaataaaactgtgaatgaacatttacatacaagtcttcgtgtgaatatataattttatttttcttaggtagctagaattgaaattgctgggtcctatggtatatttacatttaacattttaagacactgccaaacttttcccaagcagctacaccatcattctaccttaaatttcctgagtaccaggtaaatgataatcgtggtgttttgaacaggactacatttgctaaccaaaatagaacataaatttctgccagctcttagctcttaccagttaatatacttccatcattctatcatttcatattatcccatctattgctaaagtgatataatctgataagcaaaattgatctgtagagacgctaaaattaaatgctagttacttggaactatttggagattcaaattcaaatgggccattaaaagttacctttcttttttttgtaaatctgcttaaaaaaccccagaagcattcatatcactcctacatttcttccgaaaatttccatcaacatggtaaagagatcgagactaataagtacaattatatgacacagagatccttcagcaagccatctctgtaaagaggcataagggagtccatcgatctagtctttagagcagagtgacatttctgtgaaaaacaatattttatgtcagactgttgcttgagtagtccatgaaggataaagaaacaaggaaactaaacactgttcacagatcaacaaatgtcttttctcctcaagtgaattctgcattgtcaaactcagcaaagccaagatataaccatgacgttaaacagagttcttaattcagcttttcacaaagagagaaatctaaatttcacttatatttttttaaaagaaaatctacattgaatggaagagcaaggcctccacctagtggatagttcgaaaattttgttttttacagtctcatttggcatttatatggtaaaatgtcataatggatatatagagtgaacgacaaaacagaaatgtcgctaattagctctcacttactaacgaagccagttaaaacttgaaaataatttcacaatctttcagggagacagggaaaggtacagtcaccaataatacatttagaaataaatgtaggcaataaaagaaagtgagacgaggcaaacttttaaaggtatgaagaacatttagctagacgattaaaaatttgtgtgtataaaaaatcctcaagaccacatgaattaccatattgatgttcctcagtttcaggcaatcaatggggttattttccaccatcagctctgtagatagcacagatttttcttcttttttttttcagacagactcttgctctgttgcccagtctagagtgagcaagcagcctctcactagagttcactgcagcctggagttcctggggtcaagtaatcctcctgcctcagcccgccagagcgctggtattacagatgtgaaccactgcatctggccaactgttcttttaaatcatgtcactttacaaagcaattataggaatcttataaccatatataataatttccaaattgtatggctactataagttgattaaaagtctagagaacaacagatttgaggcttataattgtactgtaatgcatgctttattcattaggatctcagcacgtaggcagacattaaacaaaacttatgctaacatttgaggactcactgtattctaggcactggtaagggcttgatataaattatcttctataatccccaaaacaatcctattcttcccccttggtacggatgaagaaattgtgccttcaccacagaaatagcagagctggaatttgttccaggaagtcagactccagaggccacgttcttaagctctgaatgaaaacagaaaaaagcacaataaaaagtgaacgcacattgagaaatgtgcgttcactttatattgtgctgtttttaaggagaaagcgtatactgttctaatttatattacttatttgctaattttcaagaaatttcaaacttcccatttcagtgttagaactgaagtgagaatcagaagccctgagctctttttccgtctctaccgcccctttgacatcagaccagtttttgacctttctaataaaatgacctgtatccttgtgatatggtttggctctgtatccccacccaaatcacatcttgtatctcccaaattcccatgtgttgtgggaggaaccctgtgggagataatggaatcatgggggcgggtctttcccgtgctgttctcctgatggtgaataagtctcacgagatctgatggctttaaaaacgggaattttcctgtgcaagctctcttctcttgtctgccaccacgtgagacatgcctttcaccttccgccatgattgtgaggcctccccagccacgtggaactctaagtccattaaacctctttcttttttaaagtgcccagcccggggtatgtctttatcagcagcgtgaaaacagaccttgtctagtgctcttggtattgaagccttgtggtgctgtattgaagtcaatggggatataataggtcatccctaagtggatatgttcctcatgcccactgcaaggcaaccataacagagtataaaacatgagcccaaacttccatgtataaaaaaagtgcacttgagagagcatgaagatcatttggttcaacatccctgtctctgtatttcctttgccttataatatcgttgactaggactcagtgattccccacagcggtgcttttagcctttgacgcaattcttggttgttgaggattatcccatgattggaagatagttaacatctttggccccaccttcaaaatgctactagagcgctgcacattttcaaacacatacctaggaaaaaacagtaaaacctttcgtcaaaaaccatgcgaaaactcctagaatctttatctctcactcagcccagagattgtcaacaatagagaaacatcacggaagacaaaaaacccacaggcactttgagtccaccagtcaacagcctatactgattgctggtggggttccctgtatccagcgaggaagacagaatgcaaagccaagaaaggtacatgaaatgtgtggtagtggttcctcttgtgatcaagcagctttagagattggcattgaaaatatagaactatgatttatgatcttcaacatgaaaatgatcattgatgcgacacagaaaaatacaaaacaggattgacggccacaatgtgtatatgtgttgtgagtgtaaagggtagaatatttcagactctctgtgttaaccaaaaataaaattattttcttgtttttctgtaactcaacctcaatttgaacacactatttcacataataacagaaatttggtctaatcattcaaaacaaactccaaggttttctcagtcatttcttacgtaatctcaatattctctctctttcattccttttccatttgtggaggtgagaggctaataatagtaataattataacaatagctaaaatattaagctactattaacttcttaaggtgcaatccctccctcacaccactccctgctttctcatccccagacagctgatcttctttctatcgtgatagattagtctgcatttttatatgtcattttatataaattgaatcataccatatgtactctttttgtttggcttcattcactcaacataatttttttgagattcattcatattgttgcttgtattaataattcattcctttttattgtgtgaatatacctcattccattaaacaggtaatggaaattttggttgtttccagtttgtaaccatcacaaatagagtctctgtgaatattaaggtacaacctgtttggtggacatatgtttccactttccttctactcttcctagaagtggaatgcaggggtcatacggtaggtgttcatacatctttctaagaaaatgccaaactgttttccaaagtgattttattattttacattcacaccagtaatgtataagagtttatagtccctccagcaaactaacaaggaacagaaaaccaaacaccacatgttttcactcataagcgggagttgaacgatgagaacatatggacacacggaggggtacatcacacatcggggcctatcaggtggttgggggcaagggtagggaaaacattaggacaaatatctaatgcatgtggggcttaaaacctagatcatgggttgacaggtgcagcaaaccaccatggcacatgtatacctatgtaacaaacctgcacgttctgcatatgtatcccagaacttaaagtaaaattaaaaataaaaaagtttacagccccccaatatgtaatatgctcagacttttaaaatttctgtcatttcagtgggtgagtagtgataactcattgtggtggaattttcatttccctagtgactaatgatcttaagcctcttttgatgtgtttatcatctgtataactcctttgataaaacatctgtttgtatatcttgcccattttctactatgctatttctttttattagacatttttatgttctaattacaagttatttatcagattcatgtttgcaatatttttcctggtttatttgcttaacagaataaactgttttagatggtaatgcacaatattaatttttttctcttatgaattgtgtttctggtgttgtatttaagaaatattttccaaggccaagaccactaaagttttctcctatgttatcgtctagaagtcctatacttttgacatgtttttttcttttttttgagacagagtctcactctgtcacccaggctggagttcaatggtgagatctcggctcactgcaacctccgcctcccggattcaagcaattctcctgcctcagcctccttagtagctgggattacaggcatgcgccaccatgctcggctaatttttgtatttttagtagagacagggtttcaccatgttggccaggctggtctcagactcctgacctcaggtgatctgcccacctcagcctcccaaagtgctgggattacaggcatgagccaccacacccagcaattttagggtttatatttaagtctatgaaccatttcaatataatttttgttgatattgggaggtaagagttgagtattgggtttctgcatgtggctacgtgattgttcccaaaccatttgttgaaaagattatacttttcccattaaacgcattccacttacctatttttctatccttacaccaaaatcacactctcttgctcactgcagatttatatgctaagttttaaaatcagttaatgaagacctccaactttcttctttttcaaagttgttttggaatttctacgtcctttgcatttctatataaatgttagaataatgttgttaattgcctgaaaaaaaaggctttctaaggatttggttatcattgtgttacacatgtagatcatttgggggataattaataataacattgaaacttatgatccaaacactgtatattctccaattatttaggccttctttaagttatcttagcaatgatcggtagttttccaagtacgggtcttgagaatctttcgttaagggtatacgtcgttatgctattttttttttttttttttttttttttttgagactgagtctcgctctttcgcccaggccggactgcagcggcactgtctcgacttactgcaagctctgcctcccgggttcacgccattctcctgcctcagcctccccagtagctgggactacaggcgcccgccaccacacccggctaattttttgtatttttagtagagacggggtttcaccatgttagccaagatggtctcgatctcccgatctcgtgatccgcctgcctcggcctcccaaagtgctgggattacaggcgtgagccaccgcgcctgacctccaatgctgtttttaatgtactttttaaatttatattcctaattgtttgccacccatatatacaaatacaatttaattttgtatttatatcttgtcatctctagatataattggttttacttcttctttttttatcggcatgacttttgtttgtttttcttgcctattgcattggatagaacctctagtacgataactgagcaaaagcaattaaagcagacatccttattttctttctatccttagaaggaaagcattaagtctttcaccattaagtttgatgttaactgtaggtttctcacagataccctttattaaggttaacacagcttctttctctgctaattgtttttttcagaaatgaatgttggattttgccaaagcttcttccacatctactgaggtgatcatatggttcttttgtaatctgttaatgtggtgaattacataggttgattttcagtgtgaaaccaactctgcagtcttggatgaattctactggatcattatgtgatatctttttaaaatactgttaggtttggcggggcattgtggctcacacctgtaatcccaacagtttgggaggccaaggtgggtggatcacttgaggccaggagtctgagaccagtctggccaacatggtgaaaccccatctccactaaaaatacaaaaattaactagtgcccacctgtaatcccaactacttgggagactgaggcagaagaattgcttgaatccaggaggcaaaggttgcaacgagccaagatcgccactgcacgccagcctgggtaacagagcgagactctgtctcaaaaaaaaaaaaaaaaaaaaaaaattgttgggttcaatttactaaactttttgcaaaatttgtgcatccatctttatttagccattggtttgtagttccctagaaatttctttggaaagattttctggaaaaggttgtattgaattggtactatttacttgacatgattaacacatattcacatattttaactcttaatctccatgaaaacagtatgaagcagaccattatcatgattttacacagtgattaattcacttgcccaagggtcataacttataaatcatggggccagaattaaaactttgtcagtctaataaagacgcactacttcactatactaatttcaattacagtcaaaatgaaatcaatacctttaatatataagtagtatatgtttggtaatctcatttaagcttcattgttcatagactgagatcttggcagaaagagtggaggacctttgctaaggatacatctagctctttggaaataacagtatctaacagcatgttaaaataggaaacttcttgccccagcttttggtgaggtccccaaaggctcagaaacaaaattaaaggttcaaatttgcaaaaatgatgtttaaaaactgtttttatgagccttagttaacaatcagtcaagggttggtagtagaagaggctgaaatatgtgaaagctggataattgaggcattctcccacctactcctctttgccataagtctaaaaagaggagattcgagaagaccacctgtagagctacctattgtgtgagaagcaaagaagctggtgtctgactcaaggctgactagagcaaatgcaaaaatccatgctgtgagctgcttgcaatgtcaggacaagaaaagcacagcaaagaaggcagctattctttcataatttagatgggcaatgatgcacgagttgcctgagagaaaaatggatgatcaagaagaagttcaacaggtcaaagtcccctgaagagctcattcccaaaaaataaaaataagaaacaaaacaaacagccagggtaaggggacctcagcaaaaagaagctatgggtggtacctttgggtattgatgcctgttgtgagacctcgattcttttcttcttagtttgaaataatttacacaagcaacacacaggaaaagagatgcaacatagagtaatttattgcaaaggaaaaaaaatattttgaaagttaagtgcagaataggcaatacacactgagaggggagtcagagtgacctgcccgtgaggatgagacagcaaagactggcactagggagactccctttatgggaatcttacgtaatcatccatgagcaagtgggaagaggtgtctgggtggccctctgggcacacatgcacagtagctgtacatgcctgttcatatgtcacgtgtctcattagcatcttaaatctccacccagggtgtgtgttttttagtattatagtgagcacagggtcagtctgaggacagataaaatcaaagtgcacatgctccctaccggggaaattccctactggagatagctttgcttgaataagctggactacagtgcaaatgtggggggttattgttttgactgtatggtcaccatgatggatgcatcccaaggacatggctatttccatgactacctatcctgccccacagaggctctgaggatgaatcacaagaagttagctggagagtgaatctcccacatgagaggattggagcagagggcagccaagaattcaccctgcaaaaaaaaacctatttgaacatccatcattctcaaagaaaaaaaaacaatggtatatctactacgtatgcttcatttaaaaattttgaattattatccataagtatgactggtcataggaggggtgtgtgtgtgtgtgtgtgtgtgtgtgtgtgtgtgtctttgttaggttttgataatgcgtttatgttggctttgtacaaggaattttctgttgtggcccaagtaataatgttttcttacagtcttaccatcttagatgagacttaaagaggcccagagaacagcctgtgttcttggtaaaaccacctttcctactcactctcacctacaaacccctacagcattctcagtgaccacagtaaagtaacttacaggccattgacaaaaaggagtctattatatggaacatataatcactattccctcgttgctcctgagaacccaacattatgccttcattccattcacctcaacaatccaatcttatcaagcacactgctctaccagatttttaacctcctaacactttgtacatccacaatctaaatccaataccccacctctcccaaatcccctatattccttctctgaaactcatattcatcagtgtagtctataatatcttcaccctcttttctgagcattattcgtccttcttcatgaacgcagtctgtcttctatggactctgatattctgtaactctttcaagtagaggtgattttttctccatactatatgtgccaccaaacctaaaggtagattagatgtcagactttttcctccttgctacatccaaacatcttaccccctacttcttaaaacccccttgataattcagagcacatgccatcagaacatgacacgcttaatgtactgagaactgtagcactcagcacgtgactttctttcaactgctatcatcaacttaggtaagtcgctatgcctgtagagtcaacaccttgcccctccagtttcttgacctttttgctttcaataattttcttctacatcctgcctcttccaccaacaactacatcatcttcaatatctgggttttgatcacccctgtctctgataattacttcctctgatgacttccaattaagttggaattatgatcactggaattatggaatggatatggaattataataattccaataagcttcactcctattactcaaggtaatgtcaaactcactgtatctgtcaatccactaagctggccacttttttatgctacaacacgcatctcacgccctcccttccctccttacccagcttagatcccatgacctaccattataatgactaccacacataccctcagccccttcatccactttttcttctttacactcatctaacaaaacatcaaccctaactaaattcaattccaagtacaactctaagttctacatgtttattaatctcttaattgattggatttctacattaagtactttttccaggaagaatcatggatgtcgtattccctaggtccttgcattttcaagatcatccatctgtaatcttcacacctgaactgaaacgagccaggtataaatattcttattgatattttctttctctctcaacagtctagatactcttccactgtcctctggcactgaaaggttgtgtggaaaagttctgaaaccagtctgatgtttagttcattgtttagttcattttttcccttgaatcctgaatatttaattatccctaagaatcagtaactttgccttatgtagattgatatttatggaacatggtgcacctttccattttcagatgttaaaacttactaatttctttatagtggaaaagttgacggggggttgttttctcattatatcttggaatatttttcggtgtttttttaaaatccagaaaaggttaattgttttttatattgaccatgttttctgtaaattctttcatgctttatcttttttctttgcattatccgagttatttccagcctgtttgtcattggtttaattttcaacaatgcctacctcactattttttattagttccaatattatgtctttttatactcaattcatttccctagttctcccatactattctctggtctgttatcttttcatctttgagttttggttttatatagtctatacactttataatttctttaaaaatgcaaagcattagttgtgaatgtttttcttttgttttctagggcgtgttctcatttagagtactacgcatgagaaggtcatttatttcattttttaaataatcataggaacttctcatagttgttatcctgtctcttctcatttcactcatattagacaaggcagctcttctctttgcccatgtgtgagctctccttgaatctcttcttatctgcgatctaagagtgttgtcttaccttcagatggtcaacgtgaagaatgggtattgataggtcacactcactctgctctttgtttatctgagattgagaagctagagagaggaagctatgggcagttaggaagaagttggtctcttctctattttcctattgattttataaaatcctgttctgtattttgttttttctagtgaaatgttgacttctctccttaattcagagtgagctgctgaatcttccctctacaaaatatcactcattcttactaggctttattcctctttccactgaatattgagcttctaagttcaaatgggagtctttcaggctagccattaacttttcctgttctgtaaatgccaagataaaatattatgagagattaaattagtaaatctagttagattttttcttataatgaaaatacaagctggaaaattggagaatgctgtacaacccttccaaactccaacatgttcataagctcaactttcttaaattgatattaatattgtcatttcttactaacaaggactgcagataagctttagggactcttttttcctttctttctttttatttcaacctgttgacatataggcaacatgtccactataccatgattttaagtgctcctttcaaattcatatctagcccttcttcctaacccattttgggggtaaaaagttgctgagttcaaagtcctaacatcctaaaggacttctttctaaattaagtgccataaagttcttatcaaagaatatatggatttacgctatcaaaggcttccatagaaacctctaatttgactcaaatgaaaagtttagtccttttaaaatgaaaacattaaagcaataaggtgaaagcatcacttccattgatttagtaaccagtgacttctaagtgacttttaaatttgaatctcttttaaaaaccagaaacaggccgggcacggtggttcacacctgtaatcccagcactgtgggaggccaaggcgggtggatcacgaggttaggagatcgagaccatcctggctaacacagcgaaaccctgtctctactaaaaataaaaaaaactaaccgggagtggtggtgggtgcccgtagtcccagctactcaggaggctgaggcaggagaatggtgtgaacccgggaggcggatcttacagtgagtcgagatcgcgccactgcactccggcctgggcaacagagcgagactctgtctcaaaaaaataaataaataaaaataaaaaccagaaacatactggcaaattccggtagtctacctttatatggacactgtattctcacttcaaatccagtagggccaaaagaaaactcatattctccctgttgaactggtgtctttttctgattcgtcatctataacatttctgccattatatatacacaatgaagcttaacaatcttctttatttctccctttatcaaagagttcattggttaatcagtcactcagttctaaagatttttctccaccttgggaattaaatcatatttcttcctgtccgttcacacacacataccactgagaaatgcgagcccaggttacttttctcccaatctcccaagctatcttaataacagccaatctcctcatgattaggctctcactttgccatcccaattaaagttttgaccatgtcaccaccaacttaaaaaacgttccatggttctccaataccttctcaacctccttttgttgtttcaatatcccccacgatctggtccaatctccctgtcaacatcatctcacaaaagtatacacagtcaagccacaatgctttattcactattctccaaccacatttcatgtctttcatgatgacacttcttctgtcgaggctcctgtgtttattgccacactattcacagtaggaaagatatgaatcaacacgtgtgttcatcaggcccggcgcagtggctcacgcctgtaatcccagcactttgggaggacaagactggcggctcacgaggtcaggagatcgagaccatcctggctaacacggtgaaaccccgtctctactaaaaataaaaaaaaaattagccaggcttggtggtgggcgcctgtagtcccagctactcgggagtctgagaccggagaatggcgtgaacctggaggtggagcttgcagtgagccgagatcacgccactacaatccagcctgggcgacagagcaagactccgtctcaaaaaaaaaaaaaaagtgttcatcaatggataatgagataaacaaaatgtggtgtgtgtgcgcgcacacacacacacacacacacacacacagccatgtaaaaagaatgaaatcctgtcttttgccgcaatatggatggaactgcaggccattaccttaagtggaataactcagaaacacgaagacaaataccgcatgttctcacttagaagtgggagctgaacagtgtatacacatggacatacagtgtggaataatagacactggagattcgaaagggtggcagggtgggaaggaggtgaagaataagaaattatttaatggctacaatacacactgttggagtgacagttacactaaaagcccaggctgcaccactaaattaaatatccatgtaacaaaattgcactttcaacccttaaatgtgtacaaataaaaaaaagaacatttctattctttcctctcctgcttcatttctacatgttaaatcctatttagcattcaagtcttggatcaaatatgctgctacaaagccttctttgggattccgtaaataattaatctcctccctagatgactttttagttatcattatttattattattctcagtttatggttaataaatatatttattattttattatataatattatatataattatataatattatataattatataattactactactattctcattttatacttattatattattattgtcatttgattactctcatttatgctttctataaatcccttgacagcaaacttgctgtcaagaagtttctagagatttctagagagaagagtataaatgagactaatgagctgaccataaaataaaaatgtcatgttcatttttgttttcaaactcagagctcatggcctgctatggtttgaatacttgtgtccctgccaagattcacacgatgaaacctattcaccaatgtgatgatggtgggaggtatggcctttgagaggtgattagggcatgaaggcagagccttgatgaatggaattagtgccccatgataaaggtctgcagagagctgctgctccccttccaccatgtgagacacagcaagaagatgccatctatgagaaagggccttcaccagacactcaatctgccagcaccttgatctcggacttcccagttcgagaaattctggaagaaatttatttttccagaaaggggaaaaataaatttctgttgtttataagctatccagtttatggtattttgttacagcaattcaaacagactaagacaggctgtatcaataataatttctgcatagtctgaaagctcaatgacagcaagaatcaagtaggccttattgatcagaactgtatcaccaccacttaacacagtgcccttagctaactatttttaatggatgttaaataaaggagtaattactgaattgatttattttaagtcttcattgttagttttaatttgaaagacatttaaaattcactatttggtcagaatatgcagcaatgaatgaagttcgaggaaattttatttatatgtagtggccataggggtgtgtcttcacataatgacatccgttgccaaaagtaatccaaaagaaaaaacacacccttgattggttatctggcattaaaaaataaagtaaggccaggcacggtggctcatgcctgtaatcccagcacaccgggaggctgaggcaggaggatcacttgaggccaggaggtccagaccagcctgggcaaatggcaaaacctcatctctatcaaaactacaaaaattagccaggcatggtggcacaagtctgaaatcctagctagtcgggagactaaggcatgagaatcacttaaacctgggaggcagaggttgcagcgggccaagatcgcactgctgcactccagcctgggcaacagagtgagacttcatctcaaaaaaataataatagtaacactaataacaatttaatagtgaagagtctatctttggttatcatgcatcaacacaaataattcattattttgctcaaatgccaagagaaattacagtcatctctgtacccaactgccaataaagtttctaatatctatgaaattatgatacacaaaatatctgtatgagttaatattgctaatacttgtggtggttacaagacagggagatgttattgacttgctgtagttttatcattcatgtagacatgatcttcaaagggtgagaaaatacaaacgtctgtaattttcttttcctaacttgttaataacaatcatacttgtttaattccttctagtttgtaaaattattccatgcattaacttatcaaaataaccaaaagtcattgacagctgatccagaaaataatgtagatggctggagtagcattcaggaaattcaagcctttagcttcctcatctgtaaactagataattgcaatatatgatgtttgagggcctgtgggttctaacctttcattacttttaacaatgtttgtaagttgagttagggaactaatcaaaaagaaaaagtttcagaatgtttcgaagtcatgtcagccttcaagttaaaatcacaggcacctactccagagtaactttttttttaaagaatgcaacactttgggggtgtttacattcttttatggttcaacaagccttcaagttcactgttttatagagcaaatcaatccagcctggtttgctttgtaaataaagttttattggaacacagccacacccactcattcacatattgtctatggctagttttgcacaaaaataatagagttaaatagttgcaacagagactttacagcccagcgaagcctaggatatttactacctggttcactgcaaaaaaagtttgccaacccttgctttaaaacaataacttatttgtatgtatcgttaaaatgttagttcttccacaaaaaaaaaaaaaactttaagagaagtgaagttatttcaccttttctgatcaatccttggcaatctgtaaattttgtaaatttatatcagtagcacaagttaaattatttttttaaattaatttaaatttaattatgtttctgtgaaatctaatatacaattttttacactcttctaacatttgcaatgtttgaaaaacacacttgcaaataaaactgcccaaaatgtctgtcctttgtgagtttagtattctggtgaatcctgttcgatagtatttttattgatcagtagagggcgtgcttgactcaatataattgtaggtacagcgtgtgcacaatttagcctgggaacaacaggtcgacagctgcatgaagaaagttaagggagaaattactctatttttgtgatgttagtgaaaaggattagaatagcacaagaaaactggtctattaccatttaactgaaggtagtgttttcctcctgagaagaaaattactcatctactctttagcattggtttacaggaatcttgaatattttcaacaagagaaagcaacaatttggctacagaaaacaggatttttttgtgccaagatgatacagcacatcttgtgacagtggctactctctccaccctgcatctctttgcattgttgcctgtgtactgatgccattagcattgacagagccattgtccattgtaagaaaatataaaagaagatcattagaagttcagatttctgtagtggctctctgggtttttttatcaacacagaggctgtctgaaaagtgaaacatttccaaggagaatgtgctgccgaactaaagaatgctaggcccctaaaaagagactgaaaaaaaacccacctaccagcaggctagacaaagggtgcaggttggggcctcttctttgaaagacctgattaatgtgaggtcttgttacctgctttatcactgttttgttatgagtgaaaggtttcagcattcttaatttgtcttgcggatgggaaaaggaaaggcaaacttgcctgatgggggtctgagggtgaggtagatccatttgccctcagtgaaaaataacagacacaaaagacacaggtgattctacagattcatcctaaatgtctttttctgaaaaagcagccaaaagcactcatcgtttagccacttatcttgaagaataaggtataggctccagcaggtgcagaaaataagttattcattatgctaaagcaaaaatagattcaaagaactaaataggaaaaaaaaaatcagttttaggaattaaagaacaggcatagaaagattaaaataaggtaatcattgtaattcccgttacttaataggttattctaaagcacattttggcttcaggtctctagaaataatcatcttctcatgatatgtgcaatagttaaaaattaattacaaacagttttcataccatctatgaaattagaacatataaatcatgctttggagttttttaaacgagaagcagaatatgggctttttaccatattttacctctggttccctgaaatttaagtcttatgaaaatattaggagatacataatatagttaatagcaaatatccaatatgtattttcagtgagtgaagagagaaggataagatgcttatgctggatacgtgtttcatgaacattgtcccatgaggatgaaaacgtaacagatcatggtacttggattactgtattgccagtcacagacagcaagtgaaacatatcattgggttgtaatgtggaaaataccccacaataagtaagcaaatgagacatagtattaaaaatacatggcgtctgacccacataattagctattccacagatagtagctagtagtcattatcatagtgtaagtacaatttggtttgattgaatttattttgtcacctttttatcagcattttgatctcatttctaatataaattatcctagccttttgctaatcattatggctagactttggcatacataagagagaaagtgattgcaaatacctatacatacctttatgtatctatatttgtatggatacataaaactttttgccgtaacagattagtttttagaggaacgcattagctcagtggttaaataatagtttttgtttcttttgcaatatttaatgccttgaataacaaagttatacgattagattgtgtatacactaggttgtgagctcattacaagatgcatgtctttctgatttttatattccccaagcccagtaaagcctctgacatgaaagtctgctttcaaaaaatgcttaccaaacgagtgaaccttgatcagacacaaccgaacttttaaattatttccctgattcaaccagttattttttataaagaagatataaattcccatttttccaaagcatctaacagcttctcctaggtctcatatcgcctaatcagcactctatataatctctctgagtccaccgtggaaagcattagttcagtcaagggaaacttttcaatttaaagcatgcaacaagaattattgtctcatgaggaagagggttccataagatcaaaaagagaggtagaaataaataaatatatacatacatacttgttctaatgagactatctacaggtcatgcctgattgccttgagcagtgcagtggaagcatcttgatgtgggtgtgagagaggtgtgggcttatatcctcactctgcatgaacttgagcaggaaacctaacctctttgagactcaatttccatgtctggaaaacaatgataataatatctcactatatttcctgaggctccttgcagattcgatgggccttccttcttccatctgtatggaagctaggcatcatttggaagcatttgtcactgttccaaaccactaaggcttaaaaagagagaaatcactacatattgcatgttgagctcagcaaacttgcaaacaaattcctgctttgagggcagtagctgagtcctttcggattttctcagaagtcccaggactatccccagagaaggcacattctccctcagttttgttttaatttattgagttagtaagcaagccctcatgtgtggcagtcaccgttccaagcactttgctaacaatcactgatttgatcctctgaggttaatgccaccccatgaaatagggctctgtggtcttgttctacctagtaatcccttcttcatccttagataattcagccttcattcctaaaataaatgtggagcgatggcagtagttgttaactacgggaacaagctttaagtgtactacagaaaatgtaatggagaatattccaaaaataataacttggaattttatcttaggagaaaagaaatttcttccacctcaccacagccctgcgattgtcaggagaaatttcctgttagcaaggccagatccaggagaagagtccagatgtctctctgctagcctaaacaccatttggcatctctttcctttttactgaagctttgaagaaaataggaatagaaccagatctagtaaattacctggggactgaaacatctttgatatacgtcttgagaacatcgcaacatatttcttttcctccttcagagcattagctttgccgcttctcggaaccctaaatgacagaaacaatgacagacggattggacagcgagtctcgcttccctggtgccaaatacagaccaaaatagcctaagcgcccctttccaaagtcttgagactgaaaaaatatatatatgatatgcatatgtatccatatttatttattaactacttggttacactacagctgctttattagaatattttaatatcagattaatacagtggttatgatagcaggcttgattaagaaggttaccttgattacgatccaaactcaaccacttactagctgtgtaaatctggaaaagttgtgtaaatctctttgcctcagtttcccgatataaaataattataatagaacctacctcaaaagggtgttgtaaagattaaatgttaatgcatctaaagtacctaatacgtacctaactcatagtaagtactcaatacatgatagtgagaggtgacagcgtgctggcagtcctcagagccctcacttgctcttggcacctcctctgcctgggctcccactttggcagcatttgaggagcccttcagccccccactgcactgtgggagcccctttctgggctggccaaagccggagcccactccctcagcttgcagggaggtgtggagggaggcacgagcgggaaccggggctgcgtgcggcgcttgcgggccagctggagttccgggtgggcgtgggcttggtgggccccgcactcggagcagccagccagccctgctggccccaggcaatgggggacttagcacccgggccagtagctgcggagggtgtactgtgtcccccagcagtgccagcccaccggcgctgcgctcgatttctcgccgggccttagctgccttcccgcggggcagggctcgggacctgcagcccgccatgcctgagcctcccacccactccatgggctcctgtgcggcccgagcctccccgacgagcaccaccccctgctccacggcgcccagtcccatcgaccaaccaagggctgaggaatgccagcgcagggtgcaggactggcaggcagctccacctgcagccccggtgtgggatccactaggtgaagccagctgggctcctgagtctggtggggacgtagagagtctttatatctagctcagggattgtaaacacaccaatcagcacctgtgtttagctcaaggtttgtgagtgcaccaatcgactctgtatctagctgctctggtgaggacgtggagaacctttatgtctagctcaacgattgtaaatacaccaatcggcactctgtatctagctcaaggtttgtaaacacaccagtcagcaccctgtgtttagctcaaggtttgtaaatgcaccaatcgacaatctgtatctagctgctctggtggggccttggaaaacctgtgtgtcaaaactctgtatctaactaatctgatggggaagtggagaacctttgtatctagctcagggattataaacgcaccaatcagcaccctgacaaaacaggccactcggctctaccaatcagcaggatgtgggtggggccagataagagaataaaagcaggctgccggagctagcatcggcaactggttcaggtggtcttccacactgtggaagctttgttcgttcactctttacaataaatcttgctactgctcactctttgggtccacgctgcttttatgagctgtaacactcaccgcgaagatctgcagcttcactcctgaggccagcgagatcaggagcccagcaggaagaacaaacaactccagacgcgctgccttaagagctgtaacactcaccgcgaaggtctgcagcttcactactgagccagcgagaccacgaacccaccagaaggaaaaaactccaaacacatctgaacctcagaagggacagactccagacgcgccaccttaagggctgtaacactcaccgccagggtccgcggcttcattcttgaagtcagtgagaccaagaacccaccaattcaggacacaatagcaacctgtgtaactcttctctcgggccattcactatagttgagctaaatttctctttgtcaagcaggaaatgcactgttttcctaaactgttttttgaagcccactcgtccctgaagtccagcaaaaaggaattctcttcttcatttaattttcggaaacactatatttgccttggaaactcaaaatgcactgaaatatattaaggactttgatatatttgtaatttaaaaatctgtttcattttgtttaacatgatgaatcccaaatatacaagatctcttgacccttgagtttaacagtcacttactcatttttattatttcatctgtgtacgtttcgttttaaggtcttcattttcttgaaatgagatcatttcatctttcttttttttttttttgagacaaaatctcactctgtcgctgaggctggagtgcagtggcacaatctcggctcactgcaacctctgcctcctggattcaaatgattctcctgcctcagcctccccagtagctgggactacaggtgcctaccaccatgcccatctaatttttgtatttttattagagacagggtttcaccatattggccaggttggccttgaactcctgaccttgtgagctacccaccttggctccacaaagtgctgggattacaggtgtgagccaccgtgcccagccaagaccatttcatttttctttaacatacatgggacagcaaactatggaaagcacgtaggtatcctgagatgaagagatcattctggactatccgagtgggcccctaaagccaatcacaactgtccttataagagaaaggtagggggagatttgagacacagaagaggagaagacaccgtacaggagaaggcaatgtggtcacagaggcagaaatgggagggatgtggccacaaggcaaggaatactggcagccaccagaagccagaaggggcaaagaatgaattctcccctaaagcaggggtccccagcctgttacgtctgcagcctgttacgaactgggctacacaacaggaaatgagagatgggtaagcaagcaaagcttcatctgtatttacagccacttcccattgcttgcattaccccctaagctctgtgccctgtcagatcagcagcagcattcttcatagcttctcacaggagcacaaatcctattgcaaactgagcatgcgagggacctaggctgcaagctctttatgagaatctaatgccttatgatctgtcactgcctcccatcacccccagatgggaccatctggttgtaggaaaacaagttcagagctcccactgattctactttatgatgagttgcatagttacttcattacatattagaaggtaataatagaaataaaggacactataaatttaatgtgcttgagtcattccaaaaccatccccatcccctgtccacggaaaaattgtcttccatgaaacaggtccctggtgccaagaagtttggggaccgccgccctagagtctccagaataaacatagccctgctgactggatttctgatttctagcttccagaactataagagaataactttctgttgtttgaagccaccaagtttgtggacatttgttattggcagccctaggaaattaatacacccagtttcaccgctgacaaaatggttttaataaaggcgcaccttgccctgccattgccctaacagtgttctgaacatcacatgtgaaaacgtaggtgaaaaatcttccacagcttaaagtactcacacagttgtagcactatcttattatcgcgatatcgaattcatgaaccctcctccaactgaaacaagaattccaaattttggttgcttggcaatttctcggctttcccttattcctttgtttcgcttggtttggcttggtttgattttatgaaaactagatccacgatcctcacttcctcccagtcaatgcccggtatggcaaacactgaatttcctaggaaaacctcagccatacctgtcatccacttccttcctatagaggataaatccacagaattgatctgaacaggaattgttcttctgtcaaaacaaatcaaagcttaaatcgatatatatatatttagatcaaaacaaacccattgaaataacaggaaaacattaggataaattaagagaattaatccagattgcaaggaaacaccttgcgttattaagtcacttgctctgagacatttaatattatatttccattttaaaagatgtactggacacattttaatggcatctgcctcttcggtttccaaaaataaatatacttgctttcctcaaactttttcttgaaaaccgcaagagctcaaaccacaagaacaagggcttttaagagtaaccaaatgctattagaggcactgtcttccatacagggagacacatgagagtccttctttgttaagactggcttccttaactcactggagaaaagaagctggaagacggcacatctgtcaagaagcatattgaaagggccaactcggatactctcactttctctttgaaactgtgtccttttcctattcatttcagcaattgactttacctactccccgtagtgatcaaatttctcttttcttttaaagaatcttcatttgatagaatctagacttgacaatatgcagctccaagtagcaaacaatgagagtttccaaggcgtctctgactatgggattcaaattgaaatttatttctagaaaaggattcttcatctctcaaaacatcctaaatgttattggaaattcaatacatgtgtagggaactttgcaaaaaccaaggggtgttttcattccaactcatcttttctgccacactttcacttcacagtcctcactaccatctggtggctctgccagcgtttttctccaaattgtttcaattctttaagtgggtatgttgggagatcaggattgtttttcaattttattt

SEQ ID NO: 7 - DNA, 176545 bp, Homo sapiens
ccaacagattcatatgctttgtaacctctgtctatcactcataacttcaggagaaagtctgataggttccactgagaccatattcccacctatgtctaagactggaaggtgggcttactggcaggcactaccagtaatgctcattgtatctccttcggcttggctccttagttgacatatatcttgtgctcaaagaattaatgttgaatttaaatattctaaatggccagtttttaatgaaggcacatgctggtaagcagtacagctattcttataatcctagacttttgttctttcctatttattttcacatttttctatgctcccgtttttgtcagaaatctgttggaacagttattatctctatttcttccatggtgtctaaaactagagagctatttttccctctgcaatgtctttttttttcctctctttgccatgcttcagtgtaacttgtcagtccttcatgttatgtactagaggaattgctgtctcaccagaaaaagtcgctgaaagaaactgcttctgagcttgaacacaaatcaattcctttcatctcattcttgctaagttgaatattgatctgtgtcaaagcaatatgcatgactttttcattaatatttaattgttattttatatgacttcaagcaaagagacatctccatggttcattgattcatccattcttttggccaaatgccaaatagcctgtctccaagaaaatgtatctgcccttttcaaatgagactctttgaagaccaattcaattcaatcaaataattaggctatcacatcatgttattatcctactaaaaagtatagttgagaacagtacatattctaaagtagcagtgatagaaaaccttatgttacatgtaaaaattacacatgaatgaatttttggcgaatacaaaacggaaaaatggaacagaatataaatataacaaatctgcatataaaattcagaattaatgcgctagttacacccagattaaaatgaattactttatgtacaatttcattgtaaaaggaaccaacgctccatggttgattgggagactggaacagagattgtacaaggtacacttgtgcaatgagcctggaacttcttgtggtaccaaaaaaaaaaaaaaaaaaagaagtgctaaaatttttaaatagaaataaaaaggataagagcacatcaaagtgacacagttgccaaatcttcccacggtcagagctggaccaatcaaacaataaaagaaataacacattatggattataagtgtcacactggattgaagtatccataagcccttaataataaaaaatagctaaaaagaaagaggcaactcttctttatggaataattccaattaataactatagaagaaatgtgggaaatagaaaaccaactttaaaacaccacagtaataatttctgctggcaagattcaatgctgtatgctacagtgggtagcaaaatttcaagaacaggatagtggcctagattcaaatatcgcccttttttttttaattcttgttgtgattttaatatacactcatgaagtttttggtaattctctctttaggggggtggaacttaatttgtctctccttgagtgtggaattacttttcttaatgactcactttcaacaaagagagtatagaaagggaacaacagtaacttcacagtagagaaactggcagacatcactgtaataaagtgattttaaggttagcatcaccaacaataagtcatgttgatatcatgctactcttgaaattataaggacacatcacctttgtagcattctcccaaaatatagaaactcaactaattatgagaaaacatcagacaagccccaaatgaaggacattctacaaaatttctgaccagtactcttcaaaaagatcaagattataaaaaaacacataaagactgagaaagattgggagagacaaaatagacgtgacaactaaatgcagagtggtgtcccagattggatccttaaacaaaaaagagacattgatgtaaaaatttatgaaatccacacaaagtctatagtttagccaatagtatcatattatttagttttgaaaattataccatgattacgtaacatgctaacattagagaaaactgagtgaagggcatataggaataatcagtactatctttggaactttcctgtaagtcacaaaacaaagagttccaacaattaaggtgaggtcaagacaagaacatttgtcataagtagtctcacaccagagaaaaaggacaaaactttagaaaggactaaagagaaccagaaaggtcaaatatgagagtaaatataaaataatcttaagtgcttagaccagcagtataaatgtcttggaggttgataagatatattgaagtaccatatatgaaaatagctcaaaggtaggggtacaggtaaaagaaattactgtttgaagtttcttgtatggaaagttgtaaaatcattaaggcaaattataaaaagaaaaaatgcatattgtaatctctaggcgaccaataaatgaatttttaaaacatagtgataaaatgctgataaaagaggtaagtcgtttttttctttatcttaatgaacccaaaagaaggaatggaaaagtaacaataggaccaaagaaaagattgtaaaattggaaacaaaaagaaaggtggcagaactaagctcaaatgcatctgtaattggaataaatgtaaatgaattacacacctcaattaaaaggtgtgtaaattttcaaaagagttctgaaaaaggcccaatctatgctgtttacactttagatataaggacacaggaagtccttacgtcggaagaaaaagtatgggaaaaggaatacctaacgtattcctttaggtaacgtgaaaacgttacctaaacatggtgtggctacattaatatcagacaaaataggtttaaagaggaaaaatattattagagaaagtgaatttcataatgattaaggtccaattcatcataaagaaataataatcctgaatctgtaagtatttaataacatgggcttcaaaatagaaattgatggacctaagaggagtaatttaaaaattcttaacctgagtttggagtttgaacacatctctgtcagtaactaacagaacaacaaaataaaacattagtgaagctatgaaatatttaaacattttttgctaaccctttctcattcatatttatagagcactacccctttaatgggacatagaacatttacaaaagaaaaggaacagaaggaagaggagggaaaaacactggaagaaagataagaagaaaaagagaaaggagagaagaaagagaaaagggggaaagcaagcagagaattaagtcagaggagtattaaaaacattaactttatcactgataaaattagtctacagaacataccttgaactgtggctagaaataagcttccaaataatttatccccacaagtaaatttaccctgtggtcacaatcagaatacatgggcaatggtatattgtcaccttagagagacagagatgcctcagtgttgtaggaaggagtgaggaacacagtgtgctccagacaaggtggtccacaataagggagaaagaatttgtgtcacgtgtatataaaccaaccacttttcctagtttcagatcgatgggtaaaaagaagcgtggacccttctctccaaagatacaaacaatagacatttgtatttaagagtcgcagggtgtggtgcactggctcatacctgtattcccagcactttgggaggccaaggtgggtgaaccacttgagcccaggagtttgagaccagcctgggcatcatagtgagaccccatcactacaaaaaattaaaaaataggtgggcatggtggtgtgtgcctatagtcccagccactcaggaggctgaggctggacctgaacccaggaggttgagactgcattgaaccagaaactcataaaactcatgaaaaacaaaagagtgattactactgatcacatgaaagaaagagtatctgatttcaagcattagagtttgatagttcctccgcagattccatcaaagaagtaatcactggaattaagagagaatccactaagggcttgcaaccctgcagtatgttggtttatgaagcgctcatattatggcaggatgcggtggctcatgcctgtaatcccagcactttgggaggcctaggtgggtggatcacctaaggttgggagtttgagaccagcctgaccaacatggagaaaccccgtctctactgaaaatacaaaattagccgggtatggtggcacatgcctgtaatcccagccactcgggaggctgaggcaggaaaatcacttgaacccaggaggcagggttgcagtgagttgagatcgtgccactgcactccagcctgggcaacaacagcgaaagtctgtttcaaaaaaaaaaagcgctcatattcaaactccgttcagccataaacaggaaaaaggattcagccagctcatgagctaagtgaacaagtcaagtgtgatctacaaattttctaaaacctcaacagcaaatttggggcccaataaaatctctcctgtccctaagagaagtgagcatttatatctactttttaaagcatataaaggagtcatattgaaaagcagacataaaaatgctttaacataaaataaaaagaaacttaaaataaaatgtcagcttgctctcctgtgagaagatgcaaaagacatgctaatagacaagaacagaaaagcatgtagaggaataaagcttgtttattatttttttaagtgaaaataacagttaaagtcgcaagatagcctaaagtatttttatggcaatttataaattcaattccccctacagctctatgaaactgttattactcctctcccagttttgcagatatgaaaactgagaaacaaaagatttaggtaacttgtccttaattgtacaaaagtgaattcgtagaactgggatttgaaccaagagattctggctccagaagcctcatactgaacaccagagcactgtttccatcagggaaatacaaacacaaatagacataattatggagttgaggttcatgaaagatttccaagaaactaaaatgtccaaagcaaaattaaaattcacagtagagttagtttaaaactgaaactccatacaattaaggaaccagtaacctttttcagcgtttactaagtgtcaagcattgttctatttgctttgattcattaatttatatgatcctcccaatagcaatagtagatattactattatccttattttatatagaggatcaccatgttatgcataaatacgatgtaaatattattgaatttctggaacgtgacagataagattttctcatttcatgatcatgaattggatttgcttaattttctcaaaatattgttttatatttcaattatatttctagctttttagcttattttcacattattttgccctattactccaaatcacagtctcaagaaaaacatatgtatagaatatatttataaatggaatattctttaaaatcaaactattctgacatttcttcaaaaatggaggggaggttcatggttgcaacatcaatttcacatcctgtaaaaattgagtaagttattgaattcaatctaagcaaggttgaaacaatcactcgtttttggtacaagaaacactgttttgtgatttttctaagaagagttaactactctttagcataataaataaatgtatgaataattggtggccaaatttcctgtgatttaggatccatttatcaggagaccaaggctacagtgagtatatttctaaaggtattttccatccaaatccctccaaataatttgctcaagtattttttttttttgaggggggaacggggggatttatttgattattctctaaaaacttacttttattttgagactgtgattattggaaaattccaacaaatatgcaatttgtacaaaagtaggtaattcattcccttaaatggaaagctataaaaaattacaaatatttattatgagataaccaactccagacaggggaacccaagaaaatattctgatgtttccaaggaaagccatgtttgaaaaccagaagctttagctcccttattcaaagacactatcctgaaaagtatatgtttaatcctacattgtttattttttcagtaaatgatctacatttttgtcaaaatacggttaagaaatgtgcatttattatatgtctgtctgtcaataaagattgtctatttcaaaacaaagccaaaattgaaaatgatgtgtagcttactctgtttcaggcatttgtctgaatagtttcctaatatttatcccttttatttagcaaaactcttttgaaaattaggagtatatctattgttacagacaatacaaaagcaagttaacttgcttaaaattcatatagataaatgacaaaacatagtgttctttgtacctatttgtgtattcattacttcctttactacttgattaaaatgtccacattgggtcctgtttagctgtctctctggcatgcagaggattagaatgaatctcaaccaaagcagatttctgatcataaaaaccatatgtagctttggccttaattaaattaattataaacaatttcattttccttttcaggacaagatagttatggagtaatcctcacaactgctatctcaataattgattaacatgaggaatttttttctaatccacattctattgtttgccacttaagagtgctgtgttcacatataaacatgaaatacctccttcactggccatagaaatgacattgtaaccacacctgaaggaagtattcttttttccatgtgaaatcctacctcaaatattaattaatgttgatgcattcttcacttttattttgccactaatttatactttagctttttgaaagtcttgaatagaaattttgttgttgttttgccttatgcattaggttttatttccactaaagttctattaacaggaggcaagccactgaatggctttagaagtagctttgtgaaagctaacttttcagctgagagaaatctccctggggatattacagagacacagaaactttaatagtattttgttttcctcagcacatccccagattttaacgtgtctgaatttaatgcattagaaacaagcatatgtggtcttaagctaaaatctcttcttgtatctagaaaatctatcacaaaaatactagctactgaatatatttatatataaagagaaaatactaaaacaatgaacaaaggacacaattacagtataatctgcaaagcagaggctcttgctccttgagggcaagtaatagctcatagatatttcccaacatctatcttccccccttagtttgcctttgcagatcagatgctatctgaccacacatggtctgttcaaaatgataaacagtattactcaatgtatcttctctgaaatgctaatgcgttgtcaaaatgctataatagcccctattacatctatttatgaaaatagaccattcaaggaaaagttaatttaaatcatcttgtactctaaaatgtcagtaacagtaatcatgaatggtcagcaacaacaatttatgctgtaaatgtttttagactttttctctaccaaaccagttcactacagcaatgcttatgtaaattatacattctctggaagtttctataatacagattgaaaaaaatgctatgttttaaaattttcttttcggtgctattagactttaagtaaatcctcaaaatggggtgtaatttgggagcagatataaatcagcacacataaataatatgcttaatttgctataccatttgatattaaaaacatcctacttagctggtgagggaataaaatgtattatttttaatttaacctcttttttgatgcagaaatgcacctaaagtttctgcttttgagcatatattaattgaattctaactacataatatatgtaagacacttttaaaacatagaaaatataacagtccatatttctctactcaagtcactcagtcttttgagggtgacagtataaccacatacaacataagacacatttgatgtactgtattatgagaaccatacaactttcatgcaagatagctgactgagcacatacaaggtcctgtcctccattttcaatttaaataatttagtgatatattcatacaatgggctactacattgcagttttaaaaagaaagataaaaactattgatagatgcaccagaaaggatgaagcttacaagcattatgttgagtggaagaagctactcaccaaaaaatgacacaaactatgatttcacatatacaaaattcatgaacagacaaaacttgtctatagtaataaaagtcagaatagaggttacctcattggtgggagtgaagaaaggtagttaatgacatggaagtagcagaacagaacataagagggtgatggagttatataagcttatgtatgtgtaaaaatgccctgaggtttaaattaatgacttgcgtatttacaaccagtatactttcttccctttactatatgtatatgtgttaagcttcaattaatgggttaagaaaagtaaagttttatgtaatacaataaagctgtgatggaagagtgtgttagcctaaatcaaactactttatatgtgaacaggtttctgcaagacataaagaggatacaattgagttcatgaataaattagagcagaggaagttgccatccagaatatgcacaaaataaatgtatgctatacctgaaacggaagctattcaagacagagttctaactgtaagttagttctaagttatgtttttctaatggaaaaatcagtcaaacttcagtccttcttcctgtatttttctccctgacagagccggggctctgtcctcaggggaaaaaaaaaaaaaaaatggagggatatagacaataaaagatccaatttcttatattttgactttcaaaagtgatgattcagaaataagaaaaggtctccaagaatgcttgacttatcacaagtaatgttctcttgcccagaatatatgaaagagaagtagagagtagaaaggaaaggaaagagaactgaaattggtattttaaaaagcgttgaaaaaatattcctttaacaatacaaaaatagttttcaatgaaatacctgaacattcagagtctaggatatttaaatatcaagcatgaaattattctatagatatagcctagaataagactgtccaatagacccttctataatgatggaacagccctacatctgtgctgtccagtagggtaccccttagccacattggctataaagcattttaaaactgattttataactaattttaattaagttaatgtaaatttaaatagttacctatgactaagggctattgttttggacagtgaaggaatagaaaataaatctgagatctagaatatagaatgagatcaaaatataaaatatatgaaagaaacaagaaacagaaaggatgtattgaatactttcagtatttatctaatgagagttacataaagtgaaagtgagaaaatgtataagagaaaataaagcataaaatgaaccagaaaagaaaagagagacactggttatcaatcagtgatagcccttaaatagaagttcttaaccaaaaaaaaggcggggctcatactttcatatgtttcttaaaatttattttgaaatttaaaatttacagctttattgtattgtataaaactttacttttcttaaccccttaattgaagcttaacacatatacatatagtaaagggaagaaagtatactggttgtaaatacacaagtcattaatttaaacctcagggcatttttacacatacgcaagcatgcctaaaatttccaagaaaaaaaatcaaattgactacaattgaatgaacataagaccactgccgtatttctcagctgtaacactttctcctagaacaacaagcagcaatggattcaaacaaatgacagaaaacaaacaagccaaaaaccaacaacaacaaaacaaaaagcattctgaattctatatacccagacatattataaatgaatcataggcataataaagaattttccaaacaagcaagaactcaaagttgacctcctatgaactccttttgaaataattacctcagaacatattctaacaggctttggaagggatatggaaaggaagaggctataaggctactcttcaatcatttcattaccatatctggaggacaattttgagaaagaaagaaggcagatgatctggtcacattgtattgtaaacgtgtaaacaagagactttatggtaaataaaccaatggtacttactaggagaaaaatcctaatctcagaaatcttttgactaaaatgtttctagttagtattgtttatggtaaagaaacctacagtctgtggatttataagaaatggctccctggaaaatatcacatatattttctaactccatggatataaaatgaaacaattaaaatacttgttacttaaaacagatgataaagagatttagggtttgttactaacttaaaaaagttattgcatacggatgtgaaattattccagcacaatttttgaaaagactatcacttgttccatttatttgcctctgcactttggcaaatgtcaattactgtatacgtgtgagtctgtttctggactctcatttcagttacactctatatgcctattcattggccaattccatactgagttactatctctagctttataaaaagtcttgaaataaggcagcatgtgaatgtcaagtttgtttttctaggcaaaacaattttggttattcttgttcatttgccattccacataaattttataatctcttgtgcatttctatgacaaatattgccatgacattgatttggattgtatttactgatttgatcaacttggaatttggacatatttggcatcttaacactactgagtctttcaatacatgaatataatatgcctctccatttatttcagcctttttgatttctttcttcactgttttgtagcctttaccatacacatcttttaaatattttattacatttatacctaagtagctcatctttttccaccatcaatggtggtattcccatttcttactgttcattgtcagtacctaaaaataccattaaatttttaaattgtgatcttgtatcttcagtaactttgttttgtacattctttgaaatcttcttcaaatacaatcatgttgaaagtgaataactacaattgcacatatttttttttctatttgtatgcctagttctttttcttattacactgcctagaacctccagtataatgttaaatgtgggtggtaagaacatttttcttttgccttagagtgagggttcagtcttttatcagtaagtatgatgtttgctgtaggttttctgtagctgtttcttatcatgttgggtaaattccattctacctaaaatttagagtttatcatgaatgaatattgaattttgtaaaattatttttctgtatctatagagaatataatttttttctatatctatagagaatataatgtatgtagggtctgcaacaatgtcctctttttaatttgtgatataataatttgtgtcttcttccttgttggtgagtctcatcataggctttcactgatttttctctgctgctccatttccaattttatttatgttctttattattactttgcagttacttactttggtttaatttacttttttcaagtttcttaaggaggaattttaaatcactgatttaagacttttttcatataaacatgaaatgctatacatttctctttaaattgtgctttatttgcatcccgcaaattttgcatgagagagagattattttcttttattcaattcaaattattttcagatgtcccctatgattttctctttgacctgtgagttattaggttggtaaaaaaaaaattgtggtttttgccatttaaagtgatatttagatgtgtgctcatcagtaaaaatattcggcaattattccagatacctgtttgtgatttctattttaattccattatgatcaaagaatatactatgtacatgtttttaaatgtattgaggtttgaattatggccagaaccacgatatatagactatactatatgttctacatgcacttgaaaattatgtatattctgcttatatttagtgttcaataaaagtcgatttggttggtgaaggctttgataatactgttcacatctgcgaattcattattgatttctagtcaatcaattactatccaatcaattactttgggttctctgaagttattatatctatagtttgataaattattctttaaaattttgtaaccactatctcttcaaatatttcttctgcctcacattctctctctgttttctctaggatttcaatgacacatatatcacactaatgatattttcttacggcatttgagtgttttgtttccttttttcttcactcttttatcatttgacagtttaggtaattactattaactgactttcacatcctctatcactttgcttagctgtgtcaagtctactggtgagcccacccaaggcattcttcatatttcttatcgaggttctcatttctggcactttcctggggctctttcttgtcattttcatttctctgctgaaatctttatctatccatgcatgttgtacatctttgtttacaacctttaacctattaaccatagttattttcaattacctgtctgattgttgcaacatctggatcatctctaagtcttgttcagttcattactttgtctcttgacagtaagggttgtgtgttttgtttttaatttgatttttgtgtctgttaatttttttattaatttccagacatagtgttcagagtggtagagactgataaaagtagtatttatgtgttaggtaaatgtcatttgtcttctgctaggctattattgtgggaaggtgagtaaatttatctcaagagttgagcccaattttcagttttgttcaccactgtctttaaattcctgtttgttcttaggttggagatagtttgctggtgggttttcacgatgtttctgctccactcattagggcttccctgtgccactgcccctcacagggaaattctctagtcatctccagtgttaatctgttgcttctgtcttggaggttgaggcgttacggttgtggacgaggttctctgtcatcctgattcagcctcagtttaagcagtcattgtctccctgagtcttagaatatggattttctcagtgagcttcttccaactcaatggaaggagacctttactggtctgggctcttctgagcacatttcttgcttcgacctatggataaagtatttcctttttttttttttttttccttcccctacctacaatggagacatcttctccttgcactgggccaagagctttctgctattccccagcatcttaaaagtcttttttccttatgtgagaagaaaccaaagatgggttcctgtgtttcctacagcagtggatgcacctcttcttcaggctgcatctccaaagtagtctatattagtacctgccctgccaataaacttttttcatcagcacatagtgaagtctatggagaaaagcctgcaactggctgtcttcatagcttccatactctcacagtatcagagaagcagtctttgaaaattaattaaaagtcactgtgacttctttttattcacttgtatggtggccttctcttactcttatgctcttacacaggtgaatccatgcttgttctctatctgtccgcagaggcacctgtctttcctcagatgccaggctacttgttgtcctgcagcattagctctccaataggttccagaaaaattaggattttgaggaccatctatctttctcttgctagaaggcagatgggtactccttctagatgtctacattcttaggcagaagtcagaagacctgggatttgtgttgttattgtgggcaggtattaaagtcaatcactttaatttttccagtaagcttccagatatgtccacacaagaaaccatgcagatacgttcttcattgttcattcatttagggcccatttccccagatcatacagcaggacctttggttaaagtgcaagagtctgtaaatatccaaacactcgcctgtgaaagtctaacaagcctccctctgctaattccactgctattgcccttgtgcaaacccgaacttgctttcttcttcaaggctttacaaaacggccctgtggcccttattctgtattctcactctagaggatcctttcagtggactaagaagccaccttttccatgactgggagagaatggtaagacccagactacacagtatccttagtgggctctatttttggttctatagtcagcgaagcaactgctaatataaactgtaggctcccctgaagttaccctcttagcatctttctaatatactgtctctaccttgtgaacaagctttgctatgctgcactcctcctatctgaatgtctctctgatatcacccatggcgcaatcagtatttctgtcctcagaattttctgatgcccttcagtagtgggagtggtttgaaccaaccctcagtaacaatctcacttttctctcctgagttgtatatgctaaacaactcagcagttttagccaaacttcaagagaactcactgaatagccctattcaatttctgcaaattcctgcaatctgcatatgtactggttacaacaacttcaaatattatctgagtagatggatcgtaagtgtccagtgaaaatatctgtgccaacacccttggtatatctttaacacttgtttctgcaaaagccccactcaaattcagatttatttttagtgacattacggttcaggccaacaggattaatagataaatatgattcaaccaaaaccccaaaagccctgccagtctctaagtttcctgcctatttccagtatatgagagaaccagtaatttatttctcaaagtagaagaactatctctggtttctcctgtctatatacattcttcagaatttcatgggttggaataaataaattaaattttatttaatttaataaatcccgcttaaattttagcaggatttatcagccagcctctgtttttcatttaggtgcctctcttctttagctcaacctgatctttctctgaagaggcaattctcatactgtcagtgtagtaaactgactttctatcagtgatttttaactccaaatccttcatgagaatatggcaaaatgctagtaaattttaaaatccccatatcaatgcatgaaataaatactgattcactttctacaagaatgcaaattgttactggctgggttcccaaattggaatggctataatagtgctaaattaaattaaatttggcctgaagcaaccttcatacattgaatccctaagaatgaactgcaacctaagagtttatttttgtaagaaatagttgagtctcagccaatcacagccactaagctccaaacaaacacaggctgccaactgatcagaccatgtccatatagggccaatgcctcatcacaagacgcaaattaggcaaacactcaactgtaaccaataaagctgtttctgtatgttacttccttttcctgtctataaaaactgcttgccacatggctggacgaagttccctgaacctcccctggttctgagtgctgtccaatttgtgaatcattctctgctcaaataaagtctactaaatttaatttgtctataaagtttttcttaaagatagcataccatcccccgtgatctgtggtacttcctttatagcctttacaatatcagttacaatgaaggtaatcagaaataccaacctgttcaatccttcatactggtaacctccaggatccatctgtcttaagtactgaccagacaagaatttggaaaagagagttagagggaaccaaaacttctacttcaacaatttccttgatcagaacaacaatctctcattacttcaagagagtctgtatttattgtataccaccaaagatgtctccagtcacattttcccattagcaaatttacccctaccctgctttaaagtgccttacagagtatcatctgtataccccacagcgattactggacaactagtgtccatatctggtgaccctaagaagtttgcatatcacctctacatcacttcatccaaaaaagccattgcaataagcctaaggcttttttttgttttatactgtaagggatattttaattatatggacttttgaattttaattcctagaaattacctttattattattttctgtctagaacttctatatctggatatttgcacttctatggatatttctcagctgttcgatcgtatttgtttccttctaggaatgtgctggtatcccaccttacaaatgatgaattctttcttcagctatattcattctcatatgcaatctattatgcttcttattcagctgttaacttctttgcacctagtgtttctatttgattatttttcattacatcttattcttgtttcctattggtaatatccttcccttgttgcatattttctctatttcaaattctgactcttccattttaatacttatgatatgttgtccaatttacattttttaatttaaggaagatatatttctgaaatgttcaatttaaataagttatatcttagtattttggcatttaataatattattaatttggcttatccctgaagagatagatacgttggctgttaatatgaacaggggaggggcagaagaaggaatctaggtcaatccttagaggtcaaaggtttatgaagggatgggctttcaggtgaagaactcaagttaccacaaaccagaattaaccactccaatttggtttcaccgcaccaagtaacttttcaagtcaacactctacattcaaacaccaaggaaaaggaagactgcctaaattgtcatccatcagccctggaagtttggaggaaaatgaatgaaagagagaaagccaaggctgttgagtcctcatccattagttttcctcaattctccaccctgtcagggattttgcattcccttgattttatccctacagaaggatgggccattggaagtattggccttcaaaggtatgggcaaccattgccaaatcctgcaacaaaaaagaaggcaaaggggaagccaagacagtatttcaactgctcttttctaatttctactttaacagctgagccaaaagccctttgctgtcagctgcagccatctacctgccttgccacataccagttcaaagtagctgtcttttttcctaaggatttctcacatttttatgagtctgcatcgagttttccttctccccccgagtttccctcgggttgatttgctggagagcagcagcagcttgtgctaatttgcagtcttggcataaattggaaactctcctccaagcaggtttatgaacaggaaacagaagacaacatcgctgtaatagaatcaaagtagactactgaatagtcttctgagatatataagatccaaattctggaagaaacctcaaacatctaattgtacatttgactaccctgctggaatatttaactgttaattcctttaacaatatggtctcaagtgaatggactagatagacaattttaaagtgtagaataaactgaagaaaagttttacagtttaaagtttaaattattttaaattttgacttaaaacttgattagaaattatcttaattttaataaagaatgaaaaacaaatttgagaaatcttcaaactgctttccacagtggctgaactaatttacatagccaccaacagtggataagcattaacttttctcaacacccttaccagcatcttttttttctctttttaactttttaataacagacattctgactggtgtgagacagtatctcattgcagttttgatttgtatttctctgatgattagtgatgatgagtatgttttcacgtctgttggccacttgtgtgtcttcttttgagaagtgtgtgtccatgtcctttgcctattttttttaatggaattatttgtttcttgcttgctgaattgagttccttatagattctggatattagacctttgttatatgcagagtttgtacatatttttccccatgctgtaggttgtctgtttatcaatagtttgtttcttttgctgtgtagaagctctttagtttaatcaggtcttacttgtcaatttttggtttagttgcaattgcttctggggacttagccaaaaattctttgccaagaaagcctcagaaaggtatttcagaggctttcttctagaagtttaagagtttgaggtcttacatttaaatcttaaatccatcttgagttaatatctgtatagagtgagctaccatttgacccagtaatcccattgttgtgtatatccccaaatgaaaagaagttattataccaaaaggcacatgaactcatatgttcatctctgtgccaatcacaatagcaaagacatggaatcaacctagatgcccatcaatggtggactgaatttttaaaatgtagtatatatacagtatgaactacaacatagccatagaaaagaatgaaatcctgccctttgcagcaacacgaatggagctggaggtcataatcataagtgaattatcacagaaacagaaacctaaatatggcatgttttcaattataagtgggagctaaacatggagcacagaaggacagaaacatgggaacaacagacactgcagattactagagaggggagggagagagggggacatgggttgataaaattatttgggtattatgctcactacctgggtgcaatatacccatgtgacaaacctaaacatatacccccatatctaaaataaaagttgaattttataaaaataaaaataataaaatatgttaaaaaagaaaaaatagatatcagtactggtaaaccttaaactacagataaattgcaaagttctaggtaaagtgtcaaaatccctacttttagctgggacatctatttgagaaaacctgtatccagctctttaaatataatttgcattgcggttgcttgaattcacaaatttgaagcaatcatcatataatgctcctggcattggtggtgaaaataagtcaaagcatatttaagcctgtatttttgaagcatgttaactgtcctaatgcccatctcctaatgtcctcataacagcaatattttatttttacattttggtttctcttatattcccaaatatagagcccacattaaatgaaagctaactaaacaactatttgggagttcctagaacctactcttttccagccgtctctctaagtggactacccttgttcctcaaattccaccacattaggtcttttaaagttaatcatgagtgctctacattaaaatgcaaaatatcctagaaagaaagatatttttacctactggtatataagtgtgtattattttatcagatccttggtatggtattgaccatacgatggtcaatgaattagtattgaataccaggatttaaagcaggcttcaaaagacactgaggaacgtagatcaaagagagctggtgaaaagttttaggataccaggtgggacatggaaactagcagcacctttaggccatttgccaaagtggggaaaggagaaaatattttaaagcaggtgggagtatgctgatgtaactaccttcttcacgctttcatttagagccactgtgcccaagagactgaaaatacttgcgaaattattacacatatcccaaagtcagggctataaattgtgatgcaacaaaagacctgactttcccaggctgaccacccagcttgcttacacctccctgcacagcaacatacacaagttccaatttgaggccctgctttagaaatttctcacctgtccaaaagaaattcacctgaatcttcctctctactccacctaaaactgatgaatcttccttacttctggttgtagaaagaatgaatgaattcatttctcagaaaagaaagttaacactgagatgatgggggaaatgttggcagatattcatatatggacaacttttcctcatctctaaaatcatactatgcctaaagccaatgttcaggttacacctattataattattttgcaatatttagatagatacctaagtcagagacgtcaaagcaagggctttccttcgcaattataacccctctaatcctatcccaaattcccagctatcttcaaaacaaagccagtggatttctgtgcataattaacacccagactagaccattcttaactggctcctcacctgtaacacaaaattaacgtcaggaaatacaactacacctatcattagctgcattccatattccaaaagagaaaaagatattgctttgaatatatcttcctcttactttttcaaatatttccttatttgaattcctttgggtaaatgtcatttcctgttaggaccccaaattcgaattcctttttgagattcaaaataacaaccagttgttggtttcacaatagcactgcaaaagactgaaagttcttataaatccctgaaggaacaaaaaaccatgagagtttttatctacctaacattttgagttttgatcctttggttttagtttgatatgctaatattttatgcaactaattaataataactaattttaataaactcagaacatctgtagaaggtacaatttaggcaactactaaatcatgcacctctttcctggattcattccgtagttttaaaacaaattagtgtccattaaatacaacatatttccattttaaagaaattatttaaattccacgtaatactttatgcatgcatgaatatttgaacatgtaaaacaaaaacaaaaatgttagaacttgtagttagcactctgttcaatgttctagttcaatttctatttttttcgtctatcctataattgtttatcttgattctattattaaatgagtatgctgggtttataagatgaaattaattccaatctagcaatttctaaattcacaattttataagtcttagctatgtgaaaataaatagaaacagacctttttgctgattttataactaaagaaacctgaattgaataattaggacataaaaatatgtgatagtaaagttttctgagaaatggccaccaaaaacaagattcattttcaagtaaacaatgcaaaaattcactaagctgtttgccaagtagtttttctctttctacctttatacttgcactagctctgctaaaagaagcctaatatatctatgattgaggccatgcctttattggaaatagtgaaaataggataatacattcaatattggttcacttaaggtaagcctaaactacaggagataaagaatgccattagccaaatagaaactgtcttaaagatacaacatctaagaagatgatgacaacagcataatatgaaactccagttagttagcaacctgctttggtgataagacttgagctcataggggtatgcgtcccaataaaataattcaaaacgtggaagaaaaaacagagtgtgacatcagaaaattgctgaaattatttctatttgaatactttttttctgacccagagaggtacaatttatcatggaatgaatggaacaatatgtgacaataagaggaaccaatgagaataaattaggctagattgctgtgatacagtgttttgcttacttgaattgcctacaagtttctttgctaaattcaagttgtttcctatactgcttaacgtgccaaatttgttttgattcaaaatgcagtaatgaaaagaaaaaattacattggcattactttatacggcaaagttatttttagatattaatatattccacaaacaaatttattgtactcattctagttgaccttaaaattctgttattctgctattttcctaaagaatataaagatccagtatgaatgttagtgtaaaaaaatcttacaaagctctacctggctttgatgacccgtcattacacagtaagatccctgctgctactggcgctgaattctcaatcatgatagagctgctccacaatcatggaaagatttgttaatttttgcatccacaccccttcactctagtttgaccacacgctaggttgcctctttaatgccaggttccaccacgtgacttgaattagccaatgaaatgtaaacagaagttacacgagcctcttccatgcaccaggtgcaaatcttgtctcattttcttctatctctttcctcccccgcactgccacatgtgaagctgctgattgcctgggttctggactgaagatcttatggagatgagcaccagctggtctcacgcatgtagtctgagcaagaaaccattgtttatctttttttaaattttctgttactgcagcataattaagccttagatcattaataaaatgtgtatttagaagactggaagaaatatattttatcaaatatatttatatcaaattgtaaacagtaacatatgctggatgatatggggtcaaggtaatcttttcattttttgtttttctgcacttaaggaaaaatatctatttaaatattggaatcaaaataatgctttctatgttctcacttatttgtaggagctaaaaattaaaacaattgaacccatgaagatagagagtaagtagaaggatggttaccagagactgggaagtgtagtgggggttgggggagaaagtggggatggtaaacaagtacaaaaataactagaaagaattattaaggactagtatttgatagcacaacaaggtgactatagtcaataataatttaattgtacattttaaaataactaaaagaatataattgtattggttgtaacaaaagataaatgcttgaggggatagacactgcatttatcctgatgtgattattctgcattacatgctggtatcaaagtatctcacgtaccccataaatatataaaacaatgtacccactaaaattaaaaattaaaaaaatactttataaatactataaaatcaaatgctttgaatatattcatatgctgttctaattccatccattgcaggcagttaaaaatttactgtgataaataatgtatcctaatctccctaaatgggcagatagaattacatactttttaccctttaaccctggaagaatagacgtgtctattggcaatttagaggacaaagaaagaagtgtgcagaaaccctgaagcccttactgtccaattctttatggcaccaagagatgttctcacagtctgcatcaagatggctggtggctggtaataagttttatgctagtaagtacttccgtgaaattagttatttgctggatccaaaacttcattagcttatgttaagggagaattatcttcaaagcaccctctcaactagcagggtatgccccatagacgtttgggccagaaagctcatggctgagtctatccaccccattcccttcccctacatttgcatttctgttccttaaactgcttcctgcttccattcatggaagtaagaccctcctcttccctctaaagatcacaccagcagaaacacctctcccctaagtggctttagttttccactcctaaacttattttatgttgtattgtatttgttcgtcttcattagtaaaagttagaaacttagaaacaagaaagcaaaaagtatttagtgattttataagaatatatgccatgtctcaaggagtgatataaacttaaatattttaaatgtttacattctgctaatttctctctttattggagcaaaataatcgtaacgctattctttaagaatacccataaattcacctcaagaaaaacggaagatttaagcaaagatttaaataatgttgtttactaaaatattatttgtaaaagttaacgataaagagaaaaattaacaaacattgattacactgttatttccaaagaagtaaatatgttgcagtaattaaaacttgtgatttttcaaagacgttttgagaaaataagaaatgcttatgatataatgttaaatggaaaataatttaaaagtatgaatatataacataaatattcccattttaattatttcaattactttaaagaaaaaatggaaagaagcaacaagcatctcaggatcacataattaggaattacatgatagtattgttgccccaaaatacataggttttgtgttttttttgtgtgctttcaaatttttcaacaaaataaggcttcactttcacaactgtaggaaaacaaattaaaggaatctctacatgtacataaattccagttttcagtaatccaaacgctattcaaccaacttcttagttgaattaataatacagcaacaatacagtatccattttaaaatccccatagtaaaaaaaaaaacaaaactatttctctaacattttgaggaataaagttggctactatgctctgctatgtagctgagaagacaaacaaacaaacaaaatcctaaagctctttcctggcagcactgcaaaatccgaacattaatgaggggaaagtggcatatatatgtttattcatagtgctcagattgtgtcctagagattaaagcacttgcccagagcaaaactggaagttattcaccaatagggaaacaactgtggcctcctgagtgctaactgaacctttttctttgtaaaggaaatcacattttaagtgtgtacatcatttcacttcttgcccaacatttagccataaggaatgcttaaaatgtgagactggactttacctttaaatctcattaactttagtaagggacaattttttaaagcttttctttgaatttaaaattaaacttaacagccaggtgcatacattattgtaagtgacaagttgttattaaaaacatgtgtattaggctcttaaatgacctgaacttactgtggtcataccaactttgacagaacattatccaaacctttcatgaagtatttgggatagcagcccttatacctgttgatgttataaattctaacaagctagatttaaaacagagtaaataaaagaataaagagtatatttacagaaacttcaattaataatagcttctttcaatagaactattcgtcctcagaaggcacaatcttgaattactaaacattttttattcttttttaaattttggtaaatttaatcacttcattttctaattttgttttctgttgcttctatttttatgtattcctgttttctgtatgcccaacagcaaaaattgacagcctgagccgtgaacttaggcccgcacagaatttcctataggatgcaagcatcaacatttataactgaataagtcgattatacttacatgtcatgtaacttatatgtaaaataaaaataataaaatatgttgcaaaagaaacaaaaatagatgtaaatactggtaaactttaaactacagataaattgcaaagttctttgtaaagtatctaaatccctacttctagctgggacatctatttgagaaaacctgtctccagctcctcaaatataatttgcattgtggctgcctgaattcacagctttgaagcaatcatcatataatgctcctgtcactggcagtgaaaataaagtgtatttaagcctatatttttgaagcatgtgaactgtcctaatgccaatctcctaatatcctcatgccaggaatattttatttttatgttttggtttcacttatagagcccacactaaatgaaagctaactaaacaactatttgggagttcctagaacctactctttcccaactgtctctctaactggactaccctggttcctcaaattgtaccatattaggtctttttaagttaatcattgctctgcattaaaacatcactgaattttattgtttttctactgttcataatatgcttttattatttttatctataattctgtctctgataatttcccctaattcattctgcgttgctttttcctcttcctgaaacagtctttcctcagatgtccacattactcattccccacgagtcaagtgttgactcaaatattcttccttcagtgtggccttcttgcaccatcctatttaaaattgcagctatcatcttcccctttattttgagccacagcactcaccatcatctaacatacttcctcgtttcctatttattttgaactttattcatctctgcctactctaattaaacttccctgggagcacggtgtttaggctatttttttttatactgtgacatacccatcatattgaagagggctctttttttttttttatactttaagttttagggtacatgtgcacattgtgcaggttagttacatatgtatacatgtgccatgctggtgcgctgcacccactaactcatcatctagcattaggtatatctcccaatgctatccctccctcctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttctaagtctttgctattgtgaataatgccgcaataaacatacgtgtgcatgtgtctttatagcagcatgatttatagtcatttgggtatatacccagtaatgggatggctgggtcaaatggtatttctagctctagatccctgaggaatcgccacactgacttccacaatggttgaactagtttacagtcccaccaacagtgtaaaagtgttcctctttctccacatcctctccagcacctgttgtttcctgactttttaatgattgccattctaactggtgtgagatggtatctcatagtggtttagatttgcatttctctgatggctagtgatgatgagcattttttcatgtgttttttggctgcataaatatcttcttttgacaagtgtctgttcatgtccttcgcccactttttgatggggttgtttgtttttttcttgtaaatttgtttgagttcattgtagattctggatattagccctttgtcagatggggaggttgcgaaaattttctcccattttgtaggttgcctgttcactctgacggtagtttcttttgctgtgcagaagctctttagtttaattagatcccatttgtcaattttgtcttttgttgccattgtttttggtgttttggacatgaagtccttgcccatgcctatgtcctgaatggtaatgcctaggctcaacacagtgtaagtgttttataaataatggcctaaataaatgaatgaattctccattttgtttatttgtgtcttctcccttgttattttcctcaactagtcagtccatgaatgtgttcattttattactctttcaataaaccaccacttaggatttgttattcactttttaaaattatttttatctaatttgttgatttcttttcttcacctctgtctgtttggtagggagggagatttgttcctccatttttccatgcaaatctaagtacatagattttccttttcccaacctttgtgttttcattcccatgctatcataagtatacagctttgtctcttaagaacctgtggcaataaatactcttagcctcattcttgactgtaattcagctggccattcatcgcataaaaaaaaatagaagtataaatcatgtaacagtttttttaatgccctagaaaactgtgatctgtgttttgattcattttattcattatttcttttttctttttctggtgaatgactattcaaatagtgatacccagtgagttaacagctgtaatcagacttgcatttactgctgcttttaaaaaattgatttaacggggttgaactcattttaccacatttgattatttaactgtagcttttcagtctataggtataaaaggtcaaatgctaaatttgagtacttaaagtgaggagtaattgaggttgttatatcaagaaaagatttaatggttggtgatgacacagtatttacatgactaatgttgatttttttactttaagttttattcactaatactctattgccacaggagagttctagggctgaatattattcagatgaagtgaaaacattgaacctaatcaattttaaacagttcatttgaatatctattataaaccgtgtgcattcactgccatagttgtaattaacttagctttatgctcagttttaagcttttttatttaatcaaaatatacccattttctgtttgcatgatgaagaatacaaaatctgtctgttgacagtggaattttgatattaaactgttattttaaaacttttaagtatagagtaaaaaaaaaaaatatgtcttacagaaaggcagccaataaagctgatttcagcataaacatgaaaaggcttatgtgttatttatgttagggatattcattactggatgctggtaaaaatctatagagttcattttcttaatgtgacactttatattaactgaatccttttcttaaagaaggtaggatttcagccaggtatagaaagaggattttaggttcaaataggagctttttgggtcatgattacagcattaaactgtctgtatttcctctgattttgaaccaaagaaaattatttaccttatgtaatgatatggttgggcatatgaagtataaaagtgaattagtacagaaaattaaaactaatgtgagcctgttatgaactaaacatttgtcctccacccttcaaattcatatgttgaaatcctaacctccaaggtgatggtagtgagagaaggagacgttggaggttattaagtcataggagtaaagtcctcatgaatagaattagtgccttgataaaagtaacccagagagctctgtcgctccctttctaccatgtgagaatacaagaatgtagaagtctgcaatgggaagggagctctcaccagaatccaaccatgctggcaccctgatctcagacgtccagcctccaaaactgccagaagtaattttttgtggtttgtaagccacccactctacggtactttgttataacagaccaaactgattaagacagagtccttgaattttgcaaattcatttcgtattcagatcatataatttcattgctagaaatgaatatagaatatactcaactaatccctcaattttaaagatataaaagaagaccaccaaatgaccagggcgaaattgcacagagaggagctagttttccagagatgaagggcatgaagtttcctgtctagactccatcatttaacattgaactaccctgaggaagccatttttctaagtttttacattagtgaaagaaaaacgtaggtaagataaagtgattatgaagataaaatgagtggcagacaccctgtaagtatttaaatgtaatgacattttatgtatgaaactcatttaatttttacaataatcctgggaagtaggtaatattaacttccctgttttaggttaacaaactaacgcatagagaagaaactagcccaaggtaatagagctggtaggaaagagagtcatgattcaaatcccagctgtctgatttcaaagcccaggctctttgccattatatactatgacctacaaattggagaagtgtcttagcaagagaaataccaagaagccaggtatgtgtattttaattgtgactcttggtctgtcctttggaccgcagccttttcaacttcaggcttataattttctcccctgcatttcattctttctactctcctagcaatgatgtctcatttagttattcttttaattttttaattgacaaattataattgtacatagtcatggggtacacagtgatgtttcagtacatataatgtagggtgatcaaatcagggtcattagcatatccatcatttcaaacattgatcattttcttgtgttgggaacattcaatattctccttccagctatttgcaactatgtaatatattattgttaactatagtcatcctacagtggtatagaacattgaaaattatttctccagctagctgtaatttcatatcctttaacaaatctctccctcccctctccccttcccatcctctagtattctctgttctactctttacttctatagatctctcaaatcctatcaacccaaacctgtgcctcagcattttccaccaccatcaccctttcaaaactacctccttttatgctgggaaaacggcaaaaaaaaatttcttgaacccatcaaggacccgaggtcacagctaatcaaataatctgaattccaaagacaaacaagacactacaaggaaatatgaatggttccttcaggaagcgtaaaatcgtgtcaagtaaacaaaggtatgttcaacctccactgaagagtgaagcactgcaacttaagcaaaaatatgtcatctgttacaaaaatatatagctgtcaggctacgaagctggaatgggttgggttcctatataataagcgaacctaagcccaactcaatgcaaacagtaagatggaatttatgcttaaccaatcagaagctgccaaactaatctcttactagggactttccacttttatcaatcaaatatattttcatttgcgttttataaaattttccattctaccctcctcagtggagggctaaagcatttgaggtttggtactgccaggctcgtgactagttgaatgctcaaataaaccccttaaaattccaatgtacataagtttatcttttaataaaatttgtacacataagattggtaacataagaaagctgaataacgacaagtattgacagagaagtatgagaggtagaaacctcaggtactgcttctgggcgtttaggcagaaatagctacaccagagatgagctggctgaacttaggaggataaagagtaaagtagaaatcatggttcccagaatatgcccaagaaatttcaacaggaccataaaaggacatgtgtaaatatcctcataaaattcttgtttactaagaagacaattgatagacgtctatcacagagagaattaagaagatacaatagctgtttactcaagttagatggaatgggtataatataaaacctcaaatttcagtaaatcttaaatgactaatgtgtgaaaaagtaagacagataataatatttaccaattcttgactttctctcttttatagtgctttaatttctgcttgaatctttacaaaaactgcttttttcttcatcctaataagtttttgtttggcggtttcaaggcatttgttcatgaactaatttccagagttaaatgtgttagcttatttatttttattcatttttgtttaattttgtttaataatgaaatttattcaatgacttataatttgcctctggttgttggttttgtcatagtttatatgttttaatacaaaatgttgtaatagaaatattgtgtaattgcaaattaatttcttttttgaccatgaaattattttgcaatatgtttcatacttccacagggtaatgaagaagtaatttttagtctgttgctattttccaggtcttttattgtagtcagacaacatatcaaattaaaaaaattcacttctttagatttattggcttgttgaatgtgtgattacttttaaaaatatatttcatgggcttttaaaagaggtgaattcttgtaagaaactgaaattggcaatataccattaagtcgaagaaatagtttaatattataattctcaatttctcattttcttttttgatccaatgaaaatcaaaggtattgcattaaagtttaatatccagttgcattcctattcctttcttcttatattctaataacttattatgagaaaataaagtatacttagtaatttattatgtttgtaatagtttatttcctcaatactatgatttttcatgagtaatattttgattaaaaattgactttttgttattataaaaaattgtttttgatctagtttattaatactggcctataactccttgtaacattctgctttttgtttggtgctcttattttcatatttctatttttaatttgttttatcaccttattttaggttatttacattaaccaaatcatcagtaatgaaatgcatctattttgcatttgaaaagaaaaataatttgcttaagtcaatatattaattaccctagaaccaaaaggagaagaaatagatacattgatttgaaactctcctgtctaaccaataaaacacagaaacttaaccaacaagcacatacaaaccctagattggatactgttttctgctgaatatcaataaataaagtgatagatggttgcatttcaaagctgattacatgaaacttataaagtctggatatctacaagtaacttttatctacaaattacccttcaaatcttattgtgcagatgtaaatctgatacctaaatttttatttctcatcatggatcagcacatacattctttgtttctctgttcaaagacaaagaatattttcagactctagctcctcattaaagttcccaaattactttatgacttagaatcctgcttttcacactatctgattaaccaaatcatatcttagaaactcatcttgctacatgtgctaattataagttcacagactggttctagtcattattttattaaccatctttggaaaaggagagagagagagagaatgtgtgtgtggtgattatactttctatgttaggaaaatgtaggtttatgatgttataattgtttacctctacagctctatagtcttagacttactttagccccttttcatcattaccataccttaaactagatctgcataaaattatctcttttctgtctctgaggctggttcttccatcttatttctaaatacatagcatgtattaaatttattgcacttcttgagatacttcttgataatgtttttctaaaagttgctacttacgcaatgttctataatttatataagctctactaccacatacaatcaaactattacttctaatattactacacaaacatatgcatttccttaaagattaccaatgcataacaaatatatcctagctctcagcctggagtatcttactgacttcttttcaaatgagacttgataaaacatgagcaatatttgcactcttttattgacaataaatctagatccatgaaattttgtatacaatccatagtcttctttcttctttgtttctttgtttcttcctttctttctttttagacagggtctcattcttccacccaggctggagtgcagtggtactatcatggatcaccgaaacctcgaccccttggactcaagtgatcctaccacctcagcctcctgagtagctgggactacaagtgattgccatcatcccctggctaatttttcaattatgtgtagagataaggtcttgctatgttgcccaagctggtcttaaacgcctgggctgaagcgatcctcttgcctcggcctcccaaactgctgggattacaggcctgagccacatcacccagcctaccacagtcttagcgtccactgttttggaatgaataggctcacaaagccagcagagtcagtgctaaattgttttaaaataatagtatgttctttatctctatgcagttccatacattggaaatgttattacctaaatcattgctcttgaattataccatggctacaagccttcagtttgagtaaactggggaggtgatacatagctttcaataaattatttcagctttttgtttgtctcaaaatatcattaccttcacttttgaaaaataatttttctggctatagaatggtgcactaacaggttttgttttcaatattgttctacttttttctaacaagaagactcttgtaattcaaatattagtttctctgtatgtgttttaactatatcccccattctctttctcctccacccttctcctctcctttcattattttattttgactttgatttttggcagttttttctcctctgtaactatgtatctcaccagcagtatatgaaaattccatttgctctgcattcttgacaatacttgatcttgcctaggtatttcattttagtcattcttgtggttacatatagatacctcacattgactttaatttgcatttccatgatgactaatgatattgcacactttctcatatgtttgttgcctacttggagatcatcttttgtaaagtgcctgttcaaatgttattcttctcttttagattgactgtagttttctttgcagaaatcatttttatatatcgtttgcaagttctttgtgagatatacgtactgcatatgcatcctccaaatttttagtttgcctttcctcttttaatgttatcttttggtgaacataatttaaatacaaaaattatcgtttttcttttatgagtaatatattctgtctagtttcagaaatatttgcataatgcataggcataaagatatccacctatgttttattataaaagttttattgtttgatctttcacattcagatcagaaattgatttgtgtaaaagatgcagggaaagtttgttttttgtctgcatatagatagacatctaattgactcagctttgtttatcaaaaagacaatctttcatcattgccacttataaaacaggagactgtatttatttatattggtttctggcctctttattctatttgtttattttttgccaacatcatgcatgttaatatctacagttcttaatgtcttcatgtctgacacagtgagtattctagctttgttcttcccgaaagccaccttagacacacttgacctcctgtatttcctcatgatttttgaatctatttgtcagtttccacaagatatgattacaagtgttttttatacttgtagttgcaacttttacacaagttgcactgaatgtataaatcactgtggaggaaactgacaactttataatagcaaagcttttactacacgaacattgtatattattccatttaagtaggtcttcttcagcctctcagcagcaatttacttgtagttctcaatatcaacctctcaaacatttttattctgtttatagatatttggtattttctgttcctcacatgatattatttgtatattttattttctatttgcttattgatggtatataaaatatagtgtgcatccagcatactttctaaaatcactcaatacttttaagtttggaaattctttaatagtttagcagtttgaatcttctacacacactattgtgttatctgttttgtaaactgattatatttcttgctttctaatatctatacctgattgcttaacaagttttcttatccatcactggctggaaaatcccatacattattgaatagaagaagtgataacagatgtcctaattttattcttggccttagggagaaatctattaatattttaccactaagtatggagttggctgtaggtttgtttttaactactctttagaaggattacttcatttatctttctaagaatttttattatgaatgattgtcaaattttccaaatatatttttctccatctgttgatatgcttatatacttttctccattttctgttgaaatttggagttacattgattgagttttaccttttaataaactttgaattcctaaaataaaaccaacttggtcttgatgaattcaactttatatatattgctgaattaatttttctaagattcctttagatttttgtatccataatcaagagattttgatctgcagtttccctttcttgtaacgacttaagtttcagtatcaggttatagtagcctcaaaaatgaatttggaaactttttttccttttctattctctagaagatgtgttgttccttatatgtttgatagaattctcttgcaatgccatatggttttcatttgagaaaatttataagtaacagcttaaatttatttttagaaaaacacaggcttatactggctttcttgcatgattttaaagttcagttttttcagaactttgcccgttttatctcagttgtcaaatgtatagattgatgttgttcaaaatcagttgattgtctttttgggggaaggaagggagttaaatttttcctttaaataattatagcttcacaagaagttgcaaaaaaatgtacatagaagtctcgttgactctcacccagtttctcccaatggtaaaattttgcatatctatagtacaatattaaaaccagaaattaacatggatacaatccacagagattatttgaatattaccagttttacatgcactcatttgttcaagagtgagagagagagagagtgtgcatgtgtgtgtgtgtgtgtacaactttgtcacatagattagcgtcaccatcaccacaatgggggttacaaaactgtttcatgatacaaagcttccttgtgctagctgtttatagccatgcctatctctctttccccaattctaaccatggtgaccactaatctgttctctatctttataattttatgtcaaaagttagataaattgaattatatgctgtgtaacctttttagattggctattttcattcaaagatacatctaagttattgagtgttatcaatattttgtctcttttattgctaagtaatactctattgtatggaagtatcacaatttgcataaccattcacctatgacatggtatctgaattgtttccagtttttgagctattatcaataaagctgctatgaacatttacaggcaggtttctatgtgaatatcattcggtttctctgagttatatgcctaagagtgtaattggcaggtcattaggataagtttatgtttattcttatagtacactaccaaactattttctagaattctgtaccattttatatgattaccagcaatttatgagtaatctagtttctccacatcctcaccagtatttggtgttatcactattttaaatttttgttattttagctattctaataggtatgtagtgatatctcattattttagtttccatttccctagtggctaataatgtggaatatcgcttcatgcacttatttggcatttttatatctttttggtgaactgcctgttcatgtcttttgtatattttctgattggattgttttgtttattactctcaaattttcagagttctttatatgttatagatacaagtcccttgtcagatatatggtttgtaaatattttctccaagtatgtagcttgtgttttcatactcttaccagggtcttttatagagaaaaagcttaaatttttatgatatccaatttatcagttttttcttttttaaatcatgcttttggtgtcaactctaaaagctgcctggccctaagtctcaaagtctctttactcctctcttctaaaaatgttttagttttacattttacatttaagtccatgattcattgtaagttaatgttatgaggtatatttcttaagtcaagactttttttttttttttgccatgttgacctattggaccagcatcaattgttgaaaaggctatcctttcattcaattgtttttgcacctttgttaaaaatcatttgggcctgggtatggtggctcatacctgtaatcctagcactctgggaggccaagaaaggaacgttgcttgagcccaggagttcgagtccagactgggcaagatggtgaaactttgtctctacaaaaaattttaaaacataaaaaatagctgggcacagcagcgcacacctgtagtcccagctactcaggaggctaaggcaggaggatcacttgagcccaggtattttttgttgttgttgttgttagatgagtcttgttctgctgcccaggctggagtgcagtggcacgatctcggatcactgcaacctccgcctccctggttcaagcaattctctgcctcagcctcctaagtggctgggatcacaggcgcccgccaccacacccagctaatttttttgtatttttagtagaggcagggtttcagcatcttggccaggctggtcttgaactcctgacctcatgatccacccgcctcggcctcccaaagtgctgggattacaggcgtgagccactgtgcccggccgagcccaggaatttaagatggtagtgagctgtgatcacaccactgcactccagcctaggcaataaagcaagatccatctatttgaaaacaaacaaacaaacaaaaaacccatcatattggcaatatttgtgagggacacttattatgtgttctttatgctcttccattgatctatgtgttgatccctctgccagtattacttgatgctgttttgattatttcagctctacggtattttttcaattccagcagaatgtttgctcccactcttttattcctttttaatattgtcttaggtatgtcacttgccttttcatataaattttaggcatcatgtattgtctttttaatgtctgtaggatctatgattatgttctcatttttatttctactatcagtaattcgtgtcttctcttttgttctttattcattttaaattttgtattatatttaatatttcaatacagacttatatgctatattaaattaataccttagtattaattatttttatttatttatgccaaagttcatccattttatttgtctttttggagaactaaactttgattctattgggttatatattctttttaaaattactgattttacctttagtactttttatttcctttctgctttctttgggtttactttgcatgccactgatagcctcagtttattgctacataagacatctcaagtctctaatcctaactgggcatactatccagttcctgagttacctgtggtggctgcacagttgtcttagttttctcccattatctcaagtaactcagtgcgaaactttcctcggccctaaaaaatacatcccagcttttaaaattatcattatttttaagttttcattttttggtgggagctgtgaccaggactattttcatagccaaaacagtctctactttttggcaagggtcaatacacattggttccaattttctttgtaggagctgaattcctggcgatctatgcttatattcggtcatgtagaactcagttggttttgcacttcagtgcacacttactgttttgcacttccatttagactagtccactgacatgatttgtcatggaatttagcctttatgtcttctttaaattttccagtttatcagtcattgctgtgtgatagaagagacagggtggaaggtctgtctcttctatacaaaccttcagtgtttctggaccaactacttcaaagggtatttttgcagtcacacaatcttagggggaaaaaatgaagagaaaaaaataactgtcagaaatattatgaagttattccatataagtggagtctgtgttcccaatataatatcagacttagaggcaatattttacgggacaaaaatcacaatctataggagctgggccctctacattgcaatatacattcagtgtggcagggattttgcaagaggaagataaaaattttgttagttctattatttcttaaatctttaattttgttgatctagatcttgctgcctggttcattccagaagcaaaaggaagagggcctctttaatatttaagtcataaaatagagctcattcatccagaagtagtgatgcagaatgtgcagtgggaatagctatcaggaaacgcaatgatattacatttatcccttttaaaagataattccgatctacttgacacaattaggggagaaatgaaagtaagtacaggcttagaaattctatcagtaagataaatgctttaaatgaagatcaattaagagccaggtagagtgctcaaaacaagtgtcgggaagtgggcaaattgatagtatcaaagctatgaaaatcactaggaaaagttaataggttggcaaagataagcaagccaatatttggaaaagctaaatagttgtgctaagaacagagtgactcactgaagtacagaattcttatttcttttaatatttttctcactgtttgtttctattaatactggttagagaggaggcagatatactcctgggaaaaggtaagaggatctctggagtaaatgataggaaggagggccacatataggtagattgaaaaatggtttgaactactatcttagacacataaaatactgaatgtgaagttctgcaaaacattagtgacagttgagaatatattaaaaatataattgcaaaaatgattgctaacatttttaagaattagaaatgacaattcactgttaaataaaattatttgctaatttttctctaacttatcaccaatatgaacaaatgaacctactgtatatgtgagtataaacaaaaaatgctctgcctgcttaaggtaagataggcattgttcatatgatatgtttttcagatacctaatcaacttgcagcaatttacaccatatgaaagggaagtgctttggtgaatttataaagccctctaactccaaaacatttgtattttttctttattgatgtaggcaaagagttgcgttgctcatagcgataatttcagggcatacagtgagcattatctgagcaaagtcactataattttttacataattatttatcactttttattcccatacccatatattatccaatgtacagtgtttttttgttttttgttttgtgttttttactttaagttccaggatacatgtgtagaacgtgcaggtttgttacataggtatatgtgtgccatggtggcttgctgcacctgtctacctgtcacatagattttaagccccacatgcattagctatttgtcctgatgctctccctcctcttgcaccccccacctccaacaggccctcatgtatgttgttcccctccctgtgtccatatgttctcaatgttcaacgactcccactaatgaatgagaacatgcagtgtttggtttgctgttcctgtgttagtttgctggggatgatggcttccagcttcatctatgaccctgcagacgacatgatctcactcctttttatggctgcatagtattccatggtgtacatgtaccacattttctttatccagtctatcagtgatggccttttgggttggttccatgtctttgctattgtgaatagtgctgcaataaacatacgtgtgcatgtgtctttataatagaatgatttatattcctttgggtatatacccagtaatgggattgctcagtcaaatggtatttctggttctagatccttaaggaatctccacactgtcttccacaatggttgaactaattttcattcccacaacagtgtaaaagcattcctacttctccacagcctctccagcatctgttgtttcttgactttttaataatcgccattcactggcgtgagatggtatccaattgtggttttgatttgcatttctctaatgaccagtgatgatgagcattttttcatatgtctgttgccgcatagatgtcttcttttgagaagtgtctgttcatatcatttgcccactttttgatggggttgttttttcttgtaaattctgcatattggacctttatcggataggtagattgcaaaaactttctctcattcagtaggttgcctcttcactctgatgttagtttcttttgctgtgcagaagctctttaattagattccatctgtcaattttagcttttgttgtaattgcttttggtgaattcatcaaaaaatatttgtccatggctatgtcttgaatagtattgcctaggttttcttctagggtttttataattttgggttttacaattaggtctttaatccatcttgagttaatttttgtataaggtgtaagaaaggggtccagtttccgttttctgcatatggctagccagttttcccagcaccattcattaaataggaaatcctttccccattgcttatttttgtcagatttgtcaaagatcagatggttgtagatgtatggtcttacttctgagctctctattctgttccattgctgttttggttactctagccttgtagtgtagtttgaagtcaggcagtgtgatgcctccagctttgttctttttgtttaggattgtcttgattatgcaggcccttttttggttccatatgaagtttaaagtagttttttttttttctaattctgtgaagaatgtccatgttagtttgatgggaatagccatgaatctataaattactttggacagtactgctattttcatgatactgattcttcctatccatgagcatggaatgtttttctatttgtttgtgtcctctcttacttccttgagaagtggtttgtagttcttcttgaagtggtcattcatgtcccttattagctctattcctaggtattttattctctttgtagaaattgtgaatggaagttaattcatgatttggctctttgcttctctattgttggtttataggaatgcttgtgatttttgcacattgattttgtatcctgagactttgctgaagttgcttattagcttaaggagttttggagctgagatgatgggttttctaaatatggtatcatgtcatctgcaaacagagatattttgacttcctctcttttcttttttaataccctttatttctttctcttgcttgccttgactagaaattccaatactatattgaataggagtggtgagagacggcatccttgtcttgtgccagttttcaaaaggaatgcttccagcttttggccattcagtatattagctgcaggtttgtcataaatagcgcttattattttgagatatgtttcatcaatacctagtttactgaaagtttttaacatgaaggaatgatgaattttatcaaaggccttttctgcatctatcgagataatcatgaggtttttgtcattggttatattaatgtgattgattttgtttattgatttgcatatgttgaaccagccttgcatcccagaaatgaggctgacttgatcatggtggataaacttttggatgtgctgctggatttgatttgccagtattttactgaggatttttgcatcagtgttcatcagggatattggcctgaggtttcctttttttgttgtgtctctgccaggttttggtatcaggatgatgctggcctcaaaaaacgagttagggaggaacctctccctttcaaatgtttggaatagtttgtgaaggaatggtaccagctcctctttgtaatgtccagtagaattcagctgtgaatccatctggttctgggctttttttggttggtaggctatttattgttgtcggtctattcagggattcgtcttcttcctggtttagtcttgggagggtgtatgtgtctaggaatttatccatttcttctagatgttctagtttatttgcatagaggtgtttatagtattctctgatggtagtttgtatttctgtgtggtcagcagtgatatcccttctgtcatttttttattgtgtctatttgattcttctcttttcttcttatttcttgtcttctgctagcttttggattggtttgctcctgtgtctctagttctttccattgtgacattagggtgtcagtttgagatctttctagctttctgatgtgggcctttagtgctataaatttccctcttaatactgctttagctgcattccagagattctggtacattgtctctttgttctcactggtttcaaagaacttcttgatttctgccttaatttcattatttacccaggagtcattcaggagcaggttgttcaattttcatgtagttgtgtggttttgagtgagtttcttgatcctgagttctaatttgattgcactgtggtctgagagactgcttgttaagatttcatttcttttgcatttgctgaggagtgttttactcccaactatgtggttgattttagaataagcaccacgcagaaccgagaagaatgtatattctgttgtttggaggtagagagttctatagatatctattaggtccacttgttccagagctaagttcaagtcttaaatatccttgttaattttctatctaattttgatctgtctaatattgacagtggggtgttaaagtctcacactattattgtgtgggagtctaagtctctttgtaggtttctaataacttcttttatgaatctaggtgctcctgtattggatgcatatatatttaggatagttagctcttcttgttgaattgatcccgttaccattatgtaatcccttctttgtcttgtttgatctttgttggtttaaagtctgtattatcagagactaagattgcaaaccttgcttttttctgttgtacatttgcttgataaattttcctccctctctttatcttgagcctatgtgtgtctttgcacatgagatgagtctcttcaatacagcacctttctgtttgttagttttccttctaacagacaggaccctcagctgcaggtctgttggagttctagaggtccactccagaccctgtttgcctgggtatcagcagtggtgtctgcagaaccgcagattttcgtgatccgcgaatgctgctgtctgatcgttcttctggaagttttgtctcagaggagtacctggccgtgtgaggtgtcagtctgcccctactgggggtgcctcccagttaggctgcttgggggtcaggggtcagggacccacttgaggaggcagtctgcccgttctcagatctccagttgcatgctgggagaaccactgctctcctcaaagctgtcagacagggacatttaagtctgcagaggttactgctgtctttttctttgtctgtgccctgcccccagaggtggagcctacagaggcaggcaggcctccttgagctgtggtgggctccagccagttcaagcttcctggctgctttgtttacctaagcgagcctgggcaatggcgggcgcccctcccccagcctcgctgccaccttgcagtttgatctcagactgctgcgctagcaatcagcgagattctgtgggcgtaggaccctctgagccaggtgcgggatataatctcctagtgcgccatttcctaagcccgtcggaaaagcgcagtattcggctgagagtggcctgattttccaggtgccgtctgtcacccctttccttgaccaggaaagggaactccctgaccccttgtgcttcccgagtgaggcaatgcctcgccctgcttcggctggcacatggtgcactgcacccactgtcctgcacccactgtctggcactccctagtgagtgaacccggtacctcagatggaaatgcagaaatcacccgtcttctgcgtcgctcatgctgggaactgtagacaggagctgttcctattcggccatcttggctcctcctggttcttgactctttatccaatttgccagtctgtgtcttttaattggggcatttaccccagcaatgtaaagtgttgaataaatatttttgtttgtatgcagtcttcaaaaatatgtatggttgttttgtggacacataagtcatacccgtatgaagatatagaacatttctatcaccctagaaagttaaatcatgcccatatcacgtcaatcccacccccgcccacaaatcaattactgttctgctttccattatttgcctgttgtagaactttatagaatcaaatcatgcattatatatttttttgcttcttgtttcttccagtcagtataatatctgtgatattcctctgtgttgtgtttgtattagtagttcctccttttaatctgtgaattctattccactttaagactggattttactttatcatcatttccattttatccagtttgcatattccttttcttgctgatgcacctgagctgtttccaggttttgaatatgatgaacacatctaccatgtaaattgttacacaaggctttttgcatcaacatgatttcatttcttttagataagtacctagaagtgggaattcctgggtcatagggtaggtgtatattcagtgttataaacaatcacaaaacctttaggttttgtgatattttgtgtctctaataagaaaggatgagaattacccttcctcaacatttttcccaacacacggcattatcagtccttttaattttagatacttaaaacagtgtgaaatggtatctcattgtttcaatttaacttcagaacctatgaaaagttttacattcagttttaatgtaggtgtctgctaattctaacaactatacaaattctgagtcaattgattagtctcctcatattggtcttgttttctggtttcatttttcatgcctagtcatcactgaatggatataagacatcatgaattttaccttgatagttactggatttcaaaaattcttataaatattcttgagggttttttctgaaattcattttaaattactgagaaactgtctgatactcttgggtgttgcttttacgatttttagtgggtctggagtggtgctcagtgtagggttaattattactcaccactgacacaagatactctgcatagactacccaatgccctatgaattatgagctattaggtctaactgttgtgaataggcattattcccacccctgtgtgagtaccgggcactgacccttttagttgtttcagaattttttttttttttttaccaggctgaggctcttttctctaatgtatgcactgataatattcagatgaatccttgaagttactctccacagatatttggggttctttctgtgggcaactccctttttgctagagtttggactttttcttagtgaccagagaatagcaatgaaccatcattttataactgaaacaaaaaccataacccccaagtctacctatccatgatctgtagttctcttccttttttgattgctatttcttccccagtgactcttatactgtttgtaggcctagacgttttgtttgtgcatttttttgtcttttgctattttaatcccaggttatgagagccagctgggtgtggtggctcacacctataatcccagccctttggaaggctaagatgaggagattgcctgagaccagcagtttgagactggcctgggcaatatagagagacctggtttctacaaaaataaaaagtaataattagtgggtatggtggcatgcatctgtagtcccaactacttcagaggctaaggtaggaggatcacttaagcccaggagtttgaggctacagtgagctatgattttgccacttaatttcaacctaggctacgaggtaagacctatctctaaaaaaagagagcttgtcaccttcctctctctcactttgggacacttacaagggtgaatataaggaaagggaggtgttaacacatactaattcatcatcatgtcataaatcaaaagtctggcaagctggtttcaatgacaaaaatacattcacacctactagtctacattgtcattggataaaatccttatcgctcataaaacactaatcaaccccagctacatatgtgaaatatagctttgatcctaattctttttcatttttttctaattttctgcttaacagaagttcaataactaaaggtgccactatttctaaacaaaatattcattatagtctaagatatgttcagacttttgagaattctgactgccatattgagagaaaatatccttttaatgtgctattagaaaagtttattttctacaatatacactaaataaaagtataaggaatttatattttatagatatgacgaagtattattttccttaccttaaagccatctcttaattgtaggattagttcaaattagaacatctatttaatggcagaaaacagtcttaaaactagggatcttgaaaatacttctccaaatctctatttcaaattcctatgaaaagttgttttatgtatcttccaaagtatatttgttttattttttctaagaagtaggatatattttaaagttttcataaccacctagatttatttagtaacttttctctaagaaattaaagtgggcttactcttgtagatttaactcaaaaaaaagttctaataaatagatgcaatgagatatattctattttatttttattttatgtattatttagagttttgaacttttcatccagcaacattctgcctggctgcctctttgactgtaaatcagatcccctcagatagagcattgctccaatgaggacttgagagtgctcataggtacattacttactgaattgcactccagcgtcctgacagaacaaagcactggcaagtgtaacataaatttccacaaagaaataacttcagcaataaactctatttagggataagaaagaggagaataacagggcaaactacataaacgtcatcacaacacagcacattagatgacatttttacagtgacatataaaaattaccttgtagaatcttgataggaacttacagccaaactttcttacaggaacataaagccttcttgatatcatgaaaatctgttgcagttcttctcaggaaagtggcttttcaggaacattgtaattctgttttaatatggatgtaagtgctttcaattaatattcactataccgaataagcaggtctaaacaatgtaatgaaattaattaataagtgatgaattaaaccactgattaaacttatttgaagaccaattttactaagtacatataacgttctgacttacatgattgaacatatagatttaataggataaaaataaaatgcaatttactatctctacgtatgaaaaataaatatataacacaaattttgttagctgaaacaaaggaaaaataattcttttataaaataatcctcctgaatgagaaacatatatacataaactgggaaaaattaaatatatatgaatacatcattaagctgtagagacagtgaagaaaccacagagggctaaaataacatgtaaacagaagctgagaagcaaatgaaatgtgtgaaattcagcttttattctgaaaatttctgccaaattttgggagactaaagtttcccgttcccctaggactgtatgggctagaaagaacagaagtttttaatgtgacatgggtagtttaataaaatatgcctgataaatctggtaccccaaagtgccctatgataagccaaagaatgaatgaaaaatgaacccattataaagaagggacagcaaaaatatttatccattttaaacttgtaactggatgaaagaaaagaaaatctcccatgatattttgtaaccatgaactgagtgtcacatggatttttgcttgaatttatgcttacccacatgttcaggagtaaaacttggagcagaaattttaatttaaagtatggtaaggtttgcagtgctccctgatgactgatagaagaaagtaaaatcatctctagggatgtgcaacatcaattcattaaacaaaaactttccaaatataaagttccaagggaaatgagcagttcagagtcaaaaatcataaaagaaaccacataagttacagatgaccctcaaagaatgtaaatatcagaattatcagacgattttaaatatctgaagaaaagaaaaaaactgggaacaagagcctatagaaaacaagtaagatttgggagagaacactgcatttttataaataaagaagacttcaaatttaacatttaaaacaaagattgaacaataaaaaatagcttagctaatgaactagtagacagcttattctcaaaagctatgtggtagtaatatgttttaaaaactagaattgacattttaaggacaaacttccaatttacagtctggtaggtagagagcttagaagttgtcactcattcctaccaacaagtaaaaagctgaaccaactggcgcggtggctcatgcctgtaatcccagcactttgggaggccgaggcgggcggatcacaagttcaggagattgataccatcctggctaacacggtgaaaccccatctctactaaaaatacaaaaaaattagccgggcgttgtggcgggcgcctgtagtcccagctactcgggaggctgaggaaggagaatggcgtgaacccgggaggtggagcttgcagtaagccgagatgttgccactgcactccagcctgggcgacagagcgagactccgtctttaaaaaaaaaaaaaaaaaaaaaaaaaaagctgaaccaactgaaaaatcaacgactcttcttagatctgtcagagaagtaatgtcacagggaaaatcactggcctccaaattggagagacagatgaatacagagaatcacaacttaccagagcaaagacccacaagctgaaacctccatggggaccagtgctgggtaagaaaacctgagctgtaattaataaattactagaggctcagtatagattattttgagagtcaaaaagtccagggaaacccagttaaaggagtacccctacacttttgtgagctttagctcctagagctaaaccaggttttgacagtgaaagaggagaagagaaatgaaaaagaaagaagagaatttaaaaattccttcatgctccttgcaaggggaagaaaaaagtaatcattttgaaatttaccaaagtattctgctattgataaggcctgcccctagaaaaaactgttttcccagagcctagactactgttttgtttgggggcctaactaaactgggggaaagggaatacccaactctagccttctctagctttccacatagaagaagaaaaatacccaactccagtccaatctagctattctgtcccacctggggccagggatggggggaatccatgggagaagtgagaagcacatgtgaggttaacagtccagaggcataagctcattaaaacactgagacctaatcaggcaactgtaggacactttccctcctctgacatcttatcacctcattcctaaaggcctatttatcctgttacccaatacatcatgtccagctatcaggaaaaaattacaaggcatactaaaagtcgcaaatatagtttgaagagctagaacaagcataagaaccaaactcatatggcagagatgatggaactatcagatgagaaatttcaaacaactatgattattgtgctaagggctctattggataaaggagataacacatcataacagatgaacaatgtcagcagaagttctaagaaagaataaaaaagaaatgctagagatcaaaaacacactaatagaaatgaagaatgcctttgataggattactattagactgaacacagctgaggaaagaatttctgaacttgagaatactcaacgaaaatttcaaacactaaatagcaaagagaaaaaaggctgaaaaaagaacccaaacagtatttaagaactgtggaagaactacaaaaagtgtaacatatgcaaactaagatgaaagagaagaaagcaagggagagaaaagaagaaatacttgaagcaataatggatgaaaattcccccaaattaaagtcagacaccaaagcacagatgcaagaagctcagagaacaccaaacaggataaatggaaaaataaaaaaaccctagccatattatacttaaactcagaatatcaaagacaaaagaccttgaaagaaaccagagaaaacaaaacatcttattaaataggagcaaaaataagaatcatatccaattacttctcagaaaccatgcaagcaaaaagagaataaagtaaaatatttaatgtgttaagagaaaaaaaatcccagcaacctagaattctttgtcctaagaaattacccttcaaaagtgaaagagaaataaacacttcttcagacaataaaatttgaggaaatttgtaaccaatttatttgtatacataaaataaatgacagcaataataaaataatgagggttattttattactataaagtactcacagtactaaagcagcattaaagagtggattttaatgaattgtaaatctatattgctaactctagggcaaccacttaaaaataggaaaaaaaatataactgttatgctaagaaaggagataaaatggtattaaataaaatgctcaattaaaagcatcaagggaagaaaaagtagaattcaaaactgtgaataaaggacaagggtaacaaatagaaaacattagcgaatacagtagatgttattccaagtatgtcaataatcactttaaacatcaacggtctaaatataccaattaaaagacagagattgtctgagtgaataaaaaaacaagacctaaccatatgctgtttacaagaagcacactttaaatataaagacacatatatattaaaagtaacggattgagaaagatatatcatgctaacatatcaaaagaaatgaggatccagacaatggaatcttattcggcactaaaatttgagtaaggtattgagcgatgaaaagactactcagggaggaaccataatgcacattacaaagggaaagaagccaatctgaaaagactgcgtactgtatgattccaactaaacgacagtctggaaaagttaaaacttatagagacagtgaaatgatcagtgtttgccagtggttggggaaggaagaagaataggtggagcacagaggattttcagggtggtgaaactactctctatagtactaatgctatatatatgtcattatcaacttatcaaaacccatagaatgtttaacaccaaaagtcatataaaccatggactttgataatgatgtcaatatagattcactgactgtaacaaaagtaccactctggggcaggattttcatgataggggaggttgtgtacaagtgggtgcaggggatatataggaaattcatgtatcttccactcagttttgctgtgaacctcaaactgatgtaaaaaataaagtctatttaaaaagttaaaggaaaaagttttacttccagacacaaaggtgtaactgaatcagaccagctattcccccatagtcaaaataactgattgtcatgttctccctccctctctgtccttctatattactttctgcacagggatagtgttagtgccttctgggatgggagaaaggtccttcgaaagctcagaagattcaaagaagtctgaggaatcaaactggaggagggataaattcacccagataacactatccttggggtatggtgccaggttctccagctagggccctgactttgacatctcacaactacatctgtgcattgaactgtgttgaaagttcacctgctctgactcttagacaagggtttggtcttcagctctttctgctaatctactgcatgagataagggcttctttgtaagctgccaaagcactctggctctcatgcttagttttcaatgacttgctaattgagcatggcttgcattgtcaaaccactcctcatgccaactatgctagtcaggttctccagcaatcagacattgagataacattagatttacagaagttgcactgacaagtaacgtcttagaaaaaaaccaaacaccgcatgttgtcactcacagatggaaactgaacaatgagaacacagggacacaggaaggggaacatcacacaccggggcctgttgtggggtgaagggagggggaatggatagcattaggagatatacctaatgttgaatgacgagttaatggatgcagcacaccaacatagcacatgtatacatatgtaacaaacctgcacgttgtgcacatgtaccctaaaacttaaagtataataaaaaaaatagataaaagaaaggaaaggagaaaggcttacggagaagaactcatcagacggtgatataagatctcgcaaaatattggccaaccccatgggaagctctggaacaaagatttgcttttagaagagcctcatattgggttaagccattggcaagaagaaagtaacctcaactcaaaacctgaggtagaccctaatggagctagcagctagaggctgacagctaaccacactccttgctatgggtagaaccatttctttacaaaggatctaagatattctttttcatctgacacaaacactatcaaataagtagacataatggacatttggacataatggacatatggacatctacaaatggaatgaatatctacagatggaattccatgtattctaaagatacatggaatatttactaagatagtccacctgctgaggcataaaagatgtcaaattcagaaggactgaaattatatagaataatattcctgaacaaaaatggagttaaactgtgaagtaacagtaaaaaaaatcttaaacttgtaaaactcagattatggtaattagcatatccatcatctaaaatattcattatttctttgggaacaaatttaaggcatggaggcattatcctaagcaaattaagacagaaacagaaaagcaaatatcgcatgttctcacttattgtaagtagaagctaaaaattgggtactcatgggcataaagatggcaacgataaatactggggactactagagggagacaaagtgcggggacaaaggttaaaaaaataattcttggccgggtacagtggctcatgcctgtaattccagcactttaggaggctgaagcgggcggatcacctgaggtcaggaattcgagaccagcctggccaacatggtgaaaccccgtctcttctaaaattacaaaaatttgccaggcatggtagcaagcacctgtaatcgcagctactcgggaggctgaggcgggataggataattgcttgaccccaggaggcggagattgcagtgagccgagatcacaccactgcactccagcctgtgcgacagagcgtgcctctgtctcaaaaaagaaaacaaaaacaaacaaacaaacaaaaacgccacctaattcttgggtactatgctcagcacctggacgacgcaatcaactgtgctccaaacctcagcatcacaccatatacttacataataaatacttccaagcaactgctgattctaaaataaaacttaaaatttatttttaagaataatatgataaaaataaaataaaacatgaatgtaaaaaggcagtttatcatttaagaggtaatctagcttaattttttatgaaagtgtctctctagcctgttattaagcacatacaggattgaggaatttattctctaaagtagcctgattcattttaagatgttctttaatggttggaaattattttatgttaaagttaaattttccctcccattatttccacttttcatcctagttctctcctccagaacctctcaaaatcaatccaaaccttactacacatgagtccttaaaaataatcaaaaacagttatcaaatttctgattctttccttctgcagatgaaacattctcagctccttcaggtaccttctcatgtgatttacaatgacccagaaatattctcattccttgcccttcaacattcttcaatttgattaaaagacctccaaaggtgagctttccagaagagaacacaatatcttaggtgaggtcttccccgtgtgaaatacagaagccacatcccactctcacaaaaataaaataaaataaatttaaaaggcatgaagggcaggcaggagttagcttggataatttctttggtagacatacgattgattacttctaattataatctccttcttgggactcatcaggccctaaaactggctaaatagttttatgcctcatggcctttgcacaagctgtcctggtgaaactaatatttgtactaaaaatacaaaaattagccggatgtggtggtgggcacctgtaatcctagcctcttgggaggctgaggcaggagaattgcttgaacccgggaggcggaggttgcagtgagccgagattgcgccactgcactccagcctgggtgacagagcaagactctgtctcagaaaaaaaaaaaaaaaagaaagaaagaaagaaagatcttaccatactcttcatattcaccatcccaaaaaggctgttccttatcactttttccagggcaaccttttcaccattattctctgaccgagtctaatgtttattttcttcagaaaagttaccaaagatgcaattattaatttgcttgttatcttgtctttgtctctcccactagaatataaagtaaaagtttggtaaacaaacaaacaaaaaattaaaaactgcatctgttcatttcattaatatcctgccagcctttcgcacagtgcatgcatagtgtacaattaacacccaaaaatacttggtaagttaataaattaaaaaatgaaatggtgaccaacaggtttttggttttgcgactggatacataagccaagactaacattacaaaaggacaagtatgttgtggggggaaaaagagaatcatgaaggagtctaagttttttggggtctgtctaatgtctagattagaaataaggatctggatctagaagccacacctaaaaaataaatttatatagcacggtcaccaatctatttgacatagttaaagttgtaggattagatgaggaaataatcagatgttataataaagaaataagaaactaagggacacagaatgagaaattaatgtctaaggaaattaaaagcaatccgagaggtagaagtggaactacagcccaataattccattgtttcaagaagacagaagtgacagataccgtcagatggcaatagaagagacctgaaaaatgtttatgggttttgaaatttagcagttattagtaacttttgagagagagcagtttaatggtattttcggagcagaagcccgagagtcatgcagtaaacaggtcagaaaataaaagggtaaataagagcactctgtcaagatgattgattgaattgcatataagaaaatcaaggtagcaagcagagaagtacccaaggacaaagaaggtgtttttttttttttagtttgtttttagatgcaatagatttgtacatatttatcacctaagggaaagagccactggaaaggaaagcattaaaaatataaagaaaatggggacatttgaagaatgacttatgtgtgatcacaggaagacagcggaatgagtattcatgagtataggcattagatattaggtaggaggcacctgtacctcctgcttgtggggaactctcattggtgcacagaagttaaaagaatgataaatgtttaaaggcatttatatcacaaagatacaaagacagagtagacaagtaaacttattcctcaaaagcacggaggcccccttggagttggagatcatttacttgtagtggcacaaagtggcaccaaaaaaatgcatgcctatgttatgttctccatcactgttccactcacttggtaaaagatagtacaaaaagataaaaggattgaccttgggctggaagtctgtaaggcagatggagaagaataatttgagggaggaggattaaaggatactgcctttataaagatggaaagaggcctagcagtgtaatttgacaggatatgtgaaaaataacaaattaaaggagagaccacaaagcaagtggattgcagagagggataaaggtccatctgagatttgtgaataaggagatgtctaatctatgtccaaatcaaatacatagttggatacttgagtctgacataaaggaagaaatacggactggggttataagtttggtattcatcagcatcaaatagtacttaaataggtgagaatgatatgatcacctagggagtaaacaaagatagaggagaaaggagaaccaaagactgagccctggggctctggagcaccaagacgttgtagagatgagagaagaaggtttagaaggagtacagcagacagaattcttaaattcctgtctcctggtgtacaaaccccaaataatcccctccccttgactgtaggtgggacttaataacataattagatcttactcccatgaataggttatatcttatgggaaagatgtaattaaggtccctaatcagtagatttaaattactaaaaaaggaacttattctgtatgggcatgacctaatccagcaaggtattttattattttattctgttttattttactgagaaagggtcttgctctatcactcaggctggagtacagtagcatgttcactgctcactgcagccttgacctcctgggctcaggtgatcctcccacctcagccccctgaggagctgggactatggatgcacgtcaacatgcctgcttaattttttataattttttcacagagacaagagtttcaccatgttacctaggctgctttcaaactcctggactcaagtgatccacccgcctcagcttcccaaagtgctgggattacaggtgagccactgtaccccactaaaatgtaaaatattctcttcctgggcttgaagaatccaacagccatgttttgagaggtttttgagagggccatgtagcaaggacctgaaaacagccttaggagtgggagtgaccccgatctaatagccagcaaaacaacagaggcctcagtcttaaagctgcaagaaatgagttctgacaataatatgaaagaactcaaagtgaattcttttccagacaaacctctagatgagaaaatacccccgccaacactttgattttacccttgtgagaccctgagccagatttttggccagcagaaactgtaagataacaaatgagtattattttaagccacaaaatttgcggcaacttatgacacagcaatgggaaaacaacactgagagtaatcatagaaaattacgagtgctgttctggaagccaaatgattaaagagggaagaataattaactgttgtcaaatgctactgacaaatgcagtacaatgagacctgcgtattaattgttgaatttactaaagagaaaaattgtggaattatagggtaattcaagaggagatttgcagaagtatagaggtgaagctcaaaggagacaaaaaagtggagggttacctaagttagtaaatgaataaaattaaaattttccaagcatgttcattcttctggagtgtggcatttctgaccaaatgtaaatttaatactttgggttgccttcttgtcttcagaagaataacctcatctttcagcgcatctaaatgatgaataattaaaaggatcctcttgcccttgcagcatttccaaaacaagatgaaaattgagaggcatctgaacaacaaaatttccacaaaaataatgttttcaatatagttcatactttgtgtgttttataaattctccccaacacacacgcatacatacacacacacacataactgtaaattctcctacttttacaactctaattattctgtacaggtagtacagaaaagcaacttgaagatgaagtgcagaaaactatcttcagattaaggagtaatgtattatttctataggctatattcaattaacagaacatttagcataagcaattttcaaacacatacacacacacacacaccccccaacacaaacataaggtaaaatacatttattgcaaagacatacaatcaactacaacagtgtagttaaaggaatgcgtctttctgtagttactaacccagctgaagcaaatgcattttttcctaaagtaacaatcatttattgttaaataactattgtttatgtttatcgaaaaacaatgcagtgtaaagctaatatctctgttcctatttcttagtttatttcttttgaagattggtaaggtgtagagatattgattttattctctaataatcattccttaaactgtatttctgaatgccattacaaccccaggaaaagagagcaagaacaagtttagtgctctgtttgcccatttgtgtagcacaagtggtaccaatttctaataatgtgcctacatttatggagcagccgtttgagttttcagccttgctggaatcgtgttttagttataaaaaggccataccgatgagttttagagtggatatgcgttcatgtgaatctaccctagaagaggaagcactgtgtatccacaggagtctagtgttgaatctaaaaagagaagcaaatggtatctcaattctgagaactgtttctcacatcaaattgcattcacttgaacatagtgaaagttgttttggtgcatctattcccgtgattcagtaaggcacatgctttatcttctcatcataaaaggtgtaaacactcttatatgagtttcctggttactgaaagaagacaccagtgaagaggtatttatgctaaagtgaatatcctcattaacttagtcactgatctactattgtaagaggaagtctatgctagttgtacaataaatacattatgatggaacttatataaaataaactcttgccttttattcattttttgaatgattgttacctcaccttgggagaacaaaatacactctttgtgttgctgttggctggtacagaaagtattggcatgagttaatctaccattgttgtgggtagaaaaaaatactctttttctctgcttgaatcctaagactagttacaagttttcacaacaaataagatgatataagaatagtacttggctttttatacagtaaattacaccagtgacatgtaaaaggtgtagagaaaaaaatattctctgacactgaagaaatatttatagatttataggcacttgtattagtcagagttctaccagatatagacagagatgagacagagatagagataaagatagatagagatgatagagataaacagagatagatggaaagaaggaggaagacagaaagggagagggagggagagagaaaaaaagagagagatttcaaggaattggcttccacaactgtacgggtggcaagtgctaaatctttagggcaggttgacaaattggacagtctcccgcaggaggtgacactgtaatctacactcagagtttcttcttcctcagagaagccttggttttgctcttaaggccattcaactgattggatgacgccaacccagattatcaaggacaatctcctttactaaaagtcaactgattacagatgttaaccacatttacaaaacactttagttagtgtttaattgaaaaactgggtactatagcttagccatgatgatgaataaatctgaccatcataacatccatgacttaaaaggcactgggctagcataaagaagtctagattgagtaagccctcctggggcttagaagctgatagagagaatcatgtttggaacatgacataacaaaatttgttataaaaacagagaggagtctggaaatcaggctgcatatgtaatacacattataaagatatcatatgcctagtacaaaaataacacaaacaggaaaagttctgaatggaacctactacatactaaattaccacatgatataagaagcatcatcaatcaacccaaaaattgtcgattattgaagaaattgggctgggaaaattgagtactagggaaaaaaattgagtttgacactgctatcaaaaattggtttgaatagttgagaaaagttaaatgtggaaattctgataaaatggcaatgtaggaaaagcatgtgacactcatgaccaaacccccactataactccaactccccccgaccaccaccaatgcttgaggaaaacaagtgaatataaaaataagtaaaaccttatatcagcactgaaaactagcaaacttgtgatgcacttttaccagttttgaagaattgttgctatataaagcacatgcgggatcgaaataaaagaaagaataagttcaagacagctcactagtaaatgctcagtgctcattccacgatcagaaaaccttaacagaagatttcaagaccttctacctcagaaagttaggagcaacactgaaacaaccatactgttatttaaggctttcaccttccctgggtgcctacaggaaagcagttcagacaaaatatatcttatcatgtaaagtaagataagataaacgaataagaaaactgataaattagatataaaggatatgttagaaagtataaacaagtattttataaaactgtaagctaagtggctcacacctgtaattctagcactttgggagacagaggtgggaggattgctggagtccaggagtttgagaccagcctgggccacacggtgagacaccatctctacaaaattagaaaattagccaggagcggtggcatgcacgtgtattcccagctgctctggaggctgaggtgggaggatcacttgacccaaggagttcagagttgcaatgagctatgatctcttctcaggagaccaccaagaaatacatgaattattggggtaaaaggactatttcagggaaatccagaaaactaatgagttttgctttttaattaaattggtttgatgaatgggctctgtgttcagaaacaggagctcagcaggagaggccatgaagcagtgaagtgctaggaatgggaacataccttgcttgggaggccaaaggggcacacaccaaatcagtgaagataggaacaaaatacacctgggtccccaaagggcaagaggaactttgatgatatatgagttccacacatttaatatatgatgtgcccacccaaattaaggaaaagtaaagaaatggatgaattaatcaaaaatgtttgcttgggatgagtggttaacaaatcagttcataataatgataatattaaaactgttagaacccgaaacaatttacataataacttccataatcattgagaattttataagaaagcacaaacaacctagatgagagtacaggggaatatttatgtaaccttagcccttcattaaacaaaggcatatcagaaattcttcacagatttgatcaaaaaaattattaaaatcataagctcaatcaaaaggtaacagggaaaatttatggactgatttcttctggcattatttttaatttaattattgatatcaagcattatttgtatagcaagaatattaactgttttctgtaaaaactgtagcaatgaacataaacagttaattcccaagaaaacagccataaaataaacataacttttgatccagtgactacagttataatgtaagaaatgatgaaggatataaacaagggggttggctgcaaagatttacagtgcaccactgttttctcctccattggatacactgcccactgttcccatgatgtaggcacactgaaagctcagacttcactactatccaaagtatccctgtaaccataaaccacttgtacctcgaaagctattgaaatccaaataaacttttaaaaaacattgttttcaatggcaaaatgttataaacaaattaaattatctactaagacagaaataagtgaattatggtcatagaaaactcaataatcaaattctagacatctattaaattgaaattattaaagaatagttaaaaaacattcgtcaaaatatattaaatggaaaaagcatatcatcctacccaatctgaattttatgaaagacatttcctaagtaggatccatgaatttctatgaaaaatgagatttaagactttgtggggaggagccaagatggccgaataggagcagctcctgtctacagctcccagcgcgagcgacgcagaagacgggtgatttctgcatttccatctgaggtaccgggttcatctcacttgggagtgccagacagtgggcgcaggtcagtgagtgcgcgcaccgtgcgcgagccgaagcagggcgaggcattgcctcacttgggaagcgcaaggggtcagggagttccctttccgagtcaaagaaaggggtgacggacgcacctggaaaatccggtcactcccaccagaatactgcgcttttccgaccggcttaaaaaacggcccaccacgagattatatcccacacctggctcggagggtcctacgcccacggagtctcgctgattgctagcacagcagtctgagatcaaactgcaaggcggcagcgaggctgggggaggggcgctcgccattgcccaggcttgcttaggtaaacaaagcagccaggaagctcgaactgggtggagcccaccacagctcaaggaggcctgcctgcctctgtaggctccacctctgggggcagggcacagacaaagaaaaagacagcagtaacctctgcagacttaaatgtccctgtctgacagctttgaagacagcagtggttttcccagcacgcagctggagatctgagaacgggcagactgcctcctcaagtgggtcgctgacccccgagcagcctaactgggaggcaccccccagcaggggcacactgacacctcacactgcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaacactaaaaagcagagtgcctctcctcctccaaaggaacgcagttcctcaccagcaacggaacaaagctggatggagaatgactttgacgagctgagagaagaaggcttcagacgatcaaattactctcagctatgggaggacactcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagacgaaatgagtgaaatgaagtgagaagggaagtttagagaaaaaagaataaaaagaaatgagcaaagcctccaagaaatatgggactatgtgaaaagaccaaatctacgtctgattggtgtatctgaaagtgatggggagaatggaaccaagttggaaaacactctgtgggatattatccaggagaactttcccaatctagcaaggcaggccaacgttcagattcaggaaatacagggaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagataagaattttcaacccagaatctcatatccagccaaactaagcttcataagtgaaggagaaataaaatactttacagacaagcaaatgctgagagattttgtcaccagcaggcctgccctaaaaaagctcctgaaggaagcgctaaacatggaaaggaacaaccggtaccagccgctgcaaaatcatgccaaaatgtaaagaccatcgagactaggaagaaactgcatcaactaaccagcaaaatcaccagctaacatcataatgacaggatcaaattcacacataacagtattaactttaaatgtaaatggactaaatgctccaattaaaagacacagactggcaaattggataaagagtcaagacccaccagtgtgctgtattcaggaaacccatctcacatgcagagacgcacataggctcaaaataaaaggatggaggaagatctaccaagcaaatggaaaacagaaaaaggcaggggttgcaatcctagtctctgataaaacagactttaaaccaacaaagatcaaaagagacaaagaaggccattacataatggtaaagggatcaattcaacaagaagagctaactatcctaaatatatatgcccccaatacaggagcacccagattcataaagcaagtcctgagtgacctacaaagagacttagactcccacacattaataatgggagactttaacacccaactgtcaacattagacagatcaacgagacagaaagtcaccaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaatctgctcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcgacactgatcccacagaaatacaaactaccatcagagaatactacaaacacctctatgcaaataaactagagaatctagaagaaatggataaattcctcgacatatacactctcccaagactaaaccaggaagaagttgaatctctgaatagaccaataacaggatctgaaaatgtggcaataatcaatagcttaccaaccaaaaagagtccaggaccagatggattcacagccaaattctaccagaggtataagaaggagctggtaccattccttctgaaactattccaatcaatagaaaaagagggagtcctccctaactcattttatgaggccagcatcattctgataccaaagccgggcagagacacaaccaaaaaaagagaattttagaccaatatccttgatgaacattgatgcaaaaatcctcaataaagtactggcaaaacaaatccagcagcacatcaaaaagcttatccaacatgatcaagtgggcttcatccctgggatgcaagggtggttcaatatacacaaatcaataaatgtaatccagcatataaacagagccaaagacaaaaaccacatgattatctcaagagatgcagaaaaagcctttgacaaaattcaacaacccttcatgctaaaaactctcaataaattaggtattgatgggacgtatttcaaaataataagagctatctatcacaaacccacagccaatatcatactgaatgggcaaaaactggaagcattccctttgaaaacgggctagccatatgtagaaagctgaaactggatcccttccttacaccttatacaaaaattaactcaagacagattagagacttacatgtcagacctaaaaccataaaaaccctagaagaaaacctaggcattaccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaataggtgctggcgaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttagaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcacccataggtgggagttgaacaatgagatcacatggacacaggaaggggaatatcacactctggggactgtggtggggtggggggaggcgggagggatagcattgggagatatacctaatgctagatgatgagttagtgggtgcagcgcaccagcatggcacatgtatacatatgtaactaacctgcacaatgttcacatgtaccctaaaacttaaagtataaaaaaaaataagaataacaaaataaatccaaaaaaaataaaaaataaaaaaaatttaaaaaaagacctttttatctttttgcttttctacgtattatgtgatgaacatacagtatgtaaatatacattattaattatctaatgacaagaggaaataagctatttttgaaaccacctttccaatttataaatttttcttttaattgcatgcaattaatatgtattaggtagagtaaagaaatgattagaaagtattttcaaaaatgtatagagaacatttgcagaaagctaacaaattgagagtcgtagcttctacctagaaaacttgccttattgtgtatagaagtctggaccatcatgaaccatatccagacctcatggggaaattccatgtggttcaaagagctataatcaaagaggtaagtcattcacacacacacacatacactgtctctcacacacacagactcacacacatccacacacatatgcatacatatacacacatgtatacacccaaaatacaattatggagtagaaaagagaaaactgtgacaaagtgtcctggcttggagttggaatatactcagttctcggtttattctatgaaaggagcccccttacctgttcttttttgttgttctggactttactgtccatgatagtctttcttgtccattttcctccatggtcacatatgccatagactttgaagtcacgtcttggcgactgctttctattaatctggttttgaagcttagccatggcttcagaagtcaagtaacgagaggctactacaagccagacttttcatttctttggcgccaacccctcaaaagtttctgttctatttgcctctagatggttacatattcacgttaccacagctgaagttctcaactgggatcatttttaaacccgaaagctctgatcatttatttactggcctctgtgttcttactactcttatccctttcaatttagtggcagtcattttgacatgtcgtttacaataaggaaaaaagaatatcccttagaaaagtatttgttagtttctggatggtgtctgtggtctgtcaaagaaaaattcagggaagctgcttgtgaggagtttgggcttagaaatcttgtctccagcgacagtatctgttcagagccatctcatacaaaggcttcattttggaataaaagcagttggctttttcaacactggattttaaaacccagaggctccattattagatttcattctgttgacaaccttttcatctcagcgagcaaaatgatgtattacagcccaaattcatttcactaataggactttactataaaaggtaaaaataaccaacatacatcaaatttctgcatttttcttaacatgtgctctgtaggcatacaaactgacttccaagatatcacagataatggatttgccacacatactggtatgacatggcaagtgtcacctgctggcaaacctgcaatatcggcacccttgctattgccacccgaccactgagactatgcatcaagttttaggttctgttaaggcatcccatttccagacactgtactaaggctggtgattgttcaaatgttgctttggactccttagggaatcctaaaacaaacaatgtttaccttaaacaaaatagatgtcacaacaagcccaagaaagtaggtcaagtctcctctgctaagccctcagggacacagacaacttctgtcttgtgtccctttaatcttcaagagaagcttcttccatcttttgattcaagacagtggttccagtttctaccctgggaatggagaacaagaccgtatcacatgctgttaaagcacagcccaaaatgtcatagctcattttcattcagatgtcattgaccatagtttagccacatgtccatacccagctacataggaagctggaaaatataatccttagctgtgctgagtccaaaagtctatgatgtatgaaaaagggtgaatgtattgtgaggaaaaaactagcagtttgtatcacttacataagatgcatatttaagtaatcaaaatgatgagtgccccaaaggaaaaattggcagacagaagcaaaaaactctaaaaagaagaaagaaaagttattaaaccatttaaaagtaaacctacctagagatccaagaatgcaactggaaacagtgaacatatacatatttctatcaaatttaaaatagtctaaaaaattataatacctgttgtcatcatgatttcagtgagacatacatctccatattgttagaagtgtgtaaatgcgaacaaactgcaggaaacaaattggtcatctgtctcaagagtgtttacattatgcagtccttttgctgcagcaatttcatttctagaaatccaccttaaggtaacaatgatagatgagataagcgattttcataaaagaatgctcactgacactgtatttacaattgcaaaaatttaaaaatctaaatgcccaataaaagagaatgacaataataatcatgattgagacacatactagaatagtaatcagctgttaaaaatcatgtttcaatagaatatttggcaaacttccctaatgcaacactcgaataaaagtaaaactaggatatgacattattttataaaatggagtctaaactgtgagtaggtattaaattttatatcaaaatacctcaaaattataaagcaaattgtattttttatgattttttgcatttccatgttatctacagtgtacgcgttttaatttaatagatcagaaagtcaatgatgttatattcaaagttattcagatgaagatgactatgttcctcaaaactcaaaactaaacctcagcagattatcaggaaatcgtcttcatttgctcagttcataactgactctaacagctgcttgttcatttatattttctttacttctctttttgctgaacttgttaactcaatgaattgatagatatttgaaaaatgagtttcatatgaaagaaaattcccttactcatcctagtctttctttggctaatgtattttgttattcattacagtgtcctgcccacatgcgtagtggcataaatgtctgctctttgagctcagtcagaaattaatacttttacctttatgctgatttttcataatatatggaatgagttaatgggctcaaattttattttcaccaactaaaattacggagaagaaaattaaaggcaaaaatattgtttaaattgacatgaaaaatatattttaagtaatcacagaatagcaatggttaaccttctctgattgtgccagataccacactaagtgcttagcagttcttggcctattgtgtcctcacatcaattctctgaggcaagtgctatgattagcttcattttacaggcgaggagtctgaagcacaaggagttatatacttgtccaggattgctcagcagtgaggggtggagttgcaacccaatccaaggcaatgtggctacagcgtctgcacatttggccagatcacaacactgtctcatcatatcaagaacgatgatagaatcacccataagttttcaacagcacagcctctggtaacaagagaaagttatgtcctcccttattacagctaaagaaaataaattgcttctatgttgataccatcagagacagtttctcatttttacttttagcagatctgctgtggtacatttgataactcggcagaatccaataaagggaatgacagagggaatatcagattcagaacagacatagctggtcagtggcgagaacaataataaaacatttgatcaccttgagtagtaagcactacataacatcacgatatgcattcatgaatgtgtgtgtgtgtgtgtgtgtgtgtgtcatgtcttgatatgccatatatctgtcctttgaagtatcttcttcaattcatcatccagcttcaaattcagacctgcaaaaatgctctaggcaaaaggtgtcctttcaactgatctgtttgttattgtaatgagagcacattttatgtgcatagcccaatattttagaattaagagcatatacaaaaaatgatacaatattcagtgaaatgttcatcaaatccatccagctgcaccagaggcagcttttatgattctcaaaaggaaagtcggattccttggaacaataaaacaactgcacttatgtaactgacatttgatgaggtgagacaaatgttccttcagatttccagagctggcatatccaaagtagcaggtcagtgtagagcagtgtatgcgtgtgtgcatgttgtacatgcacatcagctactgtttggtctaataattggagcccagctattgtgctggatgatgctctgatctaattattgcattctgccatttcaggtaactctgacaagccatcctgtgcatatgcctcatgactttaattgcaaggagctgaaaataaagctatttctcaagttttttgtgtcttcaagtgccacagcatccagctctcagaactctttacattccctttatgctctatttagggtttcattgaaatctattatatttcacatcataatgagaggggagcaatcaagttgttttgaaagatatcagcaaatatcttggaccaaattccagaggtagttttaatgctcccaggatctttttaacattaaaccctattgacctaggatctagcaatcactcctttcacagtggccaaaaaatatacatgtatctgagatctgggggaaaaataatgactcaaaaatatgaaaaaaataaaattttaaaaaattatgtaatttctgccaacacagcactgtgtcatcctgtgagctacaactcaattattagttacatatgaattttgttacattcattttgatgttgatatattttaaagagtgagaaataatgtacaattgtcatcataaattgaaagaacctaattgcctaaaccctattttaattaatagtaggattgtcacaattctttaccctggttctccagatgttcaaatgtatgagttaatcatttaacataaatgatatatatcattacggtctgttgaaggttggctagtttgggttaaaaatcagcttctaagtctggtccctaccaccagttacacaagggcaattagaaataagcagttatgaaaattctgctacaaaaccagaagactcttttggcatgctgaactttatcttatattcatagccaaaggagaagcctctttttcattaacaattatcacttttgttatagccctggttcataaccttggctgcacatcagaatcccatatagagttttcaaaattacatacacccaggcatcacccaacacctctgaatcagaatctcagaggaaggcccaggaatttatttatattatatatatttttttaaaaattacaggtgatttagatgtactgctgctgtgggaagaaatagcctaacaagttaaaatgggcagatgtcactgatgccttatcatcaaaatgaacttcaatgcggctgacggtgtcgttaatggtgcaatgtgtcaaatttggtcatgttttcaagtgccatttctggttacgttgctgccttgttttaaatggactgaggttttttgtaacttcagttgcagacaatattttctgagagtgcacgagaaatatcaattttctgcagagattataccaccccctaacagagtggaaagccactattttacttctttaatgctgacaaggcatctaaagggagaccatttatctttcctgatagttcaggaaaaagacaaatgcacgtctccttactgtattatcaaaaccaaacaaacaaaaaccaaattaactcaccaaatttgtgaaacaatgacacttgtaatgagagccttttgagataatagaataaaaatattacctgttaaaatgtacacactacactttgaacagaatgacagtttattctcttacattctataaccttaagaatgatttgctttctcttcatcttcactctgtaagaatgcttaccaacagacaaaaagaaacttcccgaattccaacaacaaagtaacaatggatttgaagaaagggaaaacagtaatctgacaacattcagtctttccactgatgacctgaccctttcaaagttgtccaaaataacaagtcaagaatcacttgaggtcaggagttcaagaccagcctggccaacatggtgaaaccccgtctctactaaaaatacaaaaaattagccggcgtagtggagcacacctgtaatcccagctacttgggaggctgaggcaggagaatcgcttgaaccggggaggtggaggttgcagtgagccaagaccgcaccactgcactccagactgggtgaaaaagcgagattccatctcaaaaaataataataataaataaattttaagaataaaccttttgtgttagggtcctggggctcctgaaacaaagtaccacaaacagaatggcttaaaacattaaaaaaaaacaaaaaacaaaaacaaaaaaaacaaaacagaaatgtaatctctcattgttctggaggccagaagtccaaaatctagatgcccacaaggttggttccttctggaggctctgagggaggaagtctgtttcctcctggcttgtttgctgctgacaaactttggtgttccttggcctgcagatgcataatttcaaactctgcctctgtcttcacatgtgcatctctgactctttcggttgccttcttataaggacactggttgcaggatttcagacccatcctgattcagtgtgactgcatattaacttgatcatatctgccaaaatcgtatttccaaataacgtcacattcacataaggtcctgaaggttaggacttcaacgtatattttgggggaacataattcaatccacaacacatgctttcattaattacacagttttaaaaaataacttgctaactttgagtttgagtaaagtaacatttcatttacattcctgaattcagccccattcaaaacaggcgatcttgagtaagctacttaagcctgctcagcctcagttgactcatttgcagaagaccatctcatagaactcttatgaggtctaaatatgacagtgtatataatgcacataatactactacttattgagggcttattatctaatccaaaagtattctttaaatgaacaaattgacacactaaagatttgaatgacttcctaatggcaccagagctaggagtgaaacacctaaatctaaatcctaaatctagaatactttcctaaatctagaatactttccactacatcattttgtgcttatgaaattataaaaatactggatcatttttccatttatttctcaatgttatctatgttagtgagcctcagtcagaagaacgacaactttaaaatttgctttgcaatacaggaagcaagcagatatgctatgtgtgatcttatttcaataaagttgcaaagtaacacaaaccaagtattcacacatacacagatacaatgcctctgaaatggcacctaaaaacaacatgtgtgtagtgtgtgtgtgtgtgtatgtgtgtgtgtgtgtgtgtgtgtgtgtatacttggtttctgcctctttgcaaccgtattctcttctacttataaagtagtatcctcatttcttcagttttcttcagctacaaggaagcctggggcatcaccagccacaagcttggccaacttcaatggaggcagccagaataaaaaatttgacagggctcagttaaccagcactctttcaccaggaaggcatttaaatttgttaactgcaagtatggcaagtataactctgccagctttacttatgcaataagcttagtaccttcaaataaagtgaacttaactccattactagaccaggcaactcaactatttcaggtttcaataaaccacatttaactctcacaatgtcaacttagctataatcaatgtcagcagaaaaaatggttttgttattaatataagagcattttgagctaatcatattatttactaattaattcatcatttcttggctactttgtcttttaatacttggttttaatctttaaaattgtattatgatcaattaaaatagcctgatttaatttcgtctagctttttttgaataaacataattgtttttaaaagaactgttttattgtgtaagtatatttctgcatttctagatgtaatgggaactatttactctaaaggaattaagagatttattgtcaagaattctgctgtgtcataaactaaaacataaaatggaaaatcactgtgaacttactatgaaaaagtgataaactttgttgtctaatgctatgattcataaagctttactcaaaatcctctggctcaattttagaaaccttataatcagtttttctgtttaaacctataatcacttccatttttcatgtcagcagtttgtgacactcagaattccttccgaagtattttaatttcatcaaaaatatgtaacacagataagatccccttctacagcacacaggataagctttctcactgttagcaggattgtcctgtctttttcaggtaaatcttctcaaaatgtaactcacctgatacttataaaaggtataagcattattataaaggtaataattttgatatttttgtataacatgcaataatctgacatagaggtattagtaccaccaattattttaaaagatctatgcatcaggcaggttttgtagataattcaaaatcatattcaaaaagattaaatgaattaagatttaattacccaaatattctcaaaatgccaggcagtatgatagctagtatctattcctcaaatcacccacctcagtgattctaaaagaaataaccccatagggaaatggcacaagaaacatcaatttgatgttcaagacttggttgatcttgccatttatgcccctataatttctatcttcttaaaagcaagaaaattttgtgcttcaaatagcatgagttcactcttatacagcggagggtaattcaatatgtggttttcttccaattcaaagcaaggagagaggacagcaagaggaactttgcagtaaagaaacccaacagacactacttctgccagttggtcaaggtcaacatcaattatcacaagtcatgtcgatagtatgcatccttgatataaggagatgaaaatgatgctatatctgttcttccttccaataactatagcaccagttttatcataagaaaataatcagacgaattccaatattgggcaacctacagaacatctaaccaggattcctcaaaattgtcaagggcatcaaaaacaagagttgtctaagaaactgtgacagctaagacaagcctaaagagacacggcaacaaaacgtaacgtggtatcctgaatgggatcctggcgcagaaaaagaaacactacgtaaaaaactaaagaaatctgaataaactgtggatgtatatgttaataacaatatacaaatattggttcactaattgtgacagatgacccacactaatgtaagatgttaataataggggaaagtgcacacagactatatgagaatcctctttactggcttcttaatttttctgtaaatctagaaatgttctaagaaaggaagtccattagaaaaatcccaaaagtccacccagaaaaaaaaaaaaaggcgagtgaaggcataaaatgcattcacacattttcaacaaaaaaatctactgtgaattaataagatatccttaatcatttgccaagagaatatattgatattctttatccatgcagagattttctcttttttttttttttttttttttttttttgagacagggtcttcttgctctgtcacccaggctggagtgcagtggcgcgatctcggctcactgcaacctccacctcctaggttcacgtcattctcctgcctcagcctcgcgagtagctgggactacaggcgcgtgccaccacgcctggctaattttttgtatttttagtagagacggggtttcaccgtgttagccaggatgatctcaagctcctgacctcgtgatccacccaccttggcctcccagtgtgctgggattacaggcataagccactgcacccggccttccctttctgtcaaacaaacaatgaacacatgtgcaatgatattcagcaaggcaatttagttagaagaggatacaaatcaagaattatgcagaaaatataggccaatggggctagtatcattagtagttttaattagtagtttcttgctattaacctaggtatgtcatcagatgggctccttaatgaattggtcctctttcttgctttatgccactgggctcaactcaatttccctcttaaaaatttgccaaaaacaaaagcaactgtccatcacatgacacgtaaatgggagtacatacctatttcatttaagcaaagcacacttgttaaaacacaactatttttacatgtcagcgaagatggcattgcgagttggcacactgctctcagcttctcattaccacccttcttgcttgcttgcttgctttctcttccttctttttaatgtaaaattctttgctgaagcataacaaagaaataagaaagttcagcccaatggattttcaaagtgaatacatccacgaggtaagcacctagaaacagagcattactgaactcctgtagccccagtgtgtccccttccagacagaagcctccaatggtaaccactatctcaagatctaaaagaattggtttgttttgcttgttttttgaaatacatataaatggaatcctatggtgcatattttttttgtgtgggtccttttagccattattatgaatcctatggtgcatattttttgtgtgtgggtccttttacccattattatgtttgtcagctttatccatgccactgcattttaaaaatttttctgtgattgaattatgccattgtatgaatacataacgacttacccattctactgggttgggttgtttccagtttagcactgttgcaagtagtattgctatgaacgtggctataattgactgttaccctctggttaactttgctgcacctccatggcctagaatctccaggaaggaagtcaactaaatatttcctgaaatcacaagcccatgtgtttgtgcaaaatcacttttaaatttctgcatacctttaatgatgccattcaaaaagggccaaggccacatttttctcagtctacctggtaagtgatgaaagtgttcctctaagtgtaggcaagcaaagaagaaggatggtggtattgaaaacagaaagggctacacttcaggcaggagagaagcttagcattagctgatgtcaatgcagtgtaacgagtgggcatttaatgttatggttatggtataatacaagaaaccaacagagtcctgaacaaaaataaattcctgctcttggacactttacccagctattgccacacaataactttggactaattactagacctgtttctttggtctctgatgacaaagttccccttcaagaggatttccgctgctttccagccactaaaaactctaggtggtaagtgtatatgtgcatgtgttgaaatcctcatacttgaagtagatcttgttaattactacataattgagttaatccaatgtcgcagcaaaatattcttctgaatcccaagttgtctgaggtacaaatttgtcactgaacatcatctgaaactctccatgcaaaattcgtttactgaagcccaggtgagaatctgtaaggaataatttaagcatatacagacagtccccaacttaagacggttcaatttacaatttttcaactttacgatggtgcaaaagcaatatgcgttcagtagaaaccatatttcaaatacccatacaacccttctgtttttcactttcagtataatatttaataaattataggagatatttaacactttatgataaaataggcttcacattagatgcttttgcccaatggtgagctaaggtaagtgttccgagcatgtttaagataagctaagctgagctatgatgtctggttaggtgtattaaacacatttttgacttaatgatattttcaacttaccatggatttactgggatataaccccatggtaagtcaaggaacatctatatatttattttcagcatgtattaatcataatagtattttaagagacattttacaagagagatgaattatagattctgaggctatgacatggccattaaataacctctgctgacaaataaattcagaaaacccttagaaaagaaaaaagttattctccataatttcctctaatgttgactaaaggaaaagaaagtaatcaaggtaccaactttttctgagttgaagtaaaattgatcacaaggtctttcatctgtttatacccgaggctaaagattgcaatcaagctaagaggtttcctttacaataacgtgtaaaaaagatgcttttgtagagagaatttagtatagcctcagagttgcacatttttctaaacctccatagtaggaacatctctgagatagagacaacattggccaaaattttaagtcctcaaacctttagcctacacattacctccctaaaaggggccaaagaataaatgcagagggccgggcgcggtggctcacgcctgtaatcccagcactttgggaggccgaggtgggtggatcatgaggtcaggagatcgagaccatcctggctaacacggtgaaaccccgtctctactaaaaatacaaaaaattagccgggcatggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaaaaaaaaaaaaaaaaaagaataaatgcagaggaggcgagtgggcagagagacatttctcaacactaatcatgattgggctccaaattcttgtcttctctctcactcttgagagaggactggatcagatgggtcaagaatgccatttgctcctagagcacacataaggaagatgagaccaagtttttggataattaaatattttaccaaatgggaaaggcttagaaaattactagctggtaatgagcatgcaataaacatgagctttcatttgtatcattccctaggctcactacttgatcctgaccctatagcttttaatattctgatggtgataagaggcataaaaacataaaccaataaaaatagttttctcactagagcatctcattctgtcatttcttttgtgtcctaaccttaaccatatttggcttctaaagttgcagaaaacttccccaggctcatttgaccatatcgatgtcatggagttctgagagaaagaattcagggagaagcatgattaaagaagggagtgatccctgcaaaagatgcctaacaaatatcaaaacttccccaggataatagcctcaatgtgtattacgtattgtgattaacagctcttacagtggtgcaaggaagcaaaaccaaggggaaggaacaaatcccaccacaatgaagagaggtatttgggccatacaaactcttataaaagcctggttctctactcaagagtctgaggcagaaggattgcttgagcctaggtgtttgaggttacagtgagctatgatcgtgccactgcactccaacctgggcaacaacatggtgagaccgtgtctctaaaaaattataataataataacattaaaaaaagttctatgagctgggtttaacatgtgctactcacaaagtgctttctgtagtataaggataaaactacatccttagaatcttcaagacagaatgctatttatttcccattgtctgtcaacccgaagttgcccccacaaaaacggaggatctaaatgtcagtttaaaatggggcttacatatgtatacatgtgccatgacatgtaccctaaaacttagagtataataataaaaaaaaaaaaaaaaaaaaaagaaaaaaaaaagaaaaatggggcttacaaagtgtgttccattcctaatcacttttgcgaatttgctaaatagtccaattaattggttttcttccagatattttctggttctgcaattccattttgaatgtttctagcatactttgatacaaaccaatcagcaactaagcccatagacaacaataaaataactccaggaaaaaaaaataggcatggttggtgttggatatgaacaacaaacaatatgtgaacataagcaaatcattagggaaaatcttcattttctccgatattttcattttgatttaataggcacagaaaacatatgctacaattatggaaggtaatacatcaaatgaaagatacatcacataacacaatgagcctttggagatgtgtgaaatgatagcacaaggccctgaaaactttaaaaatagaggcattctgagtctctgcaaacctttggagaattaagagaaccaaataaggcaatttattactttctacagcttacaatcctaagagatttagggaatgtacatttatatgcttcttgtataaggttggttaacacaggaggtcagggtattttctttacatttcatttctgtagaactcttgaaattacatagatttgaatgccagagggaaaatagaagtttccgttgcatgtttgataagaagcatttcaagttaaaggtcaatggtcaatgttctgatgagtggcctacaagcccgagcttttgcaaataatggcatgtgctttccttctccaaaaataatgacaagcagatgagaagggactcccagatggggaggccaattgaagggcaaatgagcctgtcctgcacttgaaaatcagagcatgtgacagagagcaagtaacacttttcagagctctagtgggctgatttgcatccaaatagcaactcgagacaagcaatccattcttttaatatatattatttgtcttttggggcataggaggctatactaagaaaccatgaatttcattcctcaaaaagtttaccatcaaagaaaattataggaaataaaaattactaggtacctaaacaaacaaacaaacaaacaaaaaacagcaaaaaaagaggctcaagaaaaataaatttgttggatcaaaattttacatattagaaaaatatatatttgtgcaaatagtaaacccaatctaatgtacaaaaactttaaaatattaaggacatccaattggtaacacaatatgttgctattaaaaataatagagtacttctagactaactataactttggtacgaggatcttactgtttccttcaaatcccaataaaagtgatgaaagaaaaataaaatagaggagtaattgcagaacattgaacagaaaatcaaggtgacattcacgtggcgcaatctttgaggtagttccacataaattcctaaagatctagcaaattctttgaaaatcatacatttacataatgaatcctggggggacaggaagaatatggaactgagagcaaacagttcaaaaccttgttgacatctgctgtactcagaggcaaatgctgtgagataggagttcagcagactccgcagataaaacaggatgcagtaaagaagctggccaaacctcccaaaaccaagatggcaaaaaaagccacctctggtggtcctcactgctcattataccctaatcataatgcattagcatgctaaaagacactcccaccagcaccacgacaatttacaaataccatggcaacatccagaagttactgtacgtggtctgaaaggaagaggaaccctcagttccaggaattccacaccccattcctggaaaactcatgaataatccaccccttgtctagcatgtgactaagaaataatcataaaaatagtcaaccagcctatggagtagccaccctttcattcttttatgtcttaataatttgctctcacttaactctgtctgctcactcttgaactccttcctgtgcaaagcgaagaacctatatgacttctcaaactgaaccccaactttgaggttcgccctgtgacacaactatgtgaaataagaagcccagtggtggagcctttccctgacatggtaggccgtcctccaggatgatggtggacaccatccttgcccgctcacattctgctgagaatgaaggctcagtaaaaaattacatatgaaagctggcctttgccaaagaagcatagctgtctacagagaacaaactgtactaaaataaagtctgtttatttccccttatcccaggcactggatcatagaactgataacgtcaccttttatcaacaatttcttctgcaaaacatactagaaaagaattttaataacatccttatggacagtgagaggacacaaacaaagcttctgactacgtttctgatgaataccaggctgcaatggtgtaccaacaaaatccaatatcacacctggattttactgtgcgaagttgaagaagcaaaagaatattgcttggtattgatctttcctaagaaaacagaggtaaattatgatgtattaataagtttacagtaaaattctatgaaagatgaagtacttaaaatagggaaaaagaaaagatgataaaatagtaaaacagagctgaataagacacagaaaaaaatgtaaaaaattagaaatgccatggataaaagcagccttacagaagccaaaatacatcggaaggtttcatctaagatatgaaattaaccaatttactacaactaccagaatgcactgaaataagacagagatgaaaactgcaagagaaactatgataggctatttgacatcactgaaaaagagactgcaaaaaaaataaatatatttttaaatatatgatatatatatttttaatacatcatatttcataaatattatataacccctgagatgaaggctacaatcttcatatctcaaaaaactttcaactttccagaaacaaaatttaaaaaataggggaaaaaacctaacataccctggtaaataaaactttagcatcaaatccaaaaaaaagtcatacaagcaaccatgcagaaaaacaaaagaaaaatataaaaactcgccatagactcttctgctttattatttgtaagaacactatgaaacaagactacagatttgtgagaagtaaaacgttataaacagaaattctagaacaaacaaaactgaatgtttcacatattatacaacaaagcattctcaaataccctcataaagcaaacatatgttacttacctttaaaaaacaatttagagacatattctaggtaaccatgagacagattgaaatcaggaactcaggaatagagaaatcaaggtggagaaaagttacctgacagtgacgtctcatcacctccatacacagctaagtctaaattgttgtaaatgccattatttaaaaagaatggaaactgtataaataattattgaatagtaaatacatactacaaaatattatataataaactgggaatattttgcaaagtgcataatgaagatagtattttatttgtaaatatctcttacaaattttaagcataaacactactgttaaaaccaaaaagaacacacgaaaaccacacacacacataaacaggctaaatcccaaaagaaaaacaaagccacataaccatttgtttaagagatttctaaagttataattttaatcatctcatcttggagtgtaacaaaaagagaaccagctatcagcctgtgtatcaggaattttccgcagaaaatttgtattactttctcttcctaaagagacgtaacagacaaaattattatgtgtaggttacatattgagcatatcttatttttaaatatataataaattattatcattgtgtacttacctgtaagacttggccagaagattatatgactgaaataaaaacaattgagtcaattagaatttccagtttctacctggcaattctaaggaaacaaaccaacgacaagagccaatgctgatgtaacaacatggtagaaatagaacagtcaagaacactgtttatgggaacgtaaattagtatagccattatagaaagcagtatgaagggttctcaaaaaactacatatagggccgggcgcggtcgctcaggcctgtaatcccagcactttgggaggccgaggcgggcggatcacgaggtcaggagattgagaccatcctggttaacacggtgaaaccccgtctctactaaaaatataaaaaattagccgggcgtgctggcaggcacctgtagtcccagctactcgggaggctgaggcaggagaatggcgtgaacccgaaagtcagagcttgcagtgagccaagatcgcgccactgcactccagcctgggcgtcagagggagactgcgtctcaaaaagaaaaaaaaaaaagaaaaaaaaaagaaaactgcaaatagaactactatataatccagcaatcccactacggattatccaaaggaaaggaactcaatacatcaaagggatagctgcaccccatgtttactgcagcactattcataatagccaagatatggaatcaacataaatgtccatcaacagatggtggataaagaaaattgtggtatacatacacaatggaatactgttctaaaaaaagaatgaaatactgttattcacagcaacagggatgagtcatgttattaattattaatgacttattaagtgaaataagtcaagcacaggaaggtaaataccacatgttttttactcatatgcggcagctaaaaaacaattgaactcatggaagtggagagtagaactgtaggtattcgaagctgggaaggggaggaggagaggatagggagaggttggttaacgggctacaaaattgaagctgcacaggaggaatgagctctggtgttctgcagcactgtaagatgaagatgattaactgcaatttattgtatattttcaaaacgctccaaaagaggattctgaatattctcaatgcaaagaaaagaatgaattctttgtgatagagatgctaatttccctgacttgctcattatgcattgtatacacatacggaaatatcactctgtatgccataaatatgtacaattatgacatgtcaactaaaaataaaaggaacaaaataacaacacttttaaaaaatttaaaaaagaatcagccttttctgacagtggctaaggaaaagtcaacaacctcaaacggctataggtaggcagatctgctaaagtatagattttcagacatttgctaggagaaccaaccaagatttccccctaagaagtacctgcgaccaaatctcagcctcaggagggcccaagagaggtcgtcagggccatattctttgccagccacactcaaagacaaggtccacactgtgagccctgggatcataagtggacaaaggggaataagggatcggtggtactaggattgacttttttattgttttcattttctccaatgaacatacataatgtttccattcaaaaaacagaataatatttttcaaatggttgttgcagataatatgtgatatgggccacattcatgacataagtgctaagtgtaaattttatttacaactctgaggaacaaaataagcttggaagggaatatttaaaaacaaaatgacatgaacagtaagattatgaattattaaggtttgtcctctaatgtctaaacattccataagatggttatatgttttaatcattttagatattttaaacataattggaatccaatcattctgcaacacatatatattaagacatatgtaccagaatagtatcatatcttctagcctttaaacagattacaggaggatcaatgaatcttaatatatattagaaggccttttttgattcgaagcattcacaaataataaaataaacctggagatttaaaacggaggtgattttcaaaggaacatttttttttggaacccactctttttagaaactgtagtagtaatcattgattaattattggcattgctggaattttacaagtgacaaatttcacatctaatcatggatgacagaatctccaaagactggatatattgcaactaaagcaatcaaacaaatacaagttattttggatacagcaaagaccacagaaagactttaatgaaatttcagtaatccttgctaggagagaaattcacaaggccagagaaccctaacttctgaaactattgttcttcagagcatttgaagagcccattgtcagagaaattgaagtggatctggcttttgatttaaaataagttcctatcatgaactgtcacttccaggcattccaacctcaggcacatgatgagctgtggatggcagaagctataatcagaggtaaagcaactggtgataaagtacaaggtgccataagtttcaatataaatcaatagagaaattccatctctatccagttaaatcatttctaactttactgtcttacaggaaatacaacctgtgtcaaaagaaaggcaaagtcagaatctactgctataattcctataacgtctattttcttaacagtgcttcagcaaactcttttggtgctgttatgtgaaaagtatctccccttaaccctgggtgcaagggtagaatcccattgtgttggcaggtaagagctcacagctgctcccttctccaggaattgccctcagctggcaaaatctgctttaccacagcctccttagtcatagccaccagttaatgactgagtgattttggagtacaaaaggtcaacaaccttgccattcatgcagtgaatactctaaagttcccagctccccacgccccacacacatacccagcttccatgtatcagaccatgcccagccttcatctgataccacatccttgcctggctctttctccttcccttcttccctctcttctctttccttcttcactccctccactaagggatttttcctgaagatcacttcctcagtaaataaatcactgtcacctgaattcctatttcaggcactgattctacagaaccaacctaaaacagaacaaaaatgaaaataaacatacttaaaaatcaaattaaattttaagacttaggctgcacaaatctctggatattccatcaatgtgtatttgaccttctttattcctctcccgaagagaacttctccagtgtatcttattccccactgcctttaagacactgacatcggttcaacaattgtatgttgacttcccaggtgtatatgacaatgcttaagactattgctaagcacagccttaatgtttggaataacataatgacagcaagattcaactcctagctctaaaaaaaaaaagaaaaaagaagattccactcctgacatactcggactgcagttttgtatccaacaactctgaaattagtaggagaagaaaagatacactctctgcccctcaaatatttttatcctttacaaagcagaaatgcagaacacctttgatgccaagtgttacttaccctacactgcccttcctcacctttctgtggctcctaaaccacttaacatggtgtgtggtggctcaggcttgtaatcccaacactgggagataaggcaggattgcttgagcccaggagtttgagactggcctgggcgacgtagcgagactctgtctctacaaaaaaattcaaaaagttagtcaaccatggttgtgcgtgcctgtggtcccagctacatgggaagctgaggcagggggagcacttgaaccaaggaggttgaggctgcaattagcagttttcacaccactgcactcaagcctgggcaacagagaaagacccgtctcaaaaaaaaaaaaaaaaaaaaaaaagtgagagaatttgttttgatttgctttaattcctcctaatgagagttttaatttccatttcaatcattggggaaaaattttttgaaagcatctgctctgtaccagggcctggagattagggtaatgaaaaaacagacaaaatcctttttttttttaaatgatgcttacattctaactgtggaacacacacacacacacacacacacacacacacacacacacactaaaacaaaacaaattgtgttatatccagacaatgaaatatagttcagtactaaaaagaaataagctatcaagccatgaatagaggaaacttacatgcatgttactaagtaaaagaagccaatcagaaaaagctacatactgtatgattccaacaatgttacattctggaaaacctaaaactatggagacagtaaaaaagatcaagggttgccagaatttcggaggaagaaggaaggaataggcaaagcacagaggatttttaggacagtgaaactgctctgtatgatcctacaatgttggtgcatgtcgtacatttgtccaaacccacagaatatacaataccaagagtgagccctaatgtaaattatggactctggatgataatgtgacagtgtaggttcatcagttgcaacaatgcaccagtctggtggcagatgttgataatagaaaaggctacacctgtgtgtgggcagaggctatatgggaaatctctgtaccttctgcttagtttagctgtaaacctaaaactactctacaaaataaaacctacttgaaaaaaaaaacagaatgcaaataaaattataaattctagtaaagaagaacatccaaaaataactttgtctctaaattttaatataacattttaaacaaattattttttcctccataaattgcattctaggccaaggagcttagtagtccttggaatgttttagtaaaatatagattgatcaaatatgttaatatgaccttatttccattacaactcagagaagggaagagtatattcatctaaagaaagtaatggtttctccagtaaaataagttgaataatttcataatttaacagtggcattatttgaaatagcaaatacttgataaaagatttatctataaaatgcacacttaaactataaaaatattattagtatttttggacaattagctattgttctgcacaatttcactaataaaaatttcactagcaaaaattaaaatggctataagtagctaaaaggtgcagactgtgaaatcattcctcaatagtggtcacttaaatgaactgttctctcaatgtagatggtaggtttacccaacagttgcattgcccaattatttgcatactaaccgtgtcttgtgaacactgcagcatccatcacagcctttgtttcatgatccacattgagactgtgcttccaactggaccacaggagtaatggtaactttgagattactttgagattaacaaccagatctgaaaaaggaatcacacacagctctagctgcaaaagggactgtaaactctatgagatggtacaatgcttgaggaagatatgacatatccccagcatagaagatactaaataaatgcctatggaatgaatgaataagcaaaaacaacatacacttatattgtgaaagctcgaattttatgctccttcgtgttcccaattaactcagaaggaatacttcatggaatcatagaaaattatttccccagtgataaagaaaactaggttaaactagaaggcatactataagtcattttgtaactttaatatataggttaatgattattgactggagtttgagattaataggtcacacttgctgtagctgtaaaaataagtactgtgtaaaatatgtaacatctaaaatgtatttaataaaggaatgtgtctaatataaatattttcagggatattttattaaatagatttttctcacatctttcaataaggagtcaggcaaaaaacatactattctatctatctatctatccacctcactccttttcattgctgaatcccaaatttgctctgattaagtggtagcattgattctatagctggtttcctttcttgactatttgaggatctcctatagttcactcttaagaactttgcaagatattgcttaaattctccttcagtctagccagttttattctgaccttctataccttctagatatttacattgtcttttcatgaacctacatttaagtttcacaggtgtcttttttttcttgcaatagcttcattgactttgcctgtcagttatgctatgaaaacttgcaacagactttatatacttactatactcatacttaaaaattaaactaattatttaactaagattaaacataaaatttattctttatcaaaaaattaaaataacggaaaaaataaaaataaaatagaaaaaaaatagaacatgtggaaaatacaccaaaaatataaaaaataaaaacataataaaaatgaaatttatgctcatcaaatgtacagatttcagaaagctggaaagtagaataatatatcagttaggtacaaaggtaattgtggcatttaatgacaaaaaccacaattacctttgtaagaacctaataataaaaccaaaattaaatatcactatgagagattggatctcaaactcaaaaggtgaatttaaagccctgtatttatgttcaaaaaataattacataagtacagaatgagaagataggtaacatagctaaaattcacttggaaaaaacataaaagttttaactgtgaactcactaggatcaattttaggatgggacaacttgaaaactaaatccagtctagctgcattgatagaagtcatatgaaagtaaaattctactgcattctagtgcttctcaaggttttctcaagaatattttccatctaaatacaacttttaagaaaaaatcaccagtggtgttttcaaccttaatgcttcatcaatttgactcactgaactgtgtactgaaactattggagctacttaggagtgagataaagtgctccactgagaaaatccaaagagtgggaagtcaagaatgagacagcaagtagaaaatgtgaaatcattggggtgaaaaggaagactccaacaaaaggcaataaaatagcattcactcaaatactgatgaaatgttctccattatccatatgccagcagctgaatgacaccaacaccatgccattacctaagtaattgcacacatttgtaattcacaaagaactaaatggatatctgaatttatcttattttcatctgccttctattcgatttgtcattacaagtatgtgaattgttactgtttgtgtaactgctcctgatacatgaaacgttaagtagttagcaccaagaagatcctaacacatttcaacattacatcatggctggtggtgaaatgatattacatttacttttttttagaaagtttgacttatatagtgtgcatttcagtgaatctgttattaatgatattttcaaacattatataattatctatttcaagaatcataaccacttcccagaaaatggttctcctattcattgaagaacatatgaagtatattctgcatatgttgatatgtacttgagagataggagaaaaaaagtactatttctgtatcacatctatttactgatttgaaatactattattattattattgcccaaatgtttattttgcaataattataaccacactaacatctacccaacaactaaaaaatgaattcttagtcttctgtaaacacaataagcatcacaccattttaataattaaactgaatgccttccctttacatttctcctacttctccaagtcatctcagccccagccactctctaagtaaaaagaggagaaagaaatagcaggtatttgggcaagtaggtttttttacactaactaacattgtttccctcataaaagcaagctacagataattctttcctgtattcttaatttctcagcaccactagcaggactagttcaaaaccatggtacaatatcaaattcaagtacgctaatatcataataatgaggatccctgttaaaacatcactgaacattagaatgtaatttaatggctgagtggcttgaagaatttaatctccttcctcaacatggcacaagaactgctgctactttcagcataaaagtccagcagatggtggaaagtctagtctgataagtataacaggcttcatcaagtacagaaggatctgtatgaattaaatgtattacacttaaaggtattacataaataaagtcactatttcccttcttagaaatgtcttgtcctgacttttccaactttccttttctcccaaagggaaaaataaacaaaaatccaacgagccgtgttggttaaacattcacatcattcctattgccatgagtacacagctcaacacacacatgatttttaggaatatataaagtaagtcaaaagggaacagacaagagagattgagactaacttccagacatttaatataattattggatcaatccagacaataataaaactaatttgattcttcactgaatgatctgaagaaatttctctttgatatcataatctctaaagggaagaaataatgagaaataggtcagtgaaatttaacactggatatcacaagaatgttatggattataccttccaccaaaacatacagagcctttttatgagtatccatgagaaaaacttcactatgattttagtaccagaaacatttctcatttgaaacttatggacatcatgattatttcaactgcttatgtttctctgtttgttctagctactgaaaggtccaagccaaagttttaatccccttcttacaaatgaaaatgactttctgtgatgcttctgtccctgaatctttcatttggcattagattatcttactatttctttccctatacctcaggtatgtccaaaagtcaactccggttctctaattctctttttaaatgtatggatcaaagtttaggtcttactccattttgtgttgctataaaggaatacctgacgctaggtgatttatgaaaaacaaaaaaagcattgtttgtttggctcatgattctgatgcctagaaagttcaagagtgggcattggcatctggtgagtgcctcaggcgtcttccactcatggcagaagcctaaaggaagccggcatgtacagatatcacatcacaagaaatgtggaatccgccccatcaccaaaacatacggtttggaggggataaacatccaaaccatagcagtatgtataaacaagtaaattgtatattgggattcttattgtttttttaaaagataatcagtataatcctttaaaagaaacaagcttttggccgggcgcggtggctcacgactctaatcccagcactttgggaggccgaggcgggccgatcacgaggtcaggaaatcgagaccatcctggctaatacagtgaaaacccgtctctactaaaaatgcaaaaaaaaaaaaaaaaaaaaaaaaatcagctgggcgtggtggcgggcacctgtagtcccagctactcgggaggctggggcaggagaatggcttgaacccgggaggtggagcttgctgtgagccgagatcgcgccactgcactccagcctgggcgacagagcaagactccatctcaaaaaaaaaaaaaagatacaagcttttcccagttctactttcagtggaacgtcctttggctttatgcgcaaaattcatcaagcaatacgaaagaaagtatcttccaagacaattttatagacaatgagcagccagttttaaatgattatttcctgtttcaatctttgattaacagttgaattctttgatttcagaatattccccttaattgaattttcttctaccatactaatctacagattcccagtcttccctcttgttccttaactggtaattttggtgcgctcagcccttggtccattctcttctctgtgtactgtctcttccttggatcacatccagtctcatagttttaggtaccatctatatgctggccagtcccaaatttgtattgccagcctagactactctcccgatttcaagattcatacatccgacagctcaacattgccccctgaatgtctaataaacattccaaagtcaaatttctaaaatcagactcatgatctcatgattttcctcccaaacatgttccacttatagtcttccctgtctcatttgatggcaacactatccttccagttgttcaggccaaagctctggaattatctttgactttttctttcccgccctgtatcaaatccattcgatattctcttggatctagctttaaaatatttccagaatccaaaagattctcaccacttttcactgctacaaagccaccaacctctcttacttaaggtttacagcactaggtcttctcatttctttttacatatatttattatactttaagttctagggtacatgtgcacaatgtgcagctttgttacatgtgtataccatggtatctccacactctatttttcacatggaagccagactgagccttttaaatcgtcagttaaatcatggcacttctcaacccaaaaccatataatgattcttcattcacttgcagtaaatccaaagtccttacaaggtcccacaagactctacaactactggcccctccattacttccccgacttcatctccactttcacctccccaacgctgctcagccacactggcctccttgttgtgagaacacaccggggcactctacttgccttaaggcctgagttctaagctgttctctctgactggaaagctcttctcccaaatatcctttggcaacatcctcacctgtttcgaaatttgttaataattgtatctgttcaatgactactaattcaatactacatccttctaagctctttccccacaattttccagccctcctaatcccccttacacttctaaaaattttttgtatatcacttatcaccttctaacataaaatataaatcactcatgtattatgtttattgctttttgtctttatccccttgctagcatgggatacccagaaagataaggatctttgtatggggctctgatatgctctggacacatagaacagagccaggaacatagtaggatggtaggtgctgattatttcttgaatgaattcatacaggctcataattcaattgaaggaagatattcctgggagaaccaaagtaacaaaatatagtaataaaattgagaaattctggttcctgccctttatcaagtgagtttcctggatatcattaacaaaaataagaaacatcagttctacagaacttgtttaataaaaatacattaagcacaaattttctgagaagtttacttgttttgttttgtttgttttgtttttgttattgtcttaagtgaccatatatatatatatatatatatatatatatatatatatatctcctttaagttctgggatacatgtgcagaatgtacagatttgttgcacaggtatacacatgccatggtggtttgctgtacccatcaacccgtcatctacattaggtatttgtcctaatgctatcccacccctagcctcccaccctccgacagtccccactgtgtgatgttcctctccctgtgtccatgtgttttcattgttcaactctcacttatgagtgggaacatgcagtgtttggttttctgttcctgtgtttgcttgccgagaatgatggagaaataggaacgctttcacactgttggtgggagtgtaaattagttcaaccattgtgcaagacagtgtggcgattcctcaaggatctagaatcacaaataccattcgacccagcaatcccattactggggatataaccaaaggattataaatcattctactacaaagacacacgtacacgtatgtttattgcagcacttttcacaatagcaaagacttgaaaccaactcaaatgtccatcaatgatagaatgaataaagaaaatgtgacacatatacaccatggaatactttgcagacataaaaagatgagttcatatcctttgcagggacatggatgaagagaagtttacttctaatactctgagaacatgcttttcaacatagaaacatcagctgtttttcaacgaagtatgagcccctaagtttctaactggcaatgtccttctccatctgcagtttgaagtatttgattggtatcaactaaagcaaagcaacattggaacaggcactagtgcatcatgatgaagaaatgtcagttaagagtggtgttataaggaaatattcagctgagacagccttgagcacggttgagacataggggagatcctcggcacaagagaacacagaaggcagtgttttcaagcattcagtcttgaatattgcttcaagactttttgcgtcaggaaaagaggtgcttcagactagtctttttaaaaacttttcaacctcaaaaagagaagtaaagtttgttactgaagaactattaacatggatgtttacataaacataagcacatttaaacaagaatgaatagatcaaaatcactttgcaagaagctaaatttacaaagaacacatactctatacactcaagctttgcttttttgtttatttgatctactttctgtatttggcagaagaaacaggaggctggaggctgggacagattttattagatggaaggagcagaggtcaggaaattatactcctcagttcacagagaatattgacatctttaatcctattttttttacaccattcctccttctcaattcctgttttcctcccccactcccatagtcaaccattttcatatattcaacatatatcattttcttgatatgttcttataaaatatatgggcttggttggttttcatgtattttattttgtacaaatagggttgtgttatatatttcaatttgtttcttttttctcagaattttattttcaaatatgctacggtctgaatgtttgcatcctcccaaaattaatacaatgtaactaatccccgtgtgacagtattgagggatgtggctttggagaagtgattagatgagataagtgtcatgataaaaaagaccccagaaactaattagccatctccaccgtgggaggatgcagtgaaaaggcaccatttatgatgagtaggctctcagcagacactgcatttgctggcaccttttattggatcccctagcctccagaacgggaagaaataaatttctgttctatattagccatcctatttatagcgttttgttatagaagcccaaaaggactaagaccaaatatctacccatatttccatgtatatatctagtccactcctgctaactgctgcataatactccaagatggacacatgctttactgttcatccctctgtaatagacacccattttgtctccaactatctgtagttaaacactgcagtgaacgtactcatacttgtacccctgtggagctctggagctatgtgactttgagatatatatatatatatatatatatatatatatatatacacacacacacatatatacacatatatatacacacacacatatatacacatatatacacacatatatatacacatatatacacatatatatacacatatatatacacatatatatgtacacatatatacacacatgtatatacgtatatgtgtacatatatacacacacatatatgtatgtgtatatatacacatatatgtatatatatacacacacagacatgtatatatgtgtatatatacacacatagatatatgtatatatgtgtatatacacacacatatatgtgtatatacacacatatatgtgtatatacacacacatatatgtgtatatacacacacatatatgtgtatatacacacacatatatgtgtatatacacacacatatatgtgtatatacacacacatgtatatatgtgtatatacacatatatgtatatatgtgtatatacacatatatgtatatatgtgtatatacacacatatgtgtatatacacacatatatatgtatatacacacatatgtgtatatacacacacatatatgtgtatatacacacacgtatatatgtgtatatacacacgtatacatgtgtatatagacacacacgtatacatgtgcatatagacacacacgtatacatgtgcatatagacacacacgtatacatgtgcatatagacacacatacatgtgcatatacacacacatatatgtgcatatatacacacatatacgtatatacgtgcatatatacacacatatatacgtatatacgtgcatatatacacacacatatatacgtatatacttgcatatatacacacatatacgtatatacgtgcatatatacacacacatatacgtatatacgtgcatatatacacacacatatacgtatatacgtgcatatatacacacacatatacgtatatacgtgcatatatacacacacatatacgtatatacgtgcatatatacacacacatatgtatatacgtgcatatacacacatatatgtatatacgtgcatatacacacatatatgtatatacgtgcatatacacacacatatatgtatatacgtgcatatacacacacacgtatatacgtgcatatacacacacatatgtatatacgtgcatatacacacacacatatgtatatacgtgcatatacacacacacatatgtatatacgtgcatatacacacacatatgtatatacgtgcatatacacacacatatgtatatatgtgcatatatacacacatatgtatatatgtgcatatatacacacaggtatatatgtgcatatatacacacaggtatatatgtgcatatatacacacatatgtatatatgtgcatatatacacacacgtatatatgtgcatatatacacacacgtatatatgtgcatatatacacacacgtatatatgtgcatatatacacacacgtatatatgtgcatatacacacacacgtatatatgtgcatatacacacacgtatatatgtgcatatacacacacatatgtatatatgtgcatatacacacacatatgcgtatatatgtgcatatacacacacatatgcgtatatatgtgcatatacacacatatacgtatatatatgcatatatacacacacatatacgtatatatgtgcatatatacacacacatatatatgtatagtctgacttttaattatgtgtttatgatttatacattggattatttgcttccccttttgttgaattatttacctttctttgatgggaacaaaactattaaggcatttccctaaaggctcttcttatacctttttaagacacaagttttcaacattataactttgctagaaacatactaacttagccatcaacatcacctcactgtggatggcagcaaagatggatgagggaatctggtctgtaaaggaatgtatccaatgctttaggctgggctgcaaaccacaagcttgagaacttcatggccacctaagccaagcaaatatcctcatccttcaaatatatatatgtatatatattcaatatactcctacaccaaacaagaacaagatgaaataggtctatttaagaactttctgaatactcttcttatattagaatgtgattatgtatagcaaaaaaacactctgaaatatatgctcagtctctaaaatcagaaaaaaaaaatcagaggggaaaacatgttgtatatacttcaatcagggcagttcctttaataccagtatccaggtcaatcccataagaacaatgacaagccccatatgagaccttggctagggtccccctcctgccctggaatgtccttggtagtctcctcaccattgcatccactcatccaaatctgacattcaggacctaacccatctccatggaaaattatttcattctgcagattgccatccttcagccatttacataggtctattaacggtttttagttttatttcctttcgttatatttagcttatgatcttttttttttttttgcttttatgagatacatggccctgaaagaccatatatatcttataaatatgtccaaatagatatatggcctaccatcagtaatccttaaaagcttgtcctttatattaaagtactaatggacagttagcgaaagtattagggtatacatgttatagcccaatagaagtgtataaatgttaaagtttgttcctagggtcactaattttgccagctataattttcattagtctagacctgttgacattggcagtgaatttgacaatctgaatttctttgtgcacattatggaacacattaattccctaatatcatcagcttcataaagtggtacaatacgttgtctgcccaactattaagaagttctctctaccctcaataagcttgcatctagaaagaataatgcaatatagatattcctcagaaatatattgaataatttattccatatatgcgtgtatccgggaaaaaaataacagaaaatgttacatgccacaggaatgctatatttagagaattttttcagaaaaaatattttgattatcctaatatatttaataagaaagcatgcaatgataattcaaggcatatttgtatttttaaaacctgaatattactgtgtgccaagtgatacttgaagaaattaaaaacaacttaatcctcagaataatcccatgacataggtaaatcttcccgttttgtgtttgagaaagctgagatataaccccctcaaagtctcaaaactagttagtagctgagcaaggatagaaacccagacagtctggctccaaagtctatgctttcagcaactatgcaatgttgtcagtctatctgagactttatttttaaaataaaaaatgggaggctgaggcaggaggatcatttgaggcctggagttcgagaccagcctgggcaacatagcgggatccctgtctacaaaagttacaaaaattgttaggatgtagtggcactcacctgtagtctcccagctacctgggaggcagaaatgggaggattgcttaagtccaggagttcaagattatagtgagctatgactgtgccaggatttcaaggttacagtgagctatgactgtgcactccagcctgggtgacacggcaagaccctgtctctaaataaataaataaacaaaaataaaatatgcagtgtaacccaatgtttaatacagccttttcacaaaatgtaataaatgcacgtttctgactatgctgtggggattttttaagttttgagactcacatagaaaattgtactgagttttctacaagtgaaaagtggttttgaggatttaacagcccagccctcttaaagtgcaagaattctcttaatttccctcaacatgagagaattcatgcattaaaggtaaaccaatttcagcttgcatgattaggcaaatgctaccaaaaattcctctgagccttgtttttttcctcttatacttccagtttatacactgagcatctgcaaaataattttacccaagaagatacatttcacctgatgataccaaactgagatattctaagagaggttaatgctttaaaaccagaggaggagcaatacatttaatcccaaatagagcagaaaataattatttaaagccatccctatcaaactagcaaaaccattatgttacctaattaatcatatcttcgcatttgcacacactatgtgaaatagtcagaaaccatttactgtttccatccatattcctttttgctttcaacaatttattttttcgtttctgaaatacaagtcaaaatacatttttgttacataacatgccctaaaataattttaaaaaaacagcccgtgtatccacgtatttttttgatgagctctttcctccattcacactcttcgtctatgctctttggctagaaaatactatttgttatacccagcagtcacctccaccctatcccaatcttccttgttaacagatctccaattttgttgagatgccaacatgctcagggaaggggcccacctccaaggaattattcgtgattgttctcaacctgtcacaagcctgccctccccttccgtggaccgttgttgaagcatactttggtaggaggcttggtatctcattctgggcagtgacatgtaatgagaaatctgctaggaccttccaggacagaatttcttccctggtagaaaagaaaaatacagaaacctgataccactgagcatcaaatcagttctgaaactgcctgtctctgaacttatatgaaattgtaagcctttattaccaaagttgcatttagtatgctattatattacttgtagccaaaaggatcctaatttatatctgatttggcttgttctccaatccctaaggccattatcataagtatgtccatgctactacatcctaacagctacattagcagaatttctcctcatagatacctgattctctttgctttcttttacatgcaaactgcatttatttgtgtgaaatataataattagaagataaaataaatgttggaaaatttttgatgtccaaaatgtgatgatgaccactatcgtcaattaagattgattaaactgttcctgataacaagaaatctagcaaataccctgattatgcacattgaagctgtggaagaattcagaaataagatcatattttttgtcaagcacttgcacgaatccctgtgagcacacaattttccttgcctgaattctgaagcatacttaccacctgcagatactgagaaaactgacaaatagtttctgacaaataggcaactattctatagcaaaatgacactgggaaacatccactgtgccaagtagcattttatattgaagaaaatacactaaattttcacattgtaggtcaagtttatatacttcatgatatcgcttttggggaaaagctttcctcttccctcttttataatacccttgtaacaacctcaatcagaaaaccatgggaaaactaaaccatatgcagtgacaatcttaaattagaaaattgttccctagctagacctcttactgggtttgctatgactacgcacttcaatttgaagagacagcaatggtcaaagaagacgggcaggatgctataatgagcccacgtttcagaaacaaaatgtcaggaaggagaatacgaggtcattcaaacatgaaataagtatagttagaatgtatatcagaaaggaaatgatgcataacagaatagcaggataacatagtttggattccaaagagatgaaaatgttggctaaaatccataaagcataatttataaaataaacaatatctgaagaaagatgggttgctaaaggagaaaaccactttgcagtcaaaacactcttattggacggcagtaaccaggcaggggtgagcagagattcaaaagagaatttgactggggcaaacacttcactggactcaatccccactctatcactttggtatacaacttcagaaatttaaaatacagtactccaacagagacttaataagaactgaaatactaagattgagccctcaggcttagacaacatttatgttactgtcgcggtaagcccctctcatagatccagaaacattaaacattcattaaaatctttctatcaattgcctacatcttcaaaggggatttcatttttattttgaacagatggcgagcccattgcagggcgttctttatgaccagagcataaacactgtctgattaaatcgttcacaaaccaattaaaaacagcatttgctttagtaagtcatatctgcaatgagagagggaacatgagcaaacctagtcaattaactatccgatcccctgaggaaaatttgacataggacgtgggttaatagaagaaatcaggtacctccatgtagctatttatagccatataagctctcagttaaaagtgcaattggccagaaatgttggaagtcctttctcatacatgtattggaattttccaatgataaagtcttcaacacacatacacatacaaagaaaacccactaatttagaaaatttgatcctattacagaaagaaaaaatgataagtcagtgtagatattactctcgcacaaggctaagttccacttaacttgtagccaaaatattgaaaactttctctctagtaaacaataaaacacatgactaccttacattacagtcagacctcacccaatatcattgagaagttcctggaaactatgactttaaggaaaatgacatataatgaagctaattttgccatatactgatataaacaagagtgaagttcctaaggcatatttctggtcacaaaaacatcaccaaacttctaaatgaagatccaaaacacttgtaatattaaacattgaaataaatgtgagctatacatgcatttaagaaagattaattgaaacgagtaagataattattaacccaatttttggtggctctacgagtgatagcagtcatagtggtggtgggcaaaatcaaggaataaaatgtttgtgaagtgaaaattgtcaggagcacctccttccactgtgcagctcaaaaacaaacaatcacaactggggcagcttgctgagcactttgcacggcatcgtttattcttatgcacttgtgtgactatcagctactcgtaaaatttttatttgacaatgtttttcagggcgtatgttcattcattttccagcctgcttattccagttcagggtctcggatggctgcagcctgttctgcagttcaggacacaagtcaagaaccagccctgtccaggacttcatcccatggcagggccactcacacacttatactctggcagatggggacaacttagacagctgattcacctaatggcacagctttgggatatgggagaaaacctaggcaggcatggggagaaagtgccatctccacacaggtggtggccccaccgggaagcaattttttttctcatcaaccttgtaaagaaaagacacgacatggctgggcatggtggctcacgcctgtaatccccgcactttgggaggtcaaggctggtggatcacgaggtcaagagatcgagaccatcctggccaacatgatgaaaccctgtctctactaaaaatacaaaaattagctgggcgtggtggcacacacctgtagtcccagctacttgggaggctgaggcaggagaatcacttgaacacaggaggcagaggttgcaatgagccgagattgcaccactgcactccagcctggcaatagagcaaaactctgtctcaaaaaataaaaaagaaaagaaaagaaaacacacgacgttatttgaggtcctgctatacataatttattcttcataacaacttattagataggtactattataccattttacagatcaaaaaactgtgccttcagaaaaataaatatttttgtcagtgggatggttcaggttcttgacttcggcacacaaaagaatttgagaatgagtttaaagcaagggtaggcaaagaagtttattgcaaagtgaaagtacactcttgagaggcacagggagctgctcagagggagagacagcagctagtgccttcaggggaattccctttataggagctgttcattcacattcataaaataccaatgaggtcaagtatgcaaaagaagacctgtagttggtgcatgtactcagcgcctacatgctctcacatgcattgcatgtatcattagcatacaaaatctccaccgaggggtgtgcatttttactattaaaatgaggaaaaggtcatataagctaaaccttgagcctagctgcacatgtgggaccctggagaagttctgagcctctctctgcaaggcaagaatttgtagctaatagcttcctgggcttttggtgctgattggctggagaatgagaaagctatatcaagaataaggacttggatgggcatggtggctcatgctgcaatcctagcagttggggaggccaaggcaggagaattgcttaagcccagcagtttgagactagcctgggcaacatggcaagaaatacaaaaattagccaggcatggtggtgcatgcttgtagtcccagctactcaggaggctgaggccagaggatagcttgaacttggtagatagaggctgcagtgagctatgatcacacgactgcactccagcctgggccacacagtgggaccctgtctcaaaaacaaaccaaccaaccaacaaacaaaacaacaacaaaaagaagaagggacttttgttctctttcccgagccatgcggggtattaggaacttggaaccatctggcaatccactggtccacagggcttcacaaaaggggacaagtcagtatggcctcctagccttacttattctgcctcaatgttctcactcatatgtgagagctaaaaagtaactgaactcagagaagacaattgttattattagaggttgggaagaggggaggggcaaacagggagaagttggttaatggatcaaaaagcacagctagataggaggaataagttctagtgttctgtaacattgttggatgaatatggttaccaattaactgtataatttcaaaaagctagaagagaggattttattctgctttttcattttgttttgctttttatttcttcgaaaaaaataaatgggatacatgtgcagaacgtgcaggttagttacataggtacacgtgtgccatggtggtttgctgcacctattgacccatcctctcagttcccttccctcaccccccacctcccaacaggccctggtgtgtgctgttcccctcgaagagaggattttgaatgtttacaacaaaaacaaattatacatgtggagatgaatatgctaattaccctgatttgatcattacacatcatatacatatatcaaaatatcactctatttcccataaatatgtacagttattacatgccaactgaaaattttttttttaatttaaactgtgccttcatgaagttaaacaactttctcaatatcacatagctaaatacatggaagagcaaaaacttggcattgtacccataagttttgataccggaagatgtgcttgaaactactacctgctatttcctctgtaagacagaacagtttttctaaactcttttagagaaaacaaaattaaaagctaaaacttccaatctagcagttgctagaactaattattttcaggcattgcatataaacaattgaagtactcatcacaaatcattctcatttcttcattaaagcaaaatgaggacatctgtgtagtccaaattactatacgtacttaaataaaatgactttataaatattctataagtcagattagttaaaaggatagattttaaatattcatattttaggcttttcatgccatactacaaaatacgaactggaaataatacaaatgttatattaaaatgtaaatgaaaatctaatatatctggaattcatcatcaaaagggcatgtattattggtaacctaactgtgcctgatcttaggtggctgactaagcatcacaaacatggaatagtactaagtaccaaaaaagtcactgtttcggtgtgaaaggaaattaaatcttgggaccccaaactcattaagccaaaggtaaaagttaagatggaaactgggtcacacacacctgcctcctgacagagcaggagcatcaccaccttagacaaacactgccatttaaaagtttcccttgatcaaaaactgcctaaatccaaagggcatcagccccaatggctaaggtcaccatgaccataaaccacaaatgacatctccgatcagaaacattccaaccctaagataaacccctccccaaccagagatatgccagccctgcgataacttccctccagccagagagatgtcagccccaagataacctccactccaacaagagacattccaatcctgcaataaacttctcctccacacagaaacattccaagcctgtgataagttctctcgccctgaacctttaaatactcttactctgtaagacagagcgctcctgatcaaaattggccagaagcccctctcaggtttattcaccaaaataaacctgtctttgactgttgagctgctttttgtctttctttcctctttctttaactcttacacctccccttttggttcctaaataagatatctacgagatgaaaagttacacaccttccccatatttttcccagaaagaaattcctggtgagctccaagatctttaccctaaaatactcctgttgaaatttcaccatggaaatgtaagtggatagcttatctttacagatgcagccacaccccctgcccacctgacgcaaatgcatatctgatggttccccccgtcccattatctctatgttatcttacgtaaaaatacagataccctgcatctttccttggccccaattgtctatgtcatcttatgtaaaaaaacgcagattcactgagcccgacaaaggcatgagtgactattttccctactccccttccaaatgaaaactgtgtacatctcaaaatcctgccctttcccctttaaatttggagccctcaaaatcatcttcagagggaagcatagacctggttcctggcagcatgtccttaactttggcaaataaacctcctaaaatgattgagacttgtctcgtcattgttctcaattgactcgggaaagacagaaatattcaagaaaacattcttatgatgtgattcatactgggaaacaatgcatgtggaattatatactttcttaagaaattgagcaattataattgtttcagcttaggcccaaaagtccaagacttttagggtattttttttttaatgtttgaatggtcaaatattacacattttctctagtaagcttgattaatctctggcagattaaggtatcacacaaaatttcatctttttttttttttttttttttttgagacagggtctcatttagtcacccaggctggagtgcagtggcatgatcatggctcactgcagcctcaacctcctggcctcaagccattctgccacctcagtccctcaagtagctggaatcacaagcttgtgccaccacacccagctaatttttttattttttgtagagatgaggtctcactatgttgtccaagctggtattgaactcctacactcaagagatcctcctgcctcagcttcccaaagtgctgagattacaggcctaagccactatgcctggcccaaagtttcatctttatgtgcagctgtaactggcacatttatttactactttaaacatacttaatgtttattctggttagggggatgatgactacaaattcatgaagtttatgatattttgctaaaattgtctcactatggtgcatctgagaaaatgtcctaccatattaactaaaaaggctacgtttatatgctattactgatatatactagatagtagcaaagaactttcaatcaaattaaggttgaatttaacacaatctactatttcacaatcatgtcaaagaagacttagtttggacccagccctctcacagatttcctgcagtggcagttaactaaactaggcaaataaattacttaatttaattaaatcactactgggtcactgtcacgttcatcacagctaaaagaaaataattcaaaatgcaaaaagaaattgcatttttaaaaatgtgagatgaatcctagcaatacaatgttaaatgagagacaacaagtccaaacattacacacagcaaaatgccttttaaaaaaggtaaaaacaacaaagaagtacatatttcttaaggaatgcatacaaatgcaataaaaccatattaaaggggaagaaagaaatggtgatcacagaaatcatttgggaagaagtagagataccagatggttgtgggggaccatatgcttagtttggggcctgtgttcgtagtgcttataatattattttaaataaaaataaataaatgtatgaatgaataaaagcagggagccatgcatagaaaatgagccatgcatagaaaatgagccatgcattgtctcatgtaataatgattacaatttttccaattctgtgcatttgaggttctttaaaatcatatatgaatttaccaccccatttaaatcctggagggcagctagaaagacccaggttagtctcctgcctccaatgttgacttctccatttcacttacatatttctaatacatcctctcaaaatttcttcatttaaaaaagacctggtcaagaggcccgatgatgcaaatgggattttccttctccatcctctcattaaactgttagagtaggcagctagtcagacataagcagagcagcagagggctccccccacaactcagacacagaaggaatgtcaggcaaccatcaggtgatggtcagaaggttgttaactgtctctttaaaataataattggtcacattcagtgccagggaaaggcagtttcccaataaacagaaatacctgaaactgacaatcagcagcttcccaaaaagatcttaaaagttgggtaagtgggctcaagcatgcccatcgatgtggtttggctgtgtccccacccaaacctcattttgccttgtagctcccataatctccacatgtcgtgggagggacccagtaataggtaattgaatcatggcggtgggttttcacatgctgttcatgatagtgaataagtctcacgagaactgatggatttacaaagggcagttcccctgcacacactctcttgcctgccaccatgtaagaggtggctttgttcatccttcgccttctgtcatgattgtgaggactctccagacctacggaactgtgcaacaattaaacctcttttctttataaattacccaatctcaggtatgtccttacagcagtgtgagaacggactaataccaacattaagaggcaaaatggtgcagtttaactggtatatgaccttctagggacatttgactggtaagggaaaaacgcctcaagtaagcatgcatacaactccagtcaacgctgtgcatgcagcccctcccaagtgctagcaggccactgggtatgtgaacaacccactccaaggataaaatcaggggagaaggattgcaagaccatggaagtatgccaatttataaaaccccaagtcaaaaggtcaaactgaacacttgatctctccagttgcccacgtggccctcttccaagtgtacgttacttcgttttactcctgctctaaagttttgtaataaactttcactcctgctctaaaactggtctcggtctctccttctgccttgtgctgctcagattcttccttctgagaaagcaaaaactagggttgatgcagacccgtgtggattcactgcagggaacctattttggtgccacaggacccacgtatgttccgctcctaacagaatcaggcactccggctcatgctagacctggtcctggactgcttccctggggtttgcacctcctccttcctgaccaagccctacttaccttgtaagcactagcacatgggccaccacattcacaaattacctagtctacaatctgttttcactctataccccagagcgtagtatacatatttttataaatgaacttatctacagtagtctatttcatctttttaatttagcaaaaatctactgacttctatgagtgaggcaataagcgagtttgggggaaaaaaggtacaaggccctcaaagaatttatggtttagaattatttatatttctatttcacttttcctatttgataataaaagaggcagtatcaatacatttcacatttgtatgtttcctagtgcttaccacacagaaggtaattaacaaatattactttcagatttactgatcttattttctttaacttcagagcccactaacctaataaataactcccaaattatactacattttataactttccgatgatcatgtctgaataaatatcacaactcctgagtctcttctatcttccaaactctgaaaacgttttctgctagcagtaagagttaagaagttgaggtaagaatcaccatcctaggcaattcttgtcctctacctcagagaagagaaactgggtctgcttccccgggtggcatgacttagtccctttttttttttttttttttgaggctgagtctcactccatcatacaggcggctggagtgcagtggcttgatctcggctcactgcaacctctgcctcctgggttcaagcgattctcctgcctcagcctcccaagtaggtgggattacaggtgcctgccaccacacctagataatttttgtatttttagtagacacagggtttcaccatgttggccaggctggtcttcaactcctgacctcaggtgatccacccgccttggcctcccaaagtgctgggattacagttgtgagccaccacacccagccaccttactccttttgggctactataacaaaatagcataaactggggagctcgtaaatgacagaaattcatttctcatacttctaaagaggctgtgaagtccaaggttaaggtgctggtagatttggtgtgtggtgagggcctatttcctgattcattgatggtgctttcttgctatgtctttacatggtctgagaggaaagagttttctggggcctttatataagggcactaatcccattcagaagagctttgcccaaacaacctaatcaccttgtgaaggccctgcctctccacatcattacaatggtgattaggtttcaacctacaaattttggaggaacacaaacattcagactaccacatggccagagaccatcctgcatttgatagttttacatatattgccagtgagtcaaaacggcgaaggcattttgcacctgcaaatattgaatttttatccccagtgttttaaaaaatgcaacaaattatactgtgagcatatttccaaaagtcagagattttcatttattgctgggaagactataactatagaacactatgaattatccagaaataagtaacttatgactatgagaacaagacatgtctcttcagtctagcaccaagaagtgatcaatggcaaatgaaaatacaaaacttatctaggggttgatctaccagctctaaaatttaacattgacaagagaacactcataatacaagagagagactgtatcagcacctgtatccttcacaacgtctattttctctatcttctttatcaattaatcccaattttatgagaacacgaggattagcaccaatgaaaaatacacatgtctattgcagctatgggtagccacatgacacagttcttagaaatgaaatgaaaacagaaatgtcctgagtggagcaacttttagtttgcagtgagccaagatcgggccactgcacttctgcctgggtgacagtatctcaaaaacaaaacaaaacaaaacaaagactctcatctttgtctcttgcccttcccctcttcaatacagatgtgatatagacatgatgcctagagttggtgcaccattttgcaaccattaaagtcacactcgggctggaggttgggaaactagaagaagccctggacttcagccactttcttgatcggtcgtgttcgcttcgctttgggctacctagctcttgactttggtcatgtaagaatgaaggactttgtatggttaagccactgtggtactttttctttcctcagccaaaagcaattccaaccaacacaacatctctgtttattagtcacaaccaggctggattttcttcctgttcagaaaatgaataaaaaatgcaaacaaaggttggagattggaaattttttctttaacattaaagaacctagcttcaagaatggacttcttacagaacactacagaaaatgaaattttagaaatagtcttctgttcacaataaaattcatagtgtagacctgtgaaataagagctaacgaatgagataacatactgacatgaagagaaatgtggttaggaggtgatatggtttggctgtgtcccctcccaaatctcatcttgaattgtagttcccatattccccatgtgtcatgggagggacctggtgggaggtagctgaatcatggagcagttacttccatgctgttgttgtgatagtgagtgagttctcatgagatctgatggttttacaaggggcgttacccctttttcgctctgcactcctccttgctgccactatgtgaagaaggatatgtttgcttctttttctgccatgattgtaagtttcctgaggcctccccagacatgctgaactgtgtgcgttaattaaacaaacctctttcctttaaaaattacccagtctcaagtatgtctttttagcagtgtgagaatggactaatacaggaggtgagttgaaataaaaaggaaataaattaaaagtaaaatggtaaaattagtatcttcacgaaattagaattactcaaaattagattcactgaagaacaaagctaacactgctgaaaattgaatagtaatgtgtacatttgagcagctgcctcccatatatgagaaatgagcagagattaaaatgatgacagaagaaaaagtagacatggttgacagcgaaatgatatgtaacataatatgcattcatgaaaagaaacagttttaacagaaatttaataaatctgaattataacaggagaatatactcctacgcgaaagaaaggcttgagtctatggatgtgattaacaggaaacattaatgacaacagtagcctgaaatgatcctgttgaaattcataaattcaagggtaaagaaaaaagccaatgatttgttttcaactaggcagaaaagtttgctgataaagaaaaagatctgactaatgtcagactcctccatagcaagaaattccaagaagcaattggcaacatccacagagtttgaggtagcaaaaattataaaccaagaaatccatacataacatgtttcttatacacaaaggttaaaggaaaacatccaatatgcaataactcaaatatatattaattctatttttgaatatgaaaaatttaaacatcaaattttaaccacttaaaggataaatcaaaagaattaaataataaaggcagacccaacaaaacttcctaattatcaaacacatgcacataaatttcaacacatacttaatcatcattacgttatttctaacaagtaaaaattggaaacatccaaatgttcagatacacaaaattaactaaatggattatagtaccgtaaatgatggactaagatatagctgtttaaaaccacattcacaaaacagtgaaaaatatagagagtcatcacaacacattactaaataaaataacaatagcaatatatgcagagagattttgttacaaaaacacatgtatttgggtagaaaaatattaaataaaatacaacaaaatgcttactctggcttaagatacgctgatgtattttcttccaaattttctgtcttttctctacctaaataaaaataatacttttaatttcctctctcccttttggatggatttatagtatatcagccctagtgccttccttgtggctctgaaagcttctctccacatgattttagtaatgtttggagtttagaaagaatttagaatgtcatattacttattaggtacaatgattatgttataatctgttttattacaactgacaaattcacaaatcaaatttgccattttgcctataagaagaaaatattgggcaatatatgttttcataacgttccttaaaaaccaaaacttcagaatgtgagcatctgttttcaatatgcacactattcagtagtgcttttagtttttaatgtaaagccataaatattttggaactgtaaatttgcctccagtcttttatcatctcactttagctttccagttttgctgaattttacttaactgatttacatcttttttatacctaatatagactcatttttaagaaatatatagtagaaatgatagacatttttcagtaagcattgcacttttctagaatacacagagcaggtttaactgaagacaaaaatatcattttatttttgttcagatgttttctacagtgataaaaattttcatggtgaagctcagcacagtactagcctttggcagttaactagggagatgaggctgtcagctcaaagaattataggaacttgaaaaaatagattgtttatgttatcatctggaggttagtttatgggctcctgagtccttaacaaccccaagacacgtagaaattcacagtgagagcctcaagcagactcaggtatcactgattgttggttccacctttgcttcccgatttgccatggggtttgcccaggagttggtgagaatcttttgactaaagccaagatgaagcatccagagtttgacattctaattcctgctctgcccctggcttgctaacgatctctgataagacagttatcttgtctgtgcctaaagcagcctgcaaagtgagaataatatttgatccgaaatctctaggacgctatgatggttaactaatactttactgtgaagccaaaaagaagtgtagctatgcttgaagttctcagtatattcaaataaactttttaaaatcctaggtatcatgactttctcatactcagttacccacagtaaaaatgaggaggaaataaatcaaagaggaacagagtccttaataagcagaaccacatgttaatattctagatcaacaaattcctactaaaccttattgtataaaagttatttcacttcatccatgggtaagcttgctttcatttgatcagatgtaaaatttattttaattttatacaaatttaacacactaacatttgcattagtttgtgatattttttggtatcaactttgttgttgcagtagcttaatcttgaatgggacaatgaattaattaatataattctataaccttaccatggtatccctttattctaaagtagcccccttatcagttgttatattgatgtagttcctcaatcaacaattgttcttggctgggcacagtggctcatgcctgtaatcccagcactttgggaggccaaggcaggcaaatcacttgagtccaggagttcaagaccaggctgggcaacatggcaaaatttcatgttatctactaagcatacagaaactagccagtatgctggtgcgtgcctgcaatcccagctactcaggaagctgagatgagaggatcccttgagcacaggaggttgaggctacagtgagcagtgattgtgccactgcactccagcctcggcaacagagtgagaatatgtctctaaataaagaaaattaaaaacaaaaacaaaacaaaattgtccttctaaagaagtcatatactattaagaatatatattcccctatgtattttttctttagtttctcatagaaacatagtcagctgtacattacattacagcaaataccatagctgacaaaaaaaaataaagtacacaaacacagaatcagaatactatattttcattgacaacttagcatagagaggtttaatttctttatttgaaattgaggataataagaatagttatcacatagaattgtaacaaatattaaaagcgctaatctttcaaagttatttattaccacaatgtctaccagacaataagtaatcaataaatgttatcaattactattattctatttcaagaatacacagcagactagtcgtgcttaagttctggctctttaataagtaaaattcaaatttttctctaataagtaaaattcaaaattatttgtattttcaactactttagaaaactaatgatataatatttctaaattccttgatttaatttgaaaacaaatttttaaaagacagttatctacaatattttgattactattaatattattttctttttttaagaaggagtctccttctgtcgtccaggctggagtgcagtggcatgatctcggctcactgcaacctccgtgattctcctgcctcagcctcccaagtaagtacctgagactacaggcgtccacaaccatgcccggctaatgctcatatttttagtggagatggggttttgccatgttggccaggctggtctcaaactcctgacctcgcgatccacccacctcggcctcccaaagtgctgggattacaggcatgacccatcttgttcaatgttcatttttgtatacagattctatgatatggggatacaacgacctcaaatacattgttattccctacaggaaatatacatctgggtttgtctgttactgtgcctagcacataatgaacactcagtacataatatctactattattaattctttaatatttaaacagatatcataaactgcctagtgtaattaagtgccaaatacatattacagatggtgagagagatgatctacagagattcgttcaaggaagactttgggcagaattaaatttgagctcttcctcatttaataggcaggaaggattctgtgcattattttgtgctatattacactattttacatcatattgtattatgtatatattgtattatatataaacatacatgccatagtgacataatctatacaataattatctcaagacctgcccccacgtttaccactattttttaaattcagaaaaaacataaaaatataaaaatttaagacataaacacacacgcaatttctcagcagtgcaaaaacaaaagcaattagataataagtaggtcttctgtacatttcacaagaaaagaaagataaaaatctagggcagagcaaattgtcaagaaggagaggacaactaaactggcaacagaacttggataccacctgttactcactgctatagtttggatgtttgtccctgtaaacctcaagttgatatttgatccccaatgttggagacagagtctaatgggaggtgcttgagtgatgggggaggatccctcctgaatagactgatctcccccacctagatcaggcagggatgagtaatttcttgctctattagttccctccagagctggttgttaaaaatagcctggcacctcccctacccctctctggcttcctctcttgccatgtaatccctgcacagcttgcttccttttgcactctgccttgagtgaaagcagcccaccttcaggctttcaccagatgcccaatagtccagccagcagaattgcgagccaaataaatctcttttctttataaattccccagcctctggtattcctttatagcaccactaagcagactaagacactcacactgtgttttcttgtcttggtcttctgcgcttgactcaagaaaatggaaagagctactcaaacatgttgagagatcactcccaaacccagccttcatttcttccatacctgaatattatttccttaaacactgaaactgccttgtcccacccgaacactgttcaagtgaaaacaaattacaaccttgttccaggcaccacctcatataccatctctacgatgatatttaattcaacaacatttttgaacacttaatatttaaaaagtgttgaagaaacatacctaagagaccgatgaccatgactttaagaaagagagatggaaagaagtataagtaggtcttctgtatgtttcacaagaaaagaaagataaaaatctagggcagggcaaattgtcaaggagaggacaactaaactggcaatagaaacctggataccacctgttactcactgctatagtttggatgtttgtccctgtaaacctcacattgatatttgatcaccaatgttggagatggagcctaatgggactaagcatcttaaaatctgtgatgggaggagaacacagtccaggaaggaccatgtatctataagtaatgcccatgtattttttgacctgtaaagggaatgagtaccaaaatagatacaggaaataactttcaccctgaacgacctttctactggggagaagatactttcaaatatttaacagagtacaaaacaaaagatgatgtgtgcaacatcccttaatttctaggaagcatggaggccttgtatggctctgcatcccagcatataacagtgttcagagattggaatgcattagttattcagtgcatattttttgaatgaatgagtaaaaagtatagttagtagaaggaggaaagaaaaatattcccttcaactattcatttcatcaagcctttcttgaattcctatgtttacagttcagggtcagattatttggggatacacagattaatcaaaaaagaatcctacctttacaatgtcaaatttagcggtcatagtcgctaaacgaagtgaaaatttgcaggaccaaacaatatttagttgacaaggaaaaagggaagaaaagacaagtacacctttgaagactgcccacagctctaggtgagcctctataccagctcttcagaaaccattctggagctccaagagcaagactatcatgtctccaataacatgaggaaacagtctaacagaactgaatcattacatagaaattctatgacgagctgctcacattaatgttgatgcaattgaatgaaatggaatgtaaactatgaaaaattttcataaataataaagataaataaatgtttttaaaaacctgaagaaccaactctgtataggacaaacattttcctctacctaaaaataaaaatattccatttcaagatggcagactttatacctgtgcttctgtctcttccttctgcaatcttgataaaatcacgataggagcacaacaaagctataatttaagaacaataaagagaaaggaatggcataattcaaccaagttccagaagactgaaagtatttcatgcaggagtcagaaaaaaagcagtatcctatagcaatggagaccaccagcctgctcatcggaaacctcagaaagatctgggcatcagctacatgatctaacagaccatgacagtaagaaactgagcatgagagcctgggttaaaggtctctataaaagatttttaaccaatactgacttaaatttattgcatgcagagtgccaggagccaaacattcatactccagggagaaataaacagcctttgctaataattatataagagtagaatgaattatctgcagacatctaggacagctagaactagtattgacactcattgaggtcctctgcactttggcattagtgctctggaattcagaccagctcccagtctactctcactagaacaaagcctggccgaccactagccccacccacatacccagaaatccccgtcaggctctctactgagtctccctttctatggacgaaataaatcccattgttgcaagtaccacagatacgctggtatcaccaaaatccatgtcacaatgcctgtttcatatgcttctcaaaactcaaaaagcaaagaacttttaccacccaccgaatctcttccccactctattctattttagtaaataaaatggcaaaaccagccactcaactgctcaagccaaaaccagtgagtttttcctcattccaaaggcaagttctgtcaactctgaccccaaaatctatcccacaccaagccagctttccttgctccactgaaaccactaaaattcaaaccaatgtaattttttacctagattcccacaactaacttccctaccactatccctggctttcattctgattttctacaatggagtgtctgttgagaagccagagttttctttttaaaatgtaaattaaaacttgttaggccaggcgcagtagttcaagtctgtaatcccagaactttaggaggctgaggcaggaggatcatttgaggccaggaatttgagaccagcctgggcaacagagtaagacccagtctacacaaaaaataaaaatgaaaataaagtagcaaggtgtgatggccatgtctttactcccagctacttaggaggctgagatgggggatcacttgagcccaggagttcaaggctgcactgagccatgttagcaccactttactccagcttgggtgatagagtgaggcctcatctctaaaactaaaaaaaaaaaaattgtcatgcccctggagtccatccaacagaatttttctttgtcactcgaaatgaaacccaaatcctttcccaaagccataggtgttactgtccctgccaccttcccttacttcatctcaggtcattgtcctctttctcacactactataaacacgttagtcttgggttcattagagatttccgaagactactccaacctcacgacatttggaagtgttcttctttctgcccggtattttttcatttgggtctcggtttccttagagaagtctttcctgactgcccagactctctatcccatggaaaactcccatagttgcaattgcctttatgttaaagctatatatacttagtatgcttatttttatttgcatactaatactcatatattatcattctcttgctcaaggatacaagttccaggagcacggttgtctcttttgtttaccacagtgtctgtactgatacacaatgagagctaaaaagtctttgctgaataattatttgaatatgtcataaagtggggggaaaaaactccaatataaacaaaagtaaaaacaaccctagaaaaaaaaaaaaagaactaccaaactaattgcctagcaaaaccatgacttttagagtattgtcattatttactcaggggattttgagaataaaatggaatcatcagaaagcaaagttcgcagaaatgggaaagataatttcaaaactattaatttaatagcgttagaaggtaaaatcaaggcaccatggaaatgtgctatcaaaaaataagagatagaaaataagaaagaaaagataaaggacacagacaatttctccaggaggtacgagattcaatgaatggaaattcccaaaagagaaacagagaaaatggagagaaaggaagcatattagtgagttcaggctgccataacagaatcccacagttatgggatttatttgaacaacagaaatttgttttttcgcagctctggaggcttgaaacccaagatatagatgccagtaggtttggtttctggtgaggcctcttatcctgacttgcagatggctaccttcacactctgtcttcacatggcctttctctatatgtccacagagagggagaacaagctatgatgtctctgcttatatcaggacaccaatcctattagattagggccccacccttatgacctcatttaatcttatttatctcaataaaggccttatctctaaatatagtcagagaaggggttatggcttcaccatatgactttgaaggagacaacacttcagtccataacaggaagtgaaacattttttaatgcatgcaagaaatttaacaaaagttaaaaagagacataaattttaaaatttaaacaacttagcaaatgccatgtaggttttttttaagttctacatctcatagtaaaatttaagaacaggataaggagaatatgttctcatcttccataagacattgagtaggaagttaaaacaagtcacatacaaaggaacaagaattatacttaaatttaacgtttaagtataatcactgggtatcataagacaatgaagaaaaaattcattttcaacctaaaattgtctacccagctaaaattataaattacacaggtaaagtaatatttcattttcaggtataacaagggcacctaaattttacattttacacactttacttagaaagtcggttgaggataccacccagccaagtgaggagcaaaccaaacagtatcaggaaaagaaagatcagtagtgaagtcaaagcaaaagacaataaaggggagaacattaacagtggtgcagcaggtggatagaaatcaatccatacaggaagaacagaagaaaagaagacttcagaagagaggtcctagggttaaaggggagtgccatagatgagacaggttagaagagattaaaaattagaaaagagatagaatgaacttttaaaggcataagaattagaaatttcagggaaaaattaacaaagtttaaaactgggctgggagtcgtggcccacgcctgtaatcccagcactttgggaggctaagatgggtgaatcacttgaggtcaggagttcaagaccagcctggccaacacagtgaaaccctgtctctactaaaaaatacaaaaattagcagggtgtaggggtgggcacctgtaatcccagctacttgggaggctgaggcaggagaatcacttgaacctgggaggcggaggttgcagcgagctgagaccacaccattgtactccagcttgggcaacaagagcaaaactctgtctcaaaaattaaagaataaaaataaatacaaactgtatgagagaacatatgattaaggcataatatttaattccacagagaacaattttcatgagttcacagtattacaaataaaaataaaattaagataaaatattttataaataaagttcaaaggtatgcagagactaggagaataatacatgcaacacgcagaaaaaagaatttatgcccaaggaacaaatacagatctagatataaatgacaaacaactcaatagaaaaataggaagggcataatgaggtaatttatgaagaggaaatgccagcaaacatttgaaaagttgctcattctcacttccagcctaagaaatgcaaatcaaactagctaggagagatcttctttttatccataatattagcaaaaataaaattttataacatctagaactggccaatagacgtggaaatgggcgctcacatgcaatgttgatgcaagaatgaagtattatgagctttcaatccaatagtatctgccaataagtaaatgcacataccctctgccccagtaattccccttttagagttaattcaacggatataaaagcattagtatataagaatatctgtacattactatctactaaagcaaaaaagtatatagtatacagtaacagaaacaagaccattacccaaaaatccatactctgtctcaaaaaaagtataattgaatatagcctatctatctataaaatagactattaagcagctatttttaaaaaatgagttagatgagtggtttgaaagggtatttattacagattattaaattgaaggaagcaaatttttaaaagataaattcgaagaagcaaatttcaaacaagcaaatgacagaatttaatttgtaaaacttaaaaataaatttttgaaattcaaagaagcatatggagtaggaccctaattttgacagaaatagaaaagcatatgtgtaagtttacatacatctgtatgctatgtgtgtgtttatgtgtgcatatatatattaatatgtattagtaagcatatttaatagcacatagaaaaatgtggaaatatgtacatgaaactatcagcaatagtaaccttgaggctggggagacaaaaagaaattctttatacacctctgtagttttctctaattacaagaaaagtataattattctatttttaaattttaatcaaattaaataaaaataaaaagataagcaaaatattttttaaagacaaggaacaaaaaggaagaatcaattatggaactaaatactacttaaagaatagtgggaaaaagtctccacaatgagtcatttgtattttagaagaactcatgggcaacgtgaaatcaataaaataagacactcactaaaaggataagacaacagaaggaaggggaaaaacaagattgcaaagtttttttttttaaaaaaagagaaactggataaaaacactctaacaaaaataataaataaataaaaatagcagaaaacaacatatggggccaaatattgaattagaggacaaacgaatgcagagagtaaagacagacactactaatcgcttagaagagagttagtaggtagatcagacaaataatttggatccagcaaaagaaaatcaattgttcttccctctggggaattcttgtgttctattctataaatggaatagggaaaacagttcatttttatatatcacaagaaaatttccatgaggagcaagggaaaaaatgggtccaccaattaaatgagcctacgatgtttgagaaaatgaactgattatgagaaagaattatcaaaactgagacatgggccgggcaccgtggctcatgcctgtaatcccagcactgtgggaggccgggagtttaagaccatcctggccaacacggtgaaatcccgtctctactaaaaatacaaaaattagccggacatggtggcgcacacctgtagtcccagctactcaggaggctgaggcaggagaattgcttgaacccaggaggcagagattgcagtgagccgagatcgcaccattgcactccagcctgggcaacagagagagactctgtctcgataataacaataaaaatcaaattactgcttgatattgtagataactttcttttaaaatttgtttccaaattaaatcaggaatcttagaaatattatatcattagttttctgcttctaaaaagcaggacttcgtctcaaaaaaaaaaaaaactgagacatatcctggaaatttttctgaaattcacaactgaattagttcaacaggaatttttagtcaggaaaagcagaaaggagaaagaaaggagaaggaagaagcaaggaaaaaagggaagaaagaaaagagggagggagtaagagaaacaatcaggcataaatatagtgagtacaagtgaggagaaagtttgattgtaagaaagtgagagtgagtggtttccatcatcacccttcctaccagatctcttataaaacctgccctgaggactaggagttgcaaagcatataacgcttgcctgaaataattgggtacatgaattacaggcatttgtattttaactgtgaataaagctttaaatcactgaagagaaagttaatggggaaaatatcagacgataaggggttagtggagaaagtacttgagaaatttaagcagtctgaaacattcatatagaagctagtattaaccttctcaaaagaaaaaaaagttaaaatttttctttcacatactgtattcttttctttcccaccctactgctttttgagaccaaaaccagaaatctggtcaaaaagttgagaccaaaaccagaaatctggtcaaaaagttgcaaaagcacttgcaactgtcatcaagaagagtatacaaagtttccaagtccaaagaaagactttctagcttctgatatttaggatttgagaagaccctaaaaattaaatatcctctcaaaacaaataaaaacaaagaaacatccctgccaaatcctaattctctattaaattcctgtatcacttggcttacctgatttgctcattccagtacttattcatattcagtctcacatattacatgatggcataaataaacataaatgtggtaccccttttacctgtggggtattgttaccaagtttagcctagctggcactaaatgctaaggaccacaaagaaagttgaaatcatgagtccagaacttgtcttagaagcctcaggaagcaaggaattctatctgcaagtacagttaaggagtagagaagtctgtctaaacctagctggcaaataaacactgatggggatttaatggaaaaagaaagcaaagaagtttccataacaaatacagactgtcataagctgccttacttcttttatgtaatctggaaggaatataaatgtataaaaatgcaaataaacaactaaatacatttttaaatgaaatgccatcagcaagaggttgcagataattgaatcaaattgtacctcagagattgttcttttgtctgaacaatataatcactacaaacatatttcagtgaaatgaaaagattattgaagtaatattaaaagtcatcagcacacattagaaacccacacgtttctaacaaatgagatgtatttaaagttgaacttaaacctataatatcaagcaagaaataatgaaaagccattgatctgaataaactatgattttctagatcagagtgcaactacttatgtgcaatgaaagtaattccaggtcatgccgtgatcctataaaaatttgtcgtctgtgatattggattttgcttttgactctaaaaggtcagaagaagagcagaaaagctatggttctagtttatccataaatcattttgtattcatggaggtactgcttcattgcaaagagaactgcctagaaaccagattgaaaatgtctatgaattgagtaggttccagatgggcagtgagctgcacagtgaccacacatttcaaaactttgaaaaaaaagaaaaaatagatatatatatatttcaaagttagttgagatgaagacacttttcaaagttctgcatttttacagattcagaactgctgtcatcaaccatgaatcactttctcatattaaactcttaaaaaatcattaccagtcatcaaagccatattttaatagagatgaggtaggatcatgtattatttcttattacctgccttctagaaattctacataggttcaataccccctgctatggtgatacagtactactctttctttccacaaagcatattaaaacacgcatacacacacacacacacacatgcgcaaacacatacaacctatgagtttacagtcattcccatggccatttcagactttgtcactagcaataacagcattttctttacaatctcaatgtcaagattcctactgttttattaccaccttgggtctttctagctcacttcctctaacaccccaattcacacaatccttagaattcaccagcacttccaatccattatcctcaccaccatgatattttgaacaccccctacattctacatccctgttttatttttattgttattatttattgagacaaggtctggtgatgttgcccaggctggtctcgaactcctgggcacaagcaatcctcccgccttggcctcccaaattgctggaattacaggcatgagacactgtgccctctttattactcaggccactttactcaggcaaaattccaccagcaattattatcatcaaattgttgcatacaccttcgatgactttactcctctttttccttgtctttctctggcaaaatcacataccagttaaatccaactctctgcttactctctcacctgcacatgggtggatgaatccagataaagaaaaaccctcatttaagttgctttatattcatgaccatgaaccaagcctttaatgcttctggaaaccacattatactttctcttttccattcatactccactctctcaagacgactatctcccatcatcaaaccttcaacactttctcctcatttcattctcagcagacaatctggcttcctactttattcaatcagaaaagaactcccacaatctatggaccctccaaccagcatcttcacccattctgccttcccaccttttccctgagattaaagattccctttcctttccaaagagacttattggaattgtacactataacccatcccctttaactgatatgaggttagcacttagatgattctttcctctctttgctataccatcaatttgtcctcactactggattatttctattagtttatattctattaatgctcagtctttaaaaataaatcttgatgtcatctctttcactagatagtaccacatttctttgctttcctttgctgcaaagctcctcaagagacatctttatccctggtctccaatttctctcttaaacctactgtaaaacctcaggcctcagtctttagtcccatctctatctgcatttctttccttgacaatctcatctgtctcatgattataattctcatgcacctgcagataactcccaaatgtataatttgtatctccagtctggacatctctcccaaattccaggcttatttttccattgcccactcaacatccatgttatgacctgaatattcgtgtccctcccaaaatccatatggtgaagccctaacccccagtgagtctgtgtttggagatggggtctctaaggaagtaattaaggttaataaggtcatacaagtgataccctgatacataggaatagagtccttataagaagagacatcataatcccagcactttgggaggccaaggcaagcagatcacaaagtccagagatcgagaccatcctggccaacatggtgaaaccccatctctaccaaaaatacaaaaattagcttggtgtggtggcgcatgcctgtagtcccagctacttgggaggctgaggcaggagaatcacttgaaccagggaggcgtaggttgcaatgagccgagatcatgccgctgaactccagcctgggtgaacagaacaagataccatataaaaaaaattaaaaaaaataaagaagaagaagagacatcagagagcttgcttgctctctgtgtagtccagaggaaaggctgtgtaagaacacagcaagaatcatctgaacctgtaaatatgttacctcagctggtgttatggtttggctctatgtccctacccaaatctcaccttgaattgtaatcctcacaggtggagggagggacttggtgggaggtgatgggatcatgaaggtggtttctcccatgctgttctcatgatagtgagggagttctcaggagatctgatgggttgatttgtttgcttgcttgtttgttggcttgtttgtttgtttgtttgttttggaagagagtctcactctggcacccaggctgcagtgcagtggcacagtctcagctcactgaaacctctacctcctgggttcaagcaattctcctgtctcagccttgccagtagttgggatcacaggcacaggtcaccatgcctggctaatttttgtatttttagtagagacggggtttcaccatgttggctaggctggtctcgagctcctggttcaagcgatccacctgccttgtcctcccaaagttctggcattacaggtgtgagccaccacactaggctgagatctgatggttttaaaactggcaatttcccctgtgctttttctctctcctgcccatgtaagatgtgccttgcttaccttcactttctgccatgagtttcttgaggcctccccagccatgcggaactgtgaggcaattaaacctcttttctttttaaattacctagtctccggtagaatctttatagcagtgtgaaaacagactaatacacctggcagaaaggactttgccaatgcaattaggcagaaaggactttgccaatgcaattagagggagataatcctgaattatcctaggggaccaacctagtcacatgaaatcttaaaaatggataacttctgctggctgcaggaagatagagagatgcagcagaagagcagacaggagagaggaggcatgagatcaacatgctgtaaatggctttgaagacacagaggtccataagtcaagaaacttgggcagttatgaaagatgagaatgactcctggctgaaagtgagcaagaaaacagaaacttcagtcctacaaccacctaggactgaattctgctaaaacctgaataagcctaaaagcagattctcccccatagctttcagcttgcagctctgcggcatccacagcagataaacaagctgagcctaacaaatgtccagcctaaagaattgtgagatcataagtgttgttgttttaggccactaaatttatggccatttgtgatggcagctagtgataactaacaagtcctaaacagctgcctctgagctcttatgtttggcacacattgttaatgcttctcagaaaccacaattcatcccagtgggaaaaggaataggtaggaatttgtctctgatggacccaggccccttctgagaggaaggccaagtctgtacctactccgggcttctgtcctttgagtcgttactgcgccatgttttgtaagacttacattatctgccttgacatatgtaagtcaaccctgtgtattactgcacaaactaataagagtgagtcattctctacacattcacacattcatttagttttccaggaagtctcaaatttaaaaaaaagaaaaaaaggcctcgtgatatttttggccaggtggggtggctcatggctgtaatcccagcacttcgggaggctgaggcaagtggattgtttgagcataggaattcgagaccaacctaggcaacaaggcaaaaccctgtctctacaaaaaataaaaaaaaaataaataaataaaaagaaatataaaaatgagctgggaatgttgacaggcatctatagtccagctacttaggaggatgaggtgggaggatcacttgagtctgggaagttgacgctgcagtgagctgtgattgtgccactgtactccaggctgggcaacagagtgagcacctgtctcaaaaaaaagtggtgggcggtggcgatttggaaaaattatataatttactatatgtctggcactgcacaaatttcttacatgtattattattttcaaatcttcataatagttccatgagacaagacgatcaggacttcctatctaacccttagagtgaaggtgagaaaccccactactctgtgaacagaattctgtccaaacatgcttcatatctccagcatattaactagtcttttttggatgcattgttagtccaaattggtataacaacttaaactttaaatgagtattcacctccttttgttgtttcaagtctcttattaaaggtcaaatttgatcgacgtgagcaaagaccaacaaaagatagtgaggtggggatcagatgaagactcagccctggagtttcccctctgttgctcaacccctgaacttattctgcttccaatttaaaagtattaaatctctagataatcttttgaatggcttccagtcaccgaaatatgttttatagcttccatagaagtgtaacattgattataagtaagatttgtgaaacatcaagtagcattagattctcaaatttaaaatgaagattcacattccacaaggctgtttgagatagccttatcaaatcagctgatttgactccaggtaggtctgccacagaattattatgaatagatagctaacttgggagaactttcacggtctggtcagcaacttgtgcgactttctaacagctttaactcataccctgatcactacagctttgagacagcgtgccaataagaataaaaggttccaatattaataaaataatatgaataatagctttaatttttaacacttgttagaatgctaggcaggtacaattcactaaacagtgacttattcaacaaatattaattaggattcgaaaaacgagtacagagttgaactctgcagctactctcctttaggctaccatttttaactaaatgaccttggccataatattcaaattcctatctgtaaaacagggtaaaaataatacctatcccacaagttgtgagaggcaaatgagtttgtgcacataaatcccttagaagagggcctatcacagagtgagttctcaatatgtcctagttgttattgcgcatgacagctacattccacgtggttactgggccctggaaatatgatggtgatcaagatatccatgtttccttacctcaatgaagcctacattcctatggggaaataaaacacaaacaagaaagcaatcgacgttcaaatgtaagtttatattgcactaaagaaaattagcatggtggttagattggcaatagctaggtgtgtacaagtgagatgaaggagtaaggaagaccatcatttgaggtgggcccagcagaggacaaagagccacacataataagaactggagatagattaaaaaagaaaaaattccaggcagaaggggcaactacaaaagcctagagaaaattaaataaaagagccaagatctcttaaatcctttcaggccaagaaaaagagttcagattttattctaaccacaaaaggaaaatgctgaattattttaattgagaaagtaaataatctgatctgtttttttttctcttgattttctccatttcttacccacttgcacagaaatttacttgcacaggtgtagagcttagaatgggaagtactgaagtatattaggaagattctcaacagacagcactgggagtgagatatttctggaacatatctaggaaaggtgagttttcctgataccttctccccaaatattctgaagaatatcagttttgagatttttttttatttaattaggagaaagaaaattctgatacaacacaagagattttagtaagtggaacaaagttcaaaatgaggaaagaggagaaaaaaatgagtaagctcccttagtaaaaagtattactataacaattcatttttagtagacatcttgagtgcaattttacttctcttttccagaaataaaattctgtgcaagaaatggagaaaatcaagagagaaagagaaagactagcaggaaattatcgcagtgttccaggtaagagatgattgacaactgggctaagataatggcaacagatatgaaaacaagtaaatagaatcatagtatggcttggaagtaaaaacaaaaataaacaataatgacaaaataaacctgtgaaataagcatcatcgttatcttaattatgttatatatatatatatatgaagaaggcttatagaatttaaaaactcagccaaaaagcaactggagttcaagcaccaggaatttctgactgccatttagatgttaggataagaagtgtggttgtgagaaaaataagcattcactttaatgcttcctatgtcagcatatctagagtcaaactgaacaccatgaaatgttttgtaagcatgcatctgttgagtatttgctatacggagcatcttcaggtttcttttatttaagtcttgcaagttgtcaaagatttttgttttcattcttttcctttctgcctttcttttagtctcttaagacatgctctgaaaggaagcactgcaggaaaacttgttactgtttggatttttacttgaaaaacggttgtttgtttttattgctatattctccaaaaggtggattgctttctcaaatgtgtgaacttccacttgagaaagaggagttgaactcttacctacctccaacccttcaaaagaatcagcattccaggattattattttgccatgtgctgatttgcacctgacgtgagattattgttgcaaggagcaaaccttccaaaagaaaaagttatttcagtgctgccaacattcccagtctccctaacgaagcaatcagctttcagaatttggcactgcaactccctgaacacactgtcacccccaaattctcttaaactatatgactgtccacagttgtagagctcagaatgggaagtactgaagtatgttaggaaggttctcaatggacagcactggaaatgagatctttctggaatatatttaggtaaggtaagtgagttttcctgataacttgtctccaaatattctgaagaacatgagttttgagggttttttttttaatttaattaggagaagaacgctaatacaacacaagagagtttagtaagtgggacaaagttcaaaatgaggaaagagaagaaaaaatgagtaagttcctttagtaaaaagtattactataacaactcattcctcatagacctcttgagtgcaattttactcctcttgtctagaaacatctctaaaagtaatgttatcagagggcaattctttaggctgacagcattttacatatttcatattgaaattgattggtctttctaccttagcaaaacatttgtagaagaaagttgacaaggaagaaacagaagagaggatgtgaaataattcataaatattcacaatctatccgttaaatttcctacagtccctcaattttcccagcttcatccacttttcatttcctgagtcaagaaaagattgaagtcttcgaaatgagggaaagtataatgatagaaaaacatagacccagaattaagactaaaattaaagacagtagtgaactacacctaatagaaaggagcccttagccccacaaatggtataatgaacttgagctcacttttaggattgaaaagggtgcatattttttctatgtgttgtcaaaccccaccataaactcacacagggtttactttgcatggctatagtgcaaagtcatgtttaagttcttcatctcaacgttctccatttacatgaaaggatttggcaatggttgtaattactagagtgtcccaaataagatgggtcactgacaaggcttggctgcagctttgggatgctccaactttcattataaattcctttaaactcttcataatggggggtgtatttatataagaggcctacaaataattgttttttaattaattttttttgagacagtgtctcactctgctgcccaggctggagtgcagtggcaggatcatggctcattacagactcaaactcctaggctcaagtgatcctcctgccctagcctcctaagtagcttgaactacaggcacacaccaccatgctgagctaacttgttgtatttttgtagagacaaggtcttgctatgctacccatgctgttctcgaactcctaggctcaagctgtcttcctgcctgggcctccaaaatgctgggattacaggcctgagccaccacacctggcctaaataattatttaaagcttaccatcaagcctatacagacaactgtggaacattttgactcagactttatttctacctgattggcaaatagaacactttcagtggaaatgaggggacaggagtagaaaagaaatagctccctgatctcctgtccctggtgcttctgtccccaccattacaattagcacagagctggtcacctctgtatctagtagtatgctgttaagtgtttaacaaccatctctcccaaaataaaacagccttgatctgtagcatttgacaatttcttggtctacatattcccaacatggccaatttcaagctcccgacatggtatcactgaacatggagttgataaaaggtatgcagtcagctctggtcaaccatcatgaacactccagcacaccactgacagtgtcttctttggaaacagggagaatgaggatgacagtgaatataaagataagaaggccaaattgttagccaccacaatgcttgctgttatcattttgcaaccatgcttacacaaatgcaaccttcatgtattacggaatgaaacctttaacacctagataatgcctacatagtgcataatgaaagttcacaggaatagaaattcatttcagtagctcacgtttatatttgcatcttttgttagcatgctataaattatctattatgaaaaagtgttgacagctatatgagatcaagatagagtatgttctatctatcatcctaaaagagagaaatttccagttcttgatgtgagctgatgtttcgtctctcataacatagttaatacatgaatgcaaaagatcacataacagaattcactgtaagaataattagtgaaaaaagtattaaatatctactattgacttcttttacaactacaactgcaatacaaaaagtccatcccttgttaaacaaatacaattgtaacacaaaaagttcagagcgcctgaacacttcacctgatacccttcacctaatagtgacagttctcctgtcctgttgaagaaagcaagtctaatcctgaacaaaactgagatattgcaactttcagacaattcatgttcaattaccactgagtgtcatgatgtgtcttctccaggagcaaagagttccctttacatgactcagagatcaatttcctatgccaaataggagaagtaaaattgttcatgaaagcatattcactgaaccgctcatctgatctgaaaatgcatgttcctctcttggtttaaaaagtaaaaggcatagaaaatttatttttgtgaagtgacaacactacgtgacattttaataattctaatgctagcatcgaagaagcctaatcagtgtagatcaatgcgtcattaatggttttattccactcttcagatctttctgtcaatgctatagtatctagccacatatggttattcaaatttaaatcagctaaaattaaataaaatttaaaatatatttcttagtctcactagacacatttcaaacactcagtagccacatgtgatgagtggctaccatagtggacaaatgcaggtatagaacgtttcagtcatcacagaaagttctattggacagcactgactaaggtactcagacatcattacaccagcaaaccagaaaatgaagggaagagaaaaacattgaaactgccatttgccttaacccattgctatgttcttatagaaatgagtttggtccaggagcgtcttttgaattgttggatgatagggcaccttaatctgaaacccattatccttgagtgaacatgcaacctttctcttgcatatataattataatagggaggactggaaaaagcatttattaagtttatgcttaacataataattcccaagcatcatatgtgcccacaggagaaataaaatctggctgcccaaaaatgattccttcctcttatttttcaattctccttgaccctaatataatagaaatctttacaataagcagtgttttagtccctgggaggaaagccctcaatccctttgcagcccagatgtttctctgctgaatcctgactctaccagctggatgttaaagcaagttcagagagcctcctctcttgggtctattaatgaagcagaattttccttctttgacaggcaagggctaattattatccttgagtaaaaaaaaattcactcgctgccccctgaaaaaaaagcaaaattcatatttaaagccagcagtttccaaattaaatttcacagaacctcagattgattaatttccaaatctagttgctgaagcaacaactctgtcctcaggcataatccgtgctttttcaatatagtggttatcacagtaatagaggtatcagcaaaactaatgttatggaggctaaaacataatgttttgtaattatatatctgcctgtcagaggtgccttgggttgaataatctcttgatgatagaaaatagatttgacggcacacaaaatagcggaaaatatcttgcatgcacctgcctgattgttctagataagctaagcagaaaacaacacatagcagtctatctttttttgctgctgttgttctgtttgtttgtttttttgagaccaagtctcactctgtcactcagactggagtgcagtggcgtgatctcaactcactacagcctctacctcactgcaacctccgcctcccaggttcaagcaattctcctgcctcagcctcctgagtagctgggactacaagcacatgccaccacacctggctaataaaacaacacgtagccatctatcttgacacatagggttagaaaatgacatttctttaaaaaacaaacaaacaaaaaactacacaaaagtactattgtctcatataaaaagcctcgtcagatttatttttctgctcatcttttttctatttttctatcttatgtcactaccacccagtcatttttcactgattctctttttttgacagtcactcatttgcccttatctagaggctaggcagcatcacagccagaatctgaaaatgccggttcacaatgagatttccaaaaaaatatttctcccaatctcaaaaggttctatccaagatattatcatgaatgtgtcagccatttaaaaaattagattaggaagaatttcacaatagttcattgtttactttagttgaactggtgggggaaccacgggggatttgagtcatactttcttttaatattttcttttttcttttcctgtgttaacttttgtatctcacatttcttagttattttcctctgcttcctttttctaatttaatgctatttgttctcatagaattaggggagctgagcactttctaaggaaatcctagaatgcagagttaattttatacttattactacattttcaccgcaaaaaaaatcatgagcacacattgtagggtacatttttaagaacaattcgattttctccctgaatatcatttgcctgggcaccctgaatgcagttcactcgcctgtgagagtttgcaggttggtagttgatatggtttggctgtggccccacccaaatctcatcttgaattgtagcttccttaattcccatgtgttgtgggagggacccagtgggagacatgtgaatcatgggggcggtttcccccatactgttcttgtgatagtgaataagtctcacgagatctgatgattttataagggatttcccctttcttttcgctctcattccctcttgtctgctgccatgtgtcttgtgtctttcaccatgattgtgaggcctcccctgccgcgtggaactgtgagtccattaaacctctttttctttataagttacccagtctcgggtatgtctttatcagcagtgtgaaaacggactaataaagtagtgaaatgaggttttttcacctcatggaaaatagacattgtatgacccatcagtttcctgttattttaaccttcactagggtcatgaaaaaactcagagcaagttgtatttcttctctcctacttgctctgtcatctgtagaaattagctgaggtaaagaggcaccttcttctcattaatcattgtaagttaaggaataattttattgctgtgaatgttttgggccgcatgcccatttcaaagttgaagatgttaagccgacccattttctcataagatgtatgtttctgcatcttcaaccaatattccttggtctgctaaaatacattagaaagtaggaaagataaatagactcacatagctgttttgaggcagcagattgaaccataaggcatatagaagttatagttttatgtctgcttataccataataaataacttcaaaaatagacaaattctttgcaaaataaaactgtaggataaaccagaaggctagaaacacaaaatactgaatgatcaagtcaaaatagaatcctcactttgcttagtgaccaaacctgattcagaataaagcaattatgcaaggtataagaacatcaggtgaaaatgcctctaaataaataaaacgcagcatttgtttcacaaatatttgaaatttcaatataatagaacacaaattaaaatggcttcattacagaaattatagccttaagtttgcctttttgtaaaaaaaaaaaagaataattatattctatctttaaatagattgtaaacaccacaagcagggtgtgtgtgtgtgtgtgtgtgtgtgtgttattcactaatgtatgtccggcatatagaaggtgtacaataaatagttgttggatagattttataaaagagtttcctgtatataatctcatatgatttcacctgatccagcagtcttaatgtatagtagacactagtcatatgtattagcccataggcacagactaaagagtgcagtacccatctgtgtctgtctacttgatagacaccaaatctctcagtattcattggatggtgatgccttctgcaaagatttggtcagactcaattcagccccctccattcactaccgcaacaccatattttattttatttttacttatttatttttgtttctatttttttagagacagggtcttactctgtcacccaggttggagtgcagtggcaccatcatagctcactgccatctcgaactcctgagctcaagcctcaggcctcccagagtgtgagccaccactctcagctcatactttattttcttaataatttttacaattagaagaaattatattattcagctacacatttactcgtttattgtttctcccatcccactaaaatgtaacttccatgaacaaagggtccttgtctgtcttagaccctaaggaagtacctcatacccagtagacactgcaagatttctatgtataaatgaatcagtgggtcagccatctacttggaattatttgtctggattatcttttgttcaattattctctctctttgcatactttacttgagtggcacaactgtttgtctgtttttgtttgtatgcttgtggcttttctttttctctctttcctcccccgtgatgtggatttcctccttggtgcacgggtgaggcaccctcgaagacctagcaggatcatggtagaatctaagaaaaaacaaccgtgaattcaatggcttaagctagctcttctctattatctcaaaaaaggtatgttgtttctaccttgtattcatcttcatgtttcctctaatctcatcagagaggtaagaccacaggagtcaagaataaggaaatatgtgccacattttctttatccagtctatcattgatggatatttgggttggttccaagtctttgctgttgtgaatagtaccccaataaacacatatgtgcatgtgtctttatagaatgatatataatcctttgggcatatagccagtaatgggattaccaggtcaaatggtatttctagttctagatccttgaggaatccccacactgtcttccgcaatggttgaactaatttacactcctaccaacagtgtaaaagcattcctatttctccacatacaccatggaatactgtacagccataaaaaaggatgagttcataccctttgcaggaacatggatgaatctggaaaccatcattctcagcaaactaacacaagaacagaaaaccaaacaccgccatgttctcacttacaagtgggagttgaacaatgagaacacatggacacagggaggggaacatcacacaccaaggcctgtggggggatggggggcaaggggagggagagcattaggagaaatacctaatgtaggggacgggttgatgggtgcagcaaaccaccacagcacgtgtatacctatgtaaaaaaactgcacgaaataaggaggccagtgggcacatctaagccttcagctaggcaagaaaatgacctttggagtctcacattcattctgttccttctgtttaccataataagatacagcacagggttgttttttttttttttttttttttttgagtcggagtctcgctctcttgcccaggctgcagtgcagtagcacaatctcagctcactgcaacctccacctcccaggttcaagcaattctcctgcctcagactcccaaagagctgggattatgggcacatgccaccatgcccagctatttttttgtatttttagtagagatgggatttcaccatattggccaggctggtcttgaactcctggtctcaagcgatctgccctccttggcctcccaaagtaccgggattacaggtgtgagccactgtgcccagccaacacagggtaacacggtcaaatcctcagcaggcaatactagcatgtacgtttgccttaactgtcctttgcatcacagttattccttggcaacccatgtgacaaaaagcagctggcaagttattcaaatctctgcattacacagtcacctatcaaaactaacagcacagacattacagatgaggaaacagcctcagagtagtcatgagacaggactgctcttccccctacatcctgtttcaattacttttcactcactgagaatgtgaaaaataaaatgaatgttgtaatacacattttcattattatttattccttggttgggtggcaaactgttaaggtaaattgattgtaagaccaccaggcaatgctaaagacataaaccagccttaacatttaaataataggaacatcctatgaccacttcgactcattgatttgtcatgttcacttattgcttctttttctccttccaggcaattttctggaaagactgaaaagtttttgttctcattttcttcaatatggcagtaatcctaaatcttaaagcaataaaaatagccattataaattcaaggaaagagttggaatatttttttataaaaatctgactatgtcctctcactcaagtcacttaaggagttatttgtacagctcctgctgctattcaaagtagccagagctctaattcaagtaatatcctttcttcttcaattccgcatacttcctcacccctgtgggtcagcactttgttcagtatttgtgactggattactggtctttccccaacaaccactatttttcttccatttctgggtttcttctcttctcacgttatgaaagccatacttttgtacttagcttttacactttcgagaacattcggtctttaaaagcaagaacactgtcttagctatcttttgatctccaacagtgattgtctttacaaatggaagcaatggtgaatatgcaatgattatcctttcctctttgctccactcatccccaataatttaatatgtttgtgataattagatttgcattgaaaatggaaatttagagaaaactttaggctaataatggacattgtcctctaattggacattagctgtaacaagtctaggctagatcctaaggaattaaccaaacaccctaagcactttcatcttcaatcctattacatttaaatgggtatctaggtcttttgaaattttaatcacctagaaagctgctgttagtttcctagagcctgctgggtgaaattattatcccacagcatttgtactgcaagtcctagacactcttggagaaatagcaccacataactttctcttcccttacagtcaaaagtggtaaaatctccaaagagatgactcaaagcctggtcaaggaactatatcagtaaacacagtaatcacatgagtttgtcaagatgaaaaattggctccttatgtgaaaccaaacagcttttttttctgtgtcaccattccaggcgaaaaagagaatgatagctttgtacagggtgggtagagagggtcttgttctgggttctgatatataggcttaaaatttaaggggaggaatttagttttggcaggaaaaagttctcaactgtaacagttatttgacactggaatgtaatataaaagaaaatcacaggttgcttccataagattttagatttttaaatgttgtactgaatcctctgagggctactaggagcaaagaaatagcatcttaaagaagagacctgtgattctataaatgtatttaaatataatgaagagtttgctaacactagtgattttcaaagagtggaacaagtaattggaaaagtaaagaatatcattctaaaggtttaaacacaaaaagatgtatacttcaattagacatggtttctaaaattaattcagtattcaaaaatgtaatcccaaacgtaagtatctctggagtcaacaacatcaattaacactttacactcacagaatacctggcactaagtaaaacattcccaaaataaagtgtttgccctctctgcattcacattcggcacgggatggtacaacctgaatattacaaagagtcagtctgaatccattttaaagtttgaattataaatcagttgtagagtcagaattatacaactttaggggagaaacatgagtcaccacggttgtaaatcagaattatacaacttctggggagaaacattggtcactatctcataaaactaagattctttttttctcatttttgttttttaaatagctgtcttctttttaagaagaaaaaaaaccatacactcattaactttctcaatatctgtcatggtcacattttaagagatggagaaaaacaatccaaatcatttagcgtaccacaagtgaattaatccacctttctcagagatagttgggatattttcatcccagtgttactaatcaattacaaagcctactctggagaggaaagactctaatttaaatgcaagcagcatgtgaagctcttcttttttattattatttcaagtaaattgtttcattaaaaacctcaggaaggagatggcttcctgtgcttgtacagagaaaagtgcccgggacagataaataagtcagcagagcccaaattaacttgcttcattatctcatccactcacctacacagaagaatctacctttctggatctctcccttcctccgcgctctctccccacgtcattgcttcccatccgggagaaaagactagagaacaagtttcagttcactctctctgaacacttccctggagacggctctaactttgactattatgcacttcaaatgttatgcagcagcagctgccgggcatcacgtcggggcaatatttaaatattatgcctaccagctgtgttttcttaaatagtacctttaaacgtcagtggctgtgtttgtgatagactctacaaggcatggaatatgcattgcaaaatcattttctcctctagagatttaacagttccaaaaatgtctttacatcggtaagaaaagtttgcctttcttcaacgcttccccccttatataactgagttaatgagtgttccttgcttgcagctatctttccaaaggcaggcaccaaatatgaaaaaacattcatcagtgaaactttaagcaagagaataagccaatgcattgaaacctgggtaatgggttccggatgactgaagttgaacaagagtcgcagtcaggactgggggccattatgataactataaatagaagtaaggttagcgctactggctctttgatcatttttcagtctatagctcacaaactcctgtcgttaaaaattctaagaattactatgcaattgagcaggcaatgaatgttttttaatacacaggttttttttgtagaatgtgtatacctgaaccactctttttaggtaatcctggaaactgtatgcaaaaaaaaaattttaaaccgaaattagaaaatattatcacaaaatagtggctcgtgtacaggattctctgaatccaaatgatcccaaaccacatcacaaaacagttaaattagtgtaaaaatttatgtaggaagacagattgttatttccacactgtaatagacagagtgactcattcccctaagggtaagcatgcatcctgctacatttttcaaatgttataaaggtaacttatctctagtccatattgtctccaaaagtaacagtcagggtagcaatactgcagataagcaagaataggacaattggacaagaccaggggcttaagtcttgtcacctgttatctagaattggtctggctttgacgtattaaattctcattctaccacatcttttaatttctaggtctactgcctcctctattttcttggatccttttcaaacccatcctgccttcatattctatactaattacttagattctattatccatcatgcatcactttgttcacactttgtcaatattttcaacttttttgagccagtgttcttccttctctccaaagtttctattacttgttaaattagagagatactagaacaagctagtgattacttaaaacatgaatatttcatgtttattcaatctttccataacccttgtttagaatacactttagccactccagaattttgcaattcttctgtaccctgagaatatacatttgcatttttacctttttttcaattttctctttgctggcagttaaagattaatttttctctttgctctaatagccttgtgcgtttgatgttggtggctaataaattcataatgctaatgatcttagacatatctaagtatcttttggtcttcaaagtgctaataattgaacttccaacacggttaagtgtagaggatacaccctcaggctctgacagcagttccaaatatcatcagacaactgagaactcttgtgctgagtgacctgggatttcttaagcagattcaactgaaccttacaatatttaagggacacccagaaagacgataattccgctacaggaagcgggaatgccaacaatcataaattggcaacataatgcagaaaaggacagctgagtttttgctaatgccaaggcagaagcagtagagggttgactgacactaagaagattatctctggattttcaatacagcaggcaaatgaatactgcagataaacacactatcaactttattcttacaaccctgatattgactttaatcttgaccttggaatggcttctctgtacacacaaagcctgtttgaaatgacatttttttaaggtgaaacaataatttatctagtgatgaacttgtatttagatgtttacagctggccagccaactaagtgctttacatacatcttgtctgatttaatccttacaacaacatgatgagctcactatgaactcccataatttacagacagggaaactgaggcttggtgcagaatcaatccaatatcagggcctgagcaattatatcccattcctagactgcaccccagtagtttgtgtttcagtattctggcttcctatagttaacaatctggacaattaccgataattataaaaaacaagggctgataattataaaaagcaggtactaaaaacagtgcagagcaaatgacagtgggtaattgacaggattcagggtataagaaaaaagaaaagcacaattcaccgcaagttctagccttctctatgggaaaagcaggccactgactatgtagtgatctttacgaccttgaagctttctttagccagaaattgaaggtctttgtctccagtcttctttagagccaggcattcttatccttaactactttaggggcttttttaaggacacatgtatattaactaggctgttacgtttcctaggaagcggaacacattaattaagtgaaggaattatttcatctactccagatcattactatctctttttcgttttttttttttttttttttgagatagagtctcactctgttgtccaggctggagtgcagtggcacaatctcggctaactgcaacctccgcctccaaggttcaggcaattctcctgcctcagtctcccgagcagctgggattacaggcctgtgccaccaagcccagctaatatttgtatttttagtagagaaggggtttcaccatgttggctaggctgctctcgaactcctgacctcaagtgatccacctgcctcggcctcccaaagtgctgggattacaggcacgagccaccatgcccgtccatctcttttcaattaatagacacacacatataaagatttctgtgaagagacgttttacacttcacttattcaagtcctagatccgttcccatcacttcagtaaagctcttttgccaaggtgacctggtggttatttttagttcttatcttattctctacagtattctccattcgacatctttctccatttgaagtagtccctttctttggatatgagcgcattactctctcctcctttccttgttctctgactctcacagctccctctctctgcaagctactattcttttaccgatccatcaagtgctggagtttctaggggctctgttccaagcgtcttctcttcacactctacatattcagtctgggcacctcactcactcatgcagtttcagtttccatatttatgcagacaaccctgaaatctctatcttcagctcagaattctacacagaagttcaggcctatatatcaaaatgtataccagctctcttagacaccctgcagacaccttacattccataattcgcaaaatccagttgtctttctccaactgaaaaacctgttcattttctgtatctcagtaacctgagtgtcacagtcctcatcccccatatcctatcaaccaccatctcctgtatattctacgtattaagcacatcattaccctctgtcctccttatcgctcatttaatgccagatgccatctctcctctggattatacaaccaactacagaaggtcttcatgcttcttggtcccatagataggacctgccatgttgcccaggctggtctcaaactcccgaccacgagcaatcctcccacctcaacctcccacagcgctgggattacaggcataagcctcctcacctggcttcactctactattaataacctcaaatttgcatgctgctctttactgctattaataagcattaaaggcttgcagttggtgtcttctcagaaggctcttcttctacttcttagaaatagaataacaaattctacattgccttctattttcaagttagatgctacatccatagcaaagtttcttctaactccaggatctggctagcctactcccgctgtgtgctgccaacattcctaatgtgtctggaattggtgggttcttggtttcactgacttcaagaatgaagccacagaccctcgtggtgagtgttacagttcttaaaggtgatgtgtccggagtttgctccttctgatgttcaggcatgttcagcgtttcttccttctggtgggttcgtggtctcgctggcttcgggagtgaacctgcagaccttcacagtgagtgtcacagctcttaaggcagcacgtctggagctgttcattcctcccatccggagttgttcactcctcccggggggtttgtggtcttgctggcctcaggagtgaaactgcagaccttggcggtgagtgttacagctcataaaatcagtgcagaccccaagcgtgagcagcagcaagatttattgcaaacaccgaaagaacagagctcccacggtggggaaggggacctgagcaggttgccactgctggcttgggcagcctgcttttattccctcatctggccccacccacattctgctgattggtccattttacagagagctgattggtccattttacagagagctgattggtccattttgacagggtgctgattggtgtgtttacaatccctgagctagacacaaaagttctccaagtccccactagattagctagacacagagcactgaatggtgcattcacaaaccctgagctagacacagggtgctgattggtgcatttacaaaccttgagctagacacagagtgctgattgctgcattcacaatcccttggctagacataaaggttctccaagtccccaccagatcagctagacacagagcactgattggtgcatttacaaaccttgagctagacacagagtgctgattggtgtatttacaatcccttagctagacctaaaggttctccaagtccccactagactcaggagcccagctggcttcacctagtggatcccacaccagggctgcaggaggagctgccccctagtcccacgccctgcgcccacactcctcagcccttgggcggtcgatgggatggggcgccatggagcagggggcggtgctcctcaaggaggctccagctgcacaggagcccaccatggccgggaggctcaggcatggtgggctgcaggtcctgaaccctgccccacggggaggcagctgaggcccagggccagcactgctgggggacccggtgcacccttcgcagctgctggcctgggtgctaagcccctcactgcctgggccggcggcagccagctgctcccagtgtgggccgccgagcccacacccacctggaactcgagctggcctgcaagggctgcgcagccccggttcccacccatgcttctccctccacacctccctgcaagctgagggagccagctccggccttggccagcccagagaggggctccctcagtgcagcggtgggctgaaggtctcctcaagcgccgccagagtgggcgccaaggccgaagaggtgctgagaaccagcgagggctgccagcacgctgtcacctctcactaatacttattcctctccatgtagtaccttaattgcttaatgctacatgaatgagaggaatgaatgagatgctagtgctgtaaattttcaacatttaaagtacttaagacagagaagtgactagatgatatggtggataggggagttatactgaagctgcatttaaatagcaggcgtaatgtttctgcttctatttattgtttatttggtatgatttggaggggttcattattactatgagagtaaattgggtctatgagggtctaaaatttctcacaagccacccattagtatcactaatgaaataaaccagtggtttgcaaacatttttcatttaagcttctatcagtaaataatatgagcatgtacctttaatgtgtggattttataatttatagattatacacatgtacttatatataatataccttttaaacattctcagaaacaaagttttaaaaaattttaagataaatggagattctaaatttttctataccttggtcgaccatctattgatttctgtttaaagatcatctttacaaatggtttgtttttcatttctgtgggtacatggtaggtgtatatatttatgcggtacaggagatatcctgatacaagcatgcaatgcataataatcacatcagggtaaatggggtacccatcccctcaagcatttgtcctttgtgttacaatccagttgtacacttttagttgtttttaaagtacaattaaattattactgactatagtcaccctggtgtgctatcaaatactaggtcttattcattaaaaatgggttttgaagacaggaaatgtattaggttggttagctgctataacaacatcaaagatgggtctagcacagagctcaggatatagtaagcacccagtagttatcaagcgattgaaagacagaaagtttgcgctaaagagtagagtagcttatggaatgcggtctaaccaccagtgggatgcatgaacactcacaagataactccttcaaggaaaatttctcaaaaacatataagaaaaagtgcttgctcgccaagatggaaaagacaaccatacatagacaaacactccatcatttccttttaaatctaagcagctttttgatgggttttgtaaaactaatttcaaacattttcaacgactctcaaaatagttgtgactattaataaggtttgagggagagagataagaatagattcattttcataagcaaaattatcactgtatttgtgaatactattttacttcaaatattttccttgaagatttctatcttaagtggtttttagaactaagctatgccaaaattctgcatctgtgatgtcagaaaatattacccattgttctggccacataagggcaaagtacaatttcaaagacatactgaaaatggtggccaaggtttcacagtttgtcagaagttagctggaaaaagaaaaaaacattattgccagccacagtggctcatgactgtagtttcagcactttgggaggccaaggcgagaggatcgtttgaggccaggagttcaagaccagcctgggcaacatagcaagaccctgtctctccaaaaccaaacaaacaaacaaaaaacgttttaaaattatctggacatggtaacatgtacctgcagtcccagctactttggagactgaggcaggaggaccacttgagcccaggagttcaaggctgcggtgagtcacgatcatgccacccagcctgggtgacagagtgagaccctgcctctaaaagaaataatcattcttttttgtatgcacttcacctcccaataatagtatttaattcctcaagataagcaaacaacatggtgttcatacgccttgagagaaaggactgtaactaagagagtctcgtcgagttcagagagtggtagattgtaagagttaaaggaatttttacaggtcacaggcaaacacaagtgctatagcttgaattctgaggctttgatttagacgcatttggctgtttttctcaaggtgacagaaaaaaaaagtcatgcattcctactcttttctgattcttgaagacaaaacctggcctggcctgggaagctgaaatatctgatgagtttgatttcttccctacaaaatgttcatgaaacatttgatcttctgattcattctattcgtttttaatagctttaaacatacaataagttttaggtgtacaattcattggctgctaggaagtgtacagagctgtgcaaccatcactacaatccaattttaaaacatctccatcactccagaaaggaacgccatgtctgtctgcaggcactccttatgaccactgcaactcccaggttaccattaatctactttctgtcactatcaatttaccttttctggacttttcctttaagtggaattctacaatatgtggtcttttgtgtctggctgattctacttagcaccatgtttctgaggttcatagatgcagcagcgtgtgtcagtactccatgcctttccattggccaatagtattgtgttgtgtggttatacaattttttgtttctctactcatcagctaatggacatttgagttctttccattttctggctaatataaataaaactgtgaatgaacatttacatacaagtcttcgtgtgaatatataattttatttttcttaggtagctagaattgaaattgctgggtcctatggtatatttacatttaacattttaagacactgccaaacttttcccaagcagctacaccatcattctaccttaaatttcctgagtaccaggtaaatgataatcgtggtgttttgaacaggactacatttgctaaccaaaatagaacataaatttctgccagctcttagctcttaccagttaatatacttccatcattctatcatttcatattatcccatctattgctaaagtgatataatctgataagcaaaattgatctgtagagacgctaaaattaaatgctagttacttggaactatttggagattcaaattcaaatgggccattaaaagttacctttcttttttttgtaaatctgcttaaaaaaccccagaagcattcatatcactcctacatttcttccgaaaatttccatcaacatggtaaagagatcgagactaataagtacaattatatgacacagagatccttcagcaagccatctctgtaaagaggcataagggagtccatcgatctagtctttagagcagagtgacatttctgtgaaaaacaatattttatgtcagactgttgcttgagtagtccatgaaggataaagaaacaaggaaactaaacactgttcacagatcaacaaatgtcttttctcctcaagtgaattctgcattgtcaaactcagcaaagccaagatataaccatgacgttaaacagagttcttaattcagcttttcacaaagagagaaatctaaatttcacttatatttttttaaaagaaaatctacattgaatggaagagcaaggcctccacctagtggatagttcgaaaattttgttttttacagtctcatttggcatttatatggtaaaatgtcataatggatatatagagtgaacgacaaaacagaaatgtcgctaattagctctcacttactaacgaagccagttaaaacttgaaaataatttcacaatctttcagggagacagggaaaggtacagtcaccaataatacatttagaaataaatgtaggcaataaaagaaagtgagacgaggcaaacttttaaaggtatgaagaacatttagctagacgattaaaaatttgtgtgtataaaaaatcctcaagaccacatgaattaccatattgatgttcctcagtttcaggcaatcaatggggttattttccaccatcagctctgtagatagcacagatttttcttcttttttttttcagacagactcttgctctgttgcccagtctagagtgagcaagcagcctctcactagagttcactgcagcctggagttcctggggtcaagtaatcctcctgcctcagcccgccagagcgctggtattacagatgtgaaccactgcatctggccaactgttcttttaaatcatgtcactttacaaagcaattataggaatcttataaccatatataataatttccaaattgtatggctactataagttgattaaaagtctagagaacaacagatttgaggcttataattgtactgtaatgcatgctttattcattaggatctcagcacgtaggcagacattaaacaaaacttatgctaacatttgaggactcactgtattctaggcactggtaagggcttgatataaattatcttctataatccccaaaacaatcctattcttcccccttggtacggatgaagaaattgtgccttcaccacagaaatagcagagctggaatttgttccaggaagtcagactccagaggccacgttcttaagctctgaatgaaaacagaaaaaagcacaataaaaagtgaacgcacattgagaaatgtgcgttcactttatattgtgctgtttttaaggagaaagcgtatactgttctaatttatattacttatttgctaattttcaagaaatttcaaacttcccatttcagtgttagaactgaagtgagaatcagaagccctgagctctttttccgtctctaccgcccctttgacatcagaccagtttttgacctttctaataaaatgacctgtatccttgtgatatggtttggctctgtatccccacccaaatcacatcttgtatctcccaaattcccatgtgttgtgggaggaaccctgtgggagataatggaatcatgggggcgggtctttcccgtgctgttctcctgatggtgaataagtctcacgagatctgatggctttaaaaacgggaattttcctgtgcaagctctcttctcttgtctgccaccacgtgagacatgcctttcaccttccgccatgattgtgaggcctccccagccacgtggaactctaagtccattaaacctctttcttttttaaagtgcccagcccggggtatgtctttatcagcagcgtgaaaacagaccttgtctagtgctcttggtattgaagccttgtggtgctgtattgaagtcaatggggatataataggtcatccctaagtggatatgttcctcatgcccactgcaaggcaaccataacagagtataaaacatgagcccaaacttccatgtataaaaaaagtgcacttgagagagcatgaagatcatttggttcaacatccctgtctctgtatttcctttgccttataatatcgttgactaggactcagtgattccccacagcggtgcttttagcctttgacgcaattcttggttgttgaggattatcccatgattggaagatagttaacatctttggccccaccttcaaaatgctactagagcgctgcacattttcaaacacatacctaggaaaaaacagtaaaacctttcgtcaaaaaccatgcgaaaactcctagaatctttatctctcactcagcccagagattgtcaacaatagagaaacatcacggaagacaaaaaacccacaggcactttgagtccaccagtcaacagcctatactgattgctggtggggttccctgtatccagcgaggaagacagaatgcaaagccaagaaaggtacatgaaatgtgtggtagtggttcctcttgtgatcaagcagctttagagattggcattgaaaatatagaactatgatttatgatcttcaacatgaaaatgatcattgatgcgacacagaaaaatacaaaacaggattgacggccacaatgtgtatatgtgttgtgagtgtaaagggtagaatatttcagactctctgtgttaaccaaaaataaaattattttcttgtttttctgtaactcaacctcaatttgaacacactatttcacataataacagaaatttggtctaatcattcaaaacaaactccaaggttttctcagtcatttcttacgtaatctcaatattctctctctttcattccttttccatttgtggaggtgagaggctaataatagtaataattataacaatagctaaaatattaagctactattaacttcttaaggtgcaatccctccctcacaccactccctgctttctcatccccagacagctgatcttctttctatcgtgatagattagtctgcatttttatatgtcattttatataaattgaatcataccatatgtactctttttgtttggcttcattcactcaacataatttttttgagattcattcatattgttgcttgtattaataattcattcctttttattgtgtgaatatacctcattccattaaacaggtaatggaaattttggttgtttccagtttgtaaccatcacaaatagagtctctgtgaatattaaggtacaacctgtttggtggacatatgtttccactttccttctactcttcctagaagtggaatgcaggggtcatacggtaggtgttcatacatctttctaagaaaatgccaaactgttttccaaagtgattttattattttacattcacaccagtaatgtataagagtttatagtccctccagcaaactaacaaggaacagaaaaccaaacaccacatgttttcactcataagcgggagttgaacgatgagaacatatggacacacggaggggtacatcacacatcggggcctatcaggtggttgggggcaagggtagggaaaacattaggacaaatatctaatgcatgtggggcttaaaacctagatcatgggttgacaggtgcagcaaaccaccatggcacatgtatacctatgtaacaaacctgcacgttctgcatatgtatcccagaacttaaagtaaaattaaaaataaaaaagtttacagccccccaatatgtaatatgctcagacttttaaaatttctgtcatttcagtgggtgagtagtgataactcattgtggtggaattttcatttccctagtgactaatgatcttaagcctcttttgatgtgtttatcatctgtataactcctttgataaaacatctgtttgtatatcttgcccattttctactatgctatttctttttattagacatttttatgttctaattacaagttatttatcagattcatgtttgcaatatttttcctggtttatttgcttaacagaataaactgttttagatggtaatgcacaatattaatttttttctcttatgaattgtgtttctggtgttgtatttaagaaatattttccaaggccaagaccactaaagttttctcctatgttatcgtctagaagtcctatacttttgacatgtttttttcttttttttgagacagagtctcactctgtcacccaggctggagttcaatggtgagatctcggctcactgcaacctccgcctcccggattcaagcaattctcctgcctcagcctccttagtagctgggattacaggcatgcgccaccatgctcggctaatttttgtatttttagtagagacagggtttcaccatgttggccaggctggtctcagactcctgacctcaggtgatctgcccacctcagcctcccaaagtgctgggattacaggcatgagccaccacacccagcaattttagggtttatatttaagtctatgaaccatttcaatataatttttgttgatattgggaggtaagagttgagtattgggtttctgcatgtggctacgtgattgttcccaaaccatttgttgaaaagattatacttttcccattaaacgcattccacttacctatttttctatccttacaccaaaatcacactctcttgctcactgcagatttatatgctaagttttaaaatcagttaatgaagacctccaactttcttctttttcaaagttgttttggaatttctacgtcctttgcatttctatataaatgttagaataatgttgttaattgcctgaaaaaaaaggctttctaaggatttggttatcattgtgttacacatgtagatcatttgggggataattaataataacattgaaacttatgatccaaacactgtatattctccaattatttaggccttctttaagttatcttagcaatgatcggtagttttccaagtacgggtcttgagaatctttcgttaagggtatacgtcgttatgctattttttttttttttttttttttttttttgagactgagtctcgctctttcgcccaggccggactgcagcggcactgtctcgacttactgcaagctctgcctcccgggttcacgccattctcctgcctcagcctccccagtagctgggactacaggcgcccgccaccacacccggctaattttttgtatttttagtagagacggggtttcaccatgttagccaagatggtctcgatctcccgatctcgtgatccgcctgcctcggcctcccaaagtgctgggattacaggcgtgagccaccgcgcctgacctccaatgctgtttttaatgtactttttaaatttatattcctaattgtttgccacccatatatacaaatacaatttaattttgtatttatatcttgtcatctctagatataattggttttacttcttctttttttatcggcatgacttttgtttgtttttcttgcctattgcattggatagaacctctagtacgataactgagcaaaagcaattaaagcagacatccttattttctttctatccttagaaggaaagcattaagtctttcaccattaagtttgatgttaactgtaggtttctcacagataccctttattaaggttaacacagcttctttctctgctaattgtttttttcagaaatgaatgttggattttgccaaagcttcttccacatctactgaggtgatcatatggttcttttgtaatctgttaatgtggtgaattacataggttgattttcagtgtgaaaccaactctgcagtcttggatgaattctactggatcattatgtgatatctttttaaaatactgttaggtttggcggggcattgtggctcacacctgtaatcccaacagtttgggaggccaaggtgggtggatcacttgaggccaggagtctgagaccagtctggccaacatggtgaaaccccatctccactaaaaatacaaaaattaactagtgcccacctgtaatcccaactacttgggagactgaggcagaagaattgcttgaatccaggaggcaaaggttgcaacgagccaagatcgccactgcacgccagcctgggtaacagagcgagactctgtctcaaaaaaaaaaaaaaaaaaaaaaaattgttgggttcaatttactaaactttttgcaaaatttgtgcatccatctttatttagccattggtttgtagttccctagaaatttctttggaaagattttctggaaaaggttgtattgaattggtactatttacttgacatgattaacacatattcacatattttaactcttaatctccatgaaaacagtatgaagcagaccattatcatgattttacacagtgattaattcacttgcccaagggtcataacttataaatcatggggccagaattaaaactttgtcagtctaataaagacgcactacttcactatactaatttcaattacagtcaaaatgaaatcaatacctttaatatataagtagtatatgtttggtaatctcatttaagcttcattgttcatagactgagatcttggcagaaagagtggaggacctttgctaaggatacatctagctctttggaaataacagtatctaacagcatgttaaaataggaaacttcttgccccagcttttggtgaggtccccaaaggctcagaaacaaaattaaaggttcaaatttgcaaaaatgatgtttaaaaactgtttttatgagccttagttaacaatcagtcaagggttggtagtagaagaggctgaaatatgtgaaagctggataattgaggcattctcccacctactcctctttgccataagtctaaaaagaggagattcgagaagaccacctgtagagctacctattgtgtgagaagcaaagaagctggtgtctgactcaaggctgactagagcaaatgcaaaaatccatgctgtgagctgcttgcaatgtcaggacaagaaaagcacagcaaagaaggcagctattctttcataatttagatgggcaatgatgcacgagttgcctgagagaaaaatggatgatcaagaagaagttcaacaggtcaaagtcccctgaagagctcattcccaaaaaataaaaataagaaacaaaacaaacagccagggtaaggggacctcagcaaaaagaagctatgggtggtacctttgggtattgatgcctgttgtgagacctcgattcttttcttcttagtttgaaataatttacacaagcaacacacaggaaaagagatgcaacatagagtaatttattgcaaaggaaaaaaaatattttgaaagttaagtgcagaataggcaatacacactgagaggggagtcagagtgacctgcccgtgaggatgagacagcaaagactggcactagggagactccctttatgggaatcttacgtaatcatccatgagcaagtgggaagaggtgtctgggtggccctctgggcacacatgcacagtagctgtacatgcctgttcatatgtcacgtgtctcattagcatcttaaatctccacccagggtgtgtgttttttagtattatagtgagcacagggtcagtctgaggacagataaaatcaaagtgcacatgctccctaccggggaaattccctactggagatagctttgcttgaataagctggactacagtgcaaatgtggggggttattgttttgactgtatggtcaccatgatggatgcatcccaaggacatggctatttccatgactacctatcctgccccacagaggctctgaggatgaatcacaagaagttagctggagagtgaatctcccacatgagaggattggagcagagggcagccaagaattcaccctgcaaaaaaaaacctatttgaacatccatcattctcaaagaaaaaaaaacaatggtatatctactacgtatgcttcatttaaaaattttgaattattatccataagtatgactggtcataggaggggtgtgtgtgtgtgtgtgtgtgtgtgtgtgtgtgtgtctttgttaggttttgataatgcgtttatgttggctttgtacaaggaattttctgttgtggcccaagtaataatgttttcttacagtcttaccatcttagatgagacttaaagaggcccagagaacagcctgtgttcttggtaaaaccacctttcctactcactctcacctacaaacccctacagcattctcagtgaccacagtaaagtaacttacaggccattgacaaaaaggagtctattatatggaacatataatcactattccctcgttgctcctgagaacccaacattatgccttcattccattcacctcaacaatccaatcttatcaagcacactgctctaccagatttttaacctcctaacactttgtacatccacaatctaaatccaataccccacctctcccaaatcccctatattccttctctgaaactcatattcatcagtgtagtctataatatcttcaccctcttttctgagcattattcgtccttcttcatgaacgcagtctgtcttctatggactctgatattctgtaactctttcaagtagaggtgattttttctccatactatatgtgccaccaaacctaaaggtagattagatgtcagactttttcctccttgctacatccaaacatcttaccccctacttcttaaaacccccttgataattcagagcacatgccatcagaacatgacacgcttaatgtactgagaactgtagcactcagcacgtgactttctttcaactgctatcatcaacttaggtaagtcgctatgcctgtagagtcaacaccttgcccctccagtttcttgacctttttgctttcaataattttcttctacatcctgcctcttccaccaacaactacatcatcttcaatatctgggttttgatcacccctgtctctgataattacttcctctgatgacttccaattaagttggaattatgatcactggaattatggaatggatatggaattataataattccaataagcttcactcctattactcaaggtaatgtcaaactcactgtatctgtcaatccactaagctggccacttttttatgctacaacacgcatctcacgccctcccttccctccttacccagcttagatcccatgacctaccattataatgactaccacacataccctcagccccttcatccactttttcttctttacactcatctaacaaaacatcaaccctaactaaattcaattccaagtacaactctaagttctacatgtttattaatctcttaattgattggatttctacattaagtactttttccaggaagaatcatggatgtcgtattccctaggtccttgcattttcaagatcatccatctgtaatcttcacacctgaactgaaacgagccaggtataaatattcttattgatattttctttctctctcaacagtctagatactcttccactgtcctctggcactgaaaggttgtgtggaaaagttctgaaaccagtctgatgtttagttcattgtttagttcattttttcccttgaatcctgaatatttaattatccctaagaatcagtaactttgccttatgtagattgatatttatggaacatggtgcacctttccattttcagatgttaaaacttactaatttctttatagtggaaaagttgacggggggttgttttctcattatatcttggaatatttttcggtgtttttttaaaatccagaaaaggttaattgttttttatattgaccatgttttctgtaaattctttcatgctttatcttttttctttgcattatccgagttatttccagcctgtttgtcattggtttaattttcaacaatgcctacctcactattttttattagttccaatattatgtctttttatactcaattcatttccctagttctcccatactattctctggtctgttatcttttcatctttgagttttggttttatatagtctatacactttataatttctttaaaaatgcaaagcattagttgtgaatgtttttcttttgttttctagggcgtgttctcatttagagtactacgcatgagaaggtcatttatttcattttttaaataatcataggaacttctcatagttgttatcctgtctcttctcatttcactcatattagacaaggcagctcttctctttgcccatgtgtgagctctccttgaatctcttcttatctgcgatctaagagtgttgtcttaccttcagatggtcaacgtgaagaatgggtattgataggtcacactcactctgctctttgtttatctgagattgagaagctagagagaggaagctatgggcagttaggaagaagttggtctcttctctattttcctattgattttataaaatcctgttctgtattttgttttttctagtgaaatgttgacttctctccttaattcagagtgagctgctgaatcttccctctacaaaatatcactcattcttactaggctttattcctctttccactgaatattgagcttctaagttcaaatgggagtctttcaggctagccattaacttttcctgttctgtaaatgccaagataaaatattatgagagattaaattagtaaatctagttagattttttcttataatgaaaatacaagctggaaaattggagaatgctgtacaacccttccaaactccaacatgttcataagctcaactttcttaaattgatattaatattgtcatttcttactaacaaggactgcagataagctttagggactcttttttcctttctttctttttatttcaacctgttgacatataggcaacatgtccactataccatgattttaagtgctcctttcaaattcatatctagcccttcttcctaacccattttgggggtaaaaagttgctgagttcaaagtcctaacatcctaaaggacttctttctaaattaagtgccataaagttcttatcaaagaatatatggatttacgctatcaaaggcttccatagaaacctctaatttgactcaaatgaaaagtttagtccttttaaaatgaaaacattaaagcaataaggtgaaagcatcacttccattgatttagtaaccagtgacttctaagtgacttttaaatttgaatctcttttaaaaaccagaaacaggccgggcacggtggttcacacctgtaatcccagcactgtgggaggccaaggcgggtggatcacgaggttaggagatcgagaccatcctggctaacacagcgaaaccctgtctctactaaaaataaaaaaaactaaccgggagtggtggtgggtgcccgtagtcccagctactcaggaggctgaggcaggagaatggtgtgaacccgggaggcggatcttacagtgagtcgagatcgcgccactgcactccggcctgggcaacagagcgagactctgtctcaaaaaaataaataaataaaaataaaaaccagaaacatactggcaaattccggtagtctacctttatatggacactgtattctcacttcaaatccagtagggccaaaagaaaactcatattctccctgttgaactggtgtctttttctgattcgtcatctataacatttctgccattatatatacacaatgaagcttaacaatcttctttatttctccctttatcaaagagttcattggttaatcagtcactcagttctaaagatttttctccaccttgggaattaaatcatatttcttcctgtccgttcacacacacataccactgagaaatgcgagcccaggttacttttctcccaatctcccaagctatcttaataacagccaatctcctcatgattaggctctcactttgccatcccaattaaagttttgaccatgtcaccaccaacttaaaaaacgttccatggttctccaataccttctcaacctccttttgttgtttcaatatcccccacgatctggtccaatctccctgtcaacatcatctcacaaaagtatacacagtcaagccacaatgctttattcactattctccaaccacatttcatgtctttcatgatgacacttcttctgtcgaggctcctgtgtttattgccacactattcacagtaggaaagatatgaatcaacacgtgtgttcatcaggcccggcgcagtggctcacgcctgtaatcccagcactttgggaggacaagactggcggctcacgaggtcaggagatcgagaccatcctggctaacacggtgaaaccccgtctctactaaaaataaaaaaaaaattagccaggcttggtggtgggcgcctgtagtcccagctactcgggagtctgagaccggagaatggcgtgaacctggaggtggagcttgcagtgagccgagatcacgccactacaatccagcctgggcgacagagcaagactccgtctcaaaaaaaaaaaaaaagtgttcatcaatggataatgagataaacaaaatgtggtgtgtgtgcgcgcacacacacacacacacacacacacacagccatgtaaaaagaatgaaatcctgtcttttgccgcaatatggatggaactgcaggccattaccttaagtggaataactcagaaacacgaagacaaataccgcatgttctcacttagaagtgggagctgaacagtgtatacacatggacatacagtgtggaataatagacactggagattcgaaagggtggcagggtgggaaggaggtgaagaataagaaattatttaatggctacaatacacactgttggagtgacagttacactaaaagcccaggctgcaccactaaattaaatatccatgtaacaaaattgcactttcaacccttaaatgtgtacaaataaaaaaaagaacatttctattctttcctctcctgcttcatttctacatgttaaatcctatttagcattcaagtcttggatcaaatatgctgctacaaagccttctttgggattccgtaaataattaatctcctccctagatgactttttagttatcattatttattattattctcagtttatggttaataaatatatttattattttattatataatattatatataattatataatattatataattatataattactactactattctcattttatacttattatattattattgtcatttgattactctcatttatgctttctataaatcccttgacagcaaacttgctgtcaagaagtttctagagatttctagagagaagagtataaatgagactaatgagctgaccataaaataaaaatgtcatgttcatttttgttttcaaactcagagctcatggcctgctatggtttgaatacttgtgtccctgccaagattcacacgatgaaacctattcaccaatgtgatgatggtgggaggtatggcctttgagaggtgattagggcatgaaggcagagccttgatgaatggaattagtgccccatgataaaggtctgcagagagctgctgctccccttccaccatgtgagacacagcaagaagatgccatctatgagaaagggccttcaccagacactcaatctgccagcaccttgatctcggacttcccagttcgagaaattctggaagaaatttatttttccagaaaggggaaaaataaatttctgttgtttataagctatccagtttatggtattttgttacagcaattcaaacagactaagacaggctgtatcaataataatttctgcatagtctgaaagctcaatgacagcaagaatcaagtaggccttattgatcagaactgtatcaccaccacttaacacagtgcccttagctaactatttttaatggatgttaaataaaggagtaattactgaattgatttattttaagtcttcattgttagttttaatttgaaagacatttaaaattcactatttggtcagaatatgcagcaatgaatgaagttcgaggaaattttatttatatgtagtggccataggggtgtgtcttcacataatgacatccgttgccaaaagtaatccaaaagaaaaaacacacccttgattggttatctggcattaaaaaataaagtaaggccaggcacggtggctcatgcctgtaatcccagcacaccgggaggctgaggcaggaggatcacttgaggccaggaggtccagaccagcctgggcaaatggcaaaacctcatctctatcaaaactacaaaaattagccaggcatggtggcacaagtctgaaatcctagctagtcgggagactaaggcatgagaatcacttaaacctgggaggcagaggttgcagcgggccaagatcgcactgctgcactccagcctgggcaacagagtgagacttcatctcaaaaaaataataatagtaacactaataacaatttaatagtgaagagtctatctttggttatcatgcatcaacacaaataattcattattttgctcaaatgccaagagaaattacagtcatctctgtacccaactgccaataaagtttctaatatctatgaaattatgatacacaaaatatctgtatgagttaatattgctaatacttgtggtggttacaagacagggagatgttattgacttgctgtagttttatcattcatgtagacatgatcttcaaagggtgagaaaatacaaacgtctgtaattttcttttcctaacttgttaataacaatcatacttgtttaattccttctagtttgtaaaattattccatgcattaacttatcaaaataaccaaaagtcattgacagctgatccagaaaataatgtagatggctggagtagcattcaggaaattcaagcctttagcttcctcatctgtaaactagataattgcaatatatgatgtttgagggcctgtgggttctaacctttcattacttttaacaatgtttgtaagttgagttagggaactaatcaaaaagaaaaagtttcagaatgtttcgaagtcatgtcagccttcaagttaaaatcacaggcacctactccagagtaactttttttttaaagaatgcaacactttgggggtgtttacattcttttatggttcaacaagccttcaagttcactgttttatagagcaaatcaatccagcctggtttgctttgtaaataaagttttattggaacacagccacacccactcattcacatattgtctatggctagttttgcacaaaaataatagagttaaatagttgcaacagagactttacagcccagcgaagcctaggatatttactacctggttcactgcaaaaaaagtttgccaacccttgctttaaaacaataacttatttgtatgtatcgttaaaatgttagttcttccacaaaaaaaaaaaaaactttaagagaagtgaagttatttcaccttttctgatcaatccttggcaatctgtaaattttgtaaatttatatcagtagcacaagttaaattatttttttaaattaatttaaatttaattatgtttctgtgaaatctaatatacaattttttacactcttctaacatttgcaatgtttgaaaaacacacttgcaaataaaactgcccaaaatgtctgtcctttgtgagtttagtattctggtgaatcctgttcgatagtatttttattgatcagtagagggcgtgcttgactcaatataattgtaggtacagcgtgtgcacaatttagcctgggaacaacaggtcgacagctgcatgaagaaagttaagggagaaattactctatttttgtgatgttagtgaaaaggattagaatagcacaagaaaactggtctattaccatttaactgaaggtagtgttttcctcctgagaagaaaattactcatctactctttagcattggtttacaggaatcttgaatattttcaacaagagaaagcaacaatttggctacagaaaacaggatttttttgtgccaagatgatacagcacatcttgtgacagtggctactctctccaccctgcatctctttgcattgttgcctgtgtactgatgccattagcattgacagagccattgtccattgtaagaaaatataaaagaagatcattagaagttcagatttctgtagtggctctctgggtttttttatcaacacagaggctgtctgaaaagtgaaacatttccaaggagaatgtgctgccgaactaaagaatgctaggcccctaaaaagagactgaaaaaaaacccacctaccagcaggctagacaaagggtgcaggttggggcctcttctttgaaagacctgattaatgtgaggtcttgttacctgctttatcactgttttgttatgagtgaaaggtttcagcattcttaatttgtcttgcggatgggaaaaggaaaggcaaacttgcctgatgggggtctgagggtgaggtagatccatttgccctcagtgaaaaataacagacacaaaagacacaggtgattctacagattcatcctaaatgtctttttctgaaaaagcagccaaaagcactcatcgtttagccacttatcttgaagaataaggtataggctccagcaggtgcagaaaataagttattcattatgctaaagcaaaaatagattcaaagaactaaataggaaaaaaaaaatcagttttaggaattaaagaacaggcatagaaagattaaaataaggtaatcattgtaattcccgttacttaataggttattctaaagcacattttggcttcaggtctctagaaataatcatcttctcatgatatgtgcaatagttaaaaattaattacaaacagttttcataccatctatgaaattagaacatataaatcatgctttggagttttttaaacgagaagcagaatatgggctttttaccatattttacctctggttccctgaaatttaagtcttatgaaaatattaggagatacataatatagttaatagcaaatatccaatatgtattttcagtgagtgaagagagaaggataagatgcttatgctggatacgtgtttcatgaacattgtcccatgaggatgaaaacgtaacagatcatggtacttggattactgtattgccagtcacagacagcaagtgaaacatatcattgggttgtaatgtggaaaataccccacaataagtaagcaaatgagacatagtattaaaaatacatggcgtctgacccacataattagctattccacagatagtagctagtagtcattatcatagtgtaagtacaatttggtttgattgaatttattttgtcacctttttatcagcattttgatctcatttctaatataaattatcctagccttttgctaatcattatggctagactttggcatacataagagagaaagtgattgcaaatacctatacatacctttatgtatctatatttgtatggatacataaaactttttgccgtaacagattagtttttagaggaacgcattagctcagtggttaaataatagtttttgtttcttttgcaatatttaatgccttgaataacaaagttatacgattagattgtgtatacactaggttgtgagctcattacaagatgcatgtctttctgatttttatattccccaagcccagtaaagcctctgacatgaaagtctgctttcaaaaaatgcttaccaaacgagtgaaccttgatcagacacaaccgaacttttaaattatttccctgattcaaccagttattttttataaagaagatataaattcccatttttccaaagcatctaacagcttctcctaggtctcatatcgcctaatcagcactctatataatctctctgagtccaccgtggaaagcattagttcagtcaagggaaacttttcaatttaaagcatgcaacaagaattattgtctcatgaggaagagggttccataagatcaaaaagagaggtagaaataaataaatatatacatacatacttgttctaatgagactatctacaggtcatgcctgattgccttgagcagtgcagtggaagcatcttgatgtgggtgtgagagaggtgtgggcttatatcctcactctgcatgaacttgagcaggaaacctaacctctttgagactcaatttccatgtctggaaaacaatgataataatatctcactatatttcctgaggctccttgcagattcgatgggccttccttcttccatctgtatggaagctaggcatcatttggaagcatttgtcactgttccaaaccactaaggcttaaaaagagagaaatcactacatattgcatgttgagctcagcaaacttgcaaacaaattcctgctttgagggcagtagctgagtcctttcggattttctcagaagtcccaggactatccccagagaaggcacattctccctcagttttgttttaatttattgagttagtaagcaagccctcatgtgtggcagtcaccgttccaagcactttgctaacaatcactgatttgatcctctgaggttaatgccaccccatgaaatagggctctgtg

SEQ ID NO: 8 - DNA, 103306 bp, Homo sapiens
aaaatcccaaaccactaagattccttctaccctaacactattaacatgtagtagaaaacataattattatggagtccttagggtattcaagcagtttaataatatcacatatattcttaaataaattcagcatattccaaagacctgagaagaaattgggatggtgatgtccatgagatgttaaatcagaggatatcttctttttatttttatgcatacataaaagttttacatatttatgaaatacatgtggtatttcgatgcaagcatacaatgtgtcatgataaaatctgggctactgggatatccatcacctcaaacatgtatttcttggccttaggaacattgcaaatatactcctgtagttattttgaaatatataataaattattatctgttattgccctattgtgctaccaaacattagatcttatttcttccatcgaaccctattttggtacccattaaccaaccctctttatccccacctcactacccttctcagccttctctggtaaccatcattctactctctacctccataaaatcaaaatgttagctcccacatatgactgaaaaaatacaacacgtgtctctctgttcttggcttatttcatttaacacaatgttcaacagcatccatgttgctgcaaataacaggatttcattcttctttgtggctgaaaaatattccattatgtatatgtaccacatttgctttatccattcattgatggacatttaggttgattccataccttggctattgtgaatacagttgcaataaacatgggagtgtagatatgtctttgatatactgatttcctttcttttgaatatatactcagcagtatgatactagctgtgcatctgctgtataaggtctttatcatgctgaggtatgtttcttctgtacccagtttgttgagagtttttatcatgaagggatgttgaaagagtttttatcatgaagggatgttgttgaggcctcgctctgccattttctagtgatattactctgggttagtcatatcatcttttacgatctatttcacctgctgcttatagcaagctcaagtttttgcctgaggttcaatgacacagggcatctaaaaacactttgcaatctctgccatactatacaaatgctaactatggttatgttctgaaagtggtaaaaatagattttatgtacagtaaagtataccattatggtaatgggggagatattttacttatattgggctctttctctccctcaaaatactttttatctttttctttcaataaaagaattgtataaaataatggtgagatcgatggggaaattcttttcaatgaaaaaattaggctggatttggaaaaggtaaatattttagcatttaacactaatctcaatatatttactgggaaataagcaatgtgaatgtttagtgcattttttcatcctctgaacacttattcttatgcctctaccactgactgccatattcaaagtcctgtggtaccataaaacatttccttcttatccccatcataataaaaatatccacctttctttctgattaaactaaggagcttctgcacagcagaagaaactatcaaaagacaacctactgaatggtagaaaatttttacaaactatgaatctgacaaagacctaatatccagcctctataaggaacttaaacaaatttacaagaaaaaatacaacctcattaaaaagtggacaaagtttatgaacagacacttttaaaagaaaacatacatgaagccaacaagcatatgaaaaaaaggtcgacattactgaccattagagaaatgcaaatcaaaaccacaatgagatactgtctcaccacctcagtcagaatggctatatatcaaaatgtcaaaaaataaaaggtgccggtgaggttacagaggaaagagaacacttatactactggtgggagtgtaaattagttcaatcatggtgtagtacagtgcagcaattcctcaaagacctaaaaacagaactaccatctcacctagcaattccattactgggtatatacccaaagggatgtaaattgttctactataaagatatatgcacgtgtatattcattgtagcactattcacaatagcaaagacatggaatcaacttaaatgcccactgatgataaactggataaagtaaatttggcacatatatatcatggaataatatgcagccatgaaaaagaatgagatcatgtcctttgcaggaacatggatggagctggaggccgttatccttagcaaactaacacaggaacaaaaaactaaataccacatgccctcacttataagtaagagcttaatgatgagaactcttggacacagagagggaaaccacagacactggggcccattggaggatggagggtgggaggagggagaggatcagtaataacaaccaacgggtactaggcttaatactccgacgatgaaatattctgtacaacaaatgcccatgacacaagtttacatatataacgaacctacacatgtacccctgaacttaaaataaaagttaaaaaccaaaatcaaaatcttcatccttgagtggtttgtagcagtcatcttggtgaaaatttaatatctgatttaattaattccagagtcgaggtatcccaggaaacatattcttgccttttcttttcttctattattcccgtctctttttttcaggagtttatttaactaaaccaattactcaaaaccataagaattgtgaggacgaacccaattttttgagtgaggaaagaaggaacatcctaaactaggaagcatacacctattctctaactaggaaacttcacaatcctttaaagaagaattcctggagtaaactacattgcacagttgaaactatcagacagggatgttaaagtaattgtatttaatgtattaaaggtctagtggtaaaggtaaaaaaaatggatgaatagatggggtatttcaaccaaaagtaagaaattattttaagaacagccaaatggaaatatacctaatatcacaatgtcagaaattaataattccttagatggaattatcagggcattacacacacctaaagaaacaatcatagacctagagggcaggcaatagaaattatctgagctggaacacaaacagggaaaacaaagaaagaaaacaaaaggagaatccaagatatgtgaaacaataccacacagtctatcacatgtgcaacaggtgactcaaaaggagaaaagagagagagcgaggcaaataaatacttgaagggataatagccaagaatgttcttcagaaaattagtgaacaatgttaaatcatagatctaagaagcttacagaacttgaaaaatcagatgaactttttaaaaacgtagatgaatcatgattacattgctaaaaaaaaaaaagaaaaagaaagaaagaaaaaaggaagcttttgaaggcagctaggaaaaaaaaaagaaatgttatatggaaatgaaaaagacagaaatgatatcagactcctttttcaaaaatatgcaagcccaaacataaaagaaggctttaaagcactaaaataaaacctgtcaactcaaaattctatacctggcaaaaatatcattcaaaaatggtagtgagataaaggacttttcagacaatagtttaaagacctcattgccatttaaactgcactaccagaaatgttagattaaatactatctttttcatgcagaaggaatgtggatctacacaaaggaattaagactgccagtaatcgttaaaataaaggtagatgtaaatgtccttttttcccaaaaaaatgttagtttaaaagaatttgactttctgaagagtaactatatattgtgaggtttacaatatatgtattaattaactatatggcaacaatagcccagaggataaaataaggaaattgaggtatatggttacaatgttcatatactatatgtgaggtggcacaatattatttgaaagtaaactgtggtaaattaaagatgtacaggcataccttgttttatagctttgttttatcatgctttgcagacactgtgttctttacaaattgaaggtttgtggcaaaacggcatcaagaaagtccatcagtgaagccatttttccaacagcatgtactgtctctttctcagtattttttaatgaaagcatttataattaagtatttttaaatttaggtgtacacatcttttagacataatgccattgcacattatagtataaacataactttaatatgcactgggaaacaaaaacatttgtgtggcactctttattgtaaaatttttatgattttgatgaaccagaacaaataatgcaatagctccaaggtatgcctgtatattatcaacctttagcaacctttatattgtcaatattcatatatatagaatggtaataaagctatgtaattaataagccaatggtagaaataaaaagggattatacatactactcactattttttaaaaggtctgaaagggaaaaaaagaccaaagtcctagatgaggtgaaaagatacaattattaaaatggcagactgaaatccagctatgtcaattattacattaagagtaaacggtctaaacaggctgaatgaaaggcagacattgctggattgtctaaaacagcagatccaactacatgttgtaagagtaaaaactttatgaagacataaataaaagtattggagaggaaaaaaatgtgtgtatgcatatatatgtgtatatatatacgtgtgtatatgtatatttgtgtgtatacacatatatatacacacacacaaatatacatatacccacaaatatatatgcatattcatatatatgtacatatacacaaatatgtacacagaaataatatatgcaaacacacaaatatacatatacacacatatatatacacatatacatatatatctatatatatacacaaatatacatatacacacatacccaacactaatcaaatgaagactggagtggtgccatgaacatcatactaagtaatcttttgaagagaaaagatatactggggatatcttttgaaaagaaaatgttatcagggataaagaagaacattgcctaatgataaagaaatcaatttatcaaaaaaattaatggtaagtatatgtacattacacactccaatgtacgtaaaacaaaaactgatggaactgaaatgaaaggataaagagagaaatctacaattctagttggagacttaaactatcatctctcagtaattgacagactacatggatataagatcagtaagagtatagaaactttcaacaatactatcagccatattgacctagttgagatatacagaatcctctacccaagaacaacagcaaatactttactttcaagtattcatgaaacattcaacccaaatgaaaaatatgctaggccataaaacaaatctcattccataacaaaaggattgaaatcatatcctctcttgccacagtggaatctgatcaatagctgaatgtgttttatttgggaaactagtatattccactatattctgccgagaaatttggggatatcaggaagaaggacatacagacactaataaatatgaaataaagtttattactcagatagtaaatggcaaaagtattctccaagaaaagggatcagattccttctgtagtaaaacaaccatgagaagaatagatgaccccagcttattttggattaagaggtgaaaccaggtagggatctacatggtttgaacttctccgccaatgccaagggagggagctcctgagcttttttgtaaatcagttttccagatgtgaggcaaaaggtaaagagggaggggtggagctttaaagctgtcagtgatcaaacatcaaaataggaatcagtctttattatagaaagatatctggataattcttacatatttataagctgaacaatatgatagctcaatgtgaactatccagacagttcataatataactaatgtgttataatttacttgagaagatagaggatgaggtgaggtccttcaagtaagttaagtcttaacctaacacaaatactactcatgagatatagtctaaaatcaataaatcataatacattatagataattataatttgtatcataatacatataacactatatacatatgaaactatatacacatatataacatatatacatacattataaacatatgcatataatttagaaatatagagattgccaccagaagatatagctggcaaggttacaaagtgatttcagttgtcaagtgggactgagcacttcaggattttcaccttaatagaggtgtattttttaacaaaaaaacaactaggccaaattaaaagaaaaacaaaaacgaaaccaaataataagcaaactttctttccttgctctactcttcactatgagacgttaagagattcactttaactctgagtcacatgttcttaccttagtaagaacaaaattgagttgaataatgttccccaagggatgtccctgggtcacaactgttatacacgaaaagggttctgatgtggagcttggacttcagttttagttaaattaaacaattaaaacaattttgttttttactttaggatgtcttcaagtcacccaagcagtttctactgtgaatctttgagagggagattgcaaggggccatcaaaagtcattccaagtcaaaccaaggtaaaacctgatgacagtgatgggatttttctcagcaaatggtcttgggtctgctagaatatacaaatgaataaacattcaaggtccaaaagtttcttttacatttggctataggttgaaagcatgagatgtttatgaagtaaacacccaacatggccaaagtgaaatgtcagtaagacaactacagaaatgtgatctttgagataactttctaattcaccctctaagctattcataaaatgtatagctaaaacatgtatactaggatttgagtttttctcattcataagaccacttgcatctgttgcatgatatcttctattaattttaataagtatcagcaaagcaaaacatttcttcaaatcttgcattcatctggtttttctcaactctaactacaaaacttagggtttcttatcttttcattcatatgtgataccttttatatatttttttcttcatgaatttttcttcatttgcatttcttcttctcataaaaactatccttgagctcggtgcagtggctcatgcctctaatcctaacactttgagaggccaaggtgggaggatcacttgagcccgggagtttgaaatcagcctgggtgggcaacacggaaagagcccatcctacaaaaaatttaaaaaattagccaggcatcgtggtatgcacctgtagtcccagttaccaggaaggctgaggtgggaggattgcttgagcccagaaggtggaggctgcagtgagctatgatcacaccactgcactacagcctgggtgacagagcgaggccccatctcaaaaaaaaaaaaaaaagaaaagcaaaaaaattctttgatattttcagtaacaatattgtagttttcagttacaattcttttaagtttttctcaaaaaattctcaattgcttattttctcttttaggagataagctgttattttaactctgtctttattatctaaggcacttccaaatctgtttcttttgtctgcttttcactgtcatccaggatgtcttgtattctttgtacctgattcctttctttgtactcgacattatatttgcaaaattgttgtagaaaattatttgagagctaccacatcaccttcctttagagaggaattaggctgcttttgtctggtacttggatgcactaactatctgggatcacttcaattcaattccaaagattaaaatgattcatacctgagctgtagtccttgaaaaggtctatctattcctagttcttttttttttttttccaaaggtgtaattttcggcccctcactaaaggtaaaggatgcttagcagaaccactgcttttgatgggacctggactctaaaccctattaccctagttctgtgagactgtcagtagcaaaattcagctgcctgtcaactgccccgggattatcaataatctagggggaaaatagcccaagtgctagaatttgccaatcttggttttgttctcttcttgaatcctgggctggtatttcttcattaacactctgatgcctttttaaatagaaggcctttgtttgtattgtttaatccagtttttcaagttgtcctcagcagaggactgtcttttatccagtgttttgttatttacaaatattagaaataatacaaatattacaattacaataatactaatattacaaagaatatttatgttacttataaatattatttatgttacttataaatattatttatgttattattactaccactgtaattcatgcattaatcatctactgaactaagtctctaactggctttcaaggcttctgggctctattattactcccttgcatcaaacctgtctccacactgctcccagggtgatagtctaacacaaaaatccaataatgtcacttagatgttttaaattatttaaaaacttcactgcatacagataacattatgtagaaaaaataaagtggttatgaactttatagcaaaataaaccttatttcgaatcctcactctaacaacagctgcatgagtttggacaagctacttaagttctaagcttcaattttctaatctctaaagcaagcatggtattaacacctaacataaaaaagtgttttgaagattaagtaagaagtaaagtactaactatggagagtattaagaagataattctcttcttgttatagcattgcatgagttcaatagacattagaagttttcttttctctgaactacctctgacagtgcaaacattccataatttgtcttccttccattcctttccacatattattttatcctttaactaggagagaatccagaggaaaaatagaaataagtgtggtttctcccatattccacagtagttagagggccaaacactctttcctactgcaaaagaagctattcagagggcctctacccatgaccacttctttagattacagatggagaatcgatccacagaaaatatgataatactgaaatttgcttgatttttcttcatgggaatccatattccacatggttaaatgggattaagtaaatataggctattctccaacaaaaaagtagtggttacaataagacagagcaagaattcaagtttaaatcaagaaaaaatgtctgaggcctctatcaagggagaaacatactgatggcattttaacaaaagaggaaaaactcaatgtaggatgcaaatgatatacaagggagacacaaattaactgtttgaatgaattttaactactttagaaggaataaaattgccctcttagttctgataattttctgtcaccctagagaaaaataaaatgtgatttccaaaatagcagaaagagcaactctccttctaaaaacagaaaaatagaaatgatcagctggctgccaattgtatgttgttaaattaaattatattataaatgtatacattttctatataacatgatatatacaaccaaaaaaggaactattaaaatttatatctaaagtaatgtcatctcttagaaaatttctatcaaatgcacaacttcctaaagtgtctacatgattagcatcatgttaactctctttatttttcagattttcgggacccctttgttatctgattcttcaaatgagtcatccttctttaccccatttacaatcagggtatatttggaatttaaataactgtaaaaataagagaataagatataaaggacacataaagatataaaggtgacctttaaacttaattttaccatactgaagttgacaaagtagttgatgatttttaaatgtggcaatatagcctaaacatgttaaatacaattttccaaaaaatgacaattacaaatacattagatagtctaggaagaaagctgtagttgtttgatgctgtgagtaccatacactgactgagatggatatgcacttacttggctaatgagttcaccttcaaactctgaatgctcaaatggaaataaatcaccaggcaactacatcaccagccacagaaaagtaaaatgaattaataaattacaaacctaaaacatattacacactatcaaaataccgtatttcatcttatctaaagatgccatcagttacaagatgcactgttatctgatttaccatcaacaattttttttaaacactggcaattcacatggaacatactattgattccaagatacatcctgatttgagatatgaaatgtaaaaaaatcatatctttgaaaattaaaatgtagcattcttttatttattggctcttactcttgcctgttgtaacaaaaggaattctcagtctcaatcctagaatgcctgatatcttcaaaatccatttaggcacaagctgactttccaaacgcagacacacaattccacagtgccttggtcttcatagcaaagttgggggcactggggatacagttaaaaagcagaaaaataaaaattaaaaaaatttttgacctttggaaacctgtgtgcctgtgtgtgtgtgtgtgtgtgtgtgttgtacctacttaattctggcagtaaactttcctcttctctgtgttcctatggtaactttaactcttgtaaattgtgctgattgctaatgtcattgaagattatttttcctattgtctttccttcttcccacttcacaccccatagagtatatgtctgatccacatctgaaaggactgaactatcaatcctccagagagaaaaaagcagttacaaagcttccagccaagcattttccggtaaaaatcagaacaaaggagtgatctcttctacttcactaagttccagtaatattacatcaagatatagaagggatcactccactgattgcagcccccaaaactgtgctctagcaaaaacatattactgaacaaatactatttttacacccattcacaactcctttgctcccagaaaagacaaaatgtcctattaaaagctgtaagatgtctctttgagtgcagtaattatctaatcgcaaagcatttctgaaggacaaactgtacatattgttcttagaaataactaagacatagccacttccagtagtcagtggcagatatagatttagtaaataagaggggcttacagtgattgcctggtttttgtgttgggcagcctatagagacttttcttgaatctacatcttggtgaccctttacagaagactgaaaatctatttgttttacatcaaagaatttgaagtcagtggtgtaagtcatggagatcatgtggggaactgaagactagcccaaactttacctcagggctcaccactctctagactgataatgatatcaaaaaatacatcttgaactctcagcacagacacagcaaagcacatttcatttctccatgggtgtcaaagcacccatggagtccaatgtattcctatgaagatgtacatatccagatagatttggataaaatttagtaatatattttccctggagaaaaaaaagaatattcaagaaaaatcttctctcacaaattctaaaacccaaattattaaatatatgattttatttctaaaactttagttcttcttattcatttttcctttaaagtgccttttgagtacccaaaggtcaatattttttaatttacttttaatttaaaattaatcaatcatataggtctgcagggcaacacaacagtaatttcagcatgaataacagtattatacatatgtgacatatattttactcctaaatgacattaataatgataaattttatatcacattgatttttcgcctctacacagcagaaacagcatcatagatcatgattctattgttgctgcagggattcggccttgcagagtgggcaaaaactagaacacactgcaggtgggaaattgtaaggaaaaagttctgcatatattaaatataatacggagctcttgactctgctcaattatgtcttgctggaagtcaaaaaagttagtactcatgccaagtacttagactgcgatgctaaatcatcaagtaacatgataactatgacttttccatttcctttgttataggtaccacagcggaatattaacagtagccttacatgtgttcacgttcttacattgcctagcacattaaccaatttctaggtaaaaaaataataaaaccaaaattaaggccattgtttctttttctcaaaactataaaagttactgatttgtgctccttagttttacaaagcaatttatttggaatttttcataggtaatccaaagaaatccaatttacacattccctgaaaggtaaagttcccatatgactagaatcctttctattaatgcaaaggacaagtgtgtagagatgtctcattaattgatttttcctggaatgttaagaattcatcaatttatatatacagatcttgcttcaaatcagaagaaatgaaatgttctgtttagtatttgaaaattgcttctatttgtaacttttggcctactgtagaaatatcattatttggttttgttagttctttgttttgtcttccacatccttttactccttctcagtttttacactatttatggtttttctacaccttcttaaagagctcctcatttttgccactgtgtagattaaagaagtatcaattctgcttcttatgacagaaaatgcccatttcaatcttgttatttttaagagtatcttaacatttttaaaccttaataatattcatggtaaaatgtagaagtgcagaatgtgataaagtgaaatattattttctctgaaatctaatttgcattcacaagaagtacaccctgttaacattttccttcatacaatgtttactatgcctatatgacatgaatgtctattagtgtgcatatacagatgaatttaaaatgtatagccttgggtttgtagaatggctttcttcattttcctattcctaaactaaatttggtcctagaataaaaagccagcaggatacttactgctgaaaactggaaacgtttccattttagtgtgggacaaaaaaaaatattatttgtcatcagattatttgattgtgagatacttaaaaacttttaggttttttccaatctttttctatcataatattgcttcaaggagtgctgtttcacatatgccattttgtaaacatgggaatgaaatttctcttcctattgatatgaggtcttttgctctaaaatactatttgtacatatataaaaatgatactatatataggtgtatatatatacgtgtatatgattatattatatgtaatgtatacacttaaattatatatgcacattatcgtgtatatgatattatacacacatatataagttgcattatatatgtatttatgtattgtaatgatacgggaggtgagcagggaagcgctggatagagaaaggcagggtccctggtgaaggctccaccttcgggcctgtgcccatggacctatgtgaggagaggcactcctgttttcacacccaactgttgcatttttcaagaccactctggccagccaccctgcatccccattcctgtgcctataaaaaccacccagagaccctagtgggcacacacacacaaacagctggacattgagaggaacacaccagcagaagaacacaccaacagacaccgccagcaggaaccacatggatgccaaggaaaattcagccaagggcagtgggaggagagccaggccgctgaatgagcggctcacgcaggggaagaccaccttcccactccatccccctcctggctcccgatccgtctgctgagagccacttccaccactcaataaaaccttgcactcgttctccaagcccacgtgtgatctgatttttctggtacactagggcaagaaccccaggatacagaaagccctctgtccttggaataaggcagaaggtctaattgagctaattaacacaagccacctgtgttaaggctaagctgaaagagcgcactgtaatacgagcccactggggctttgagagctgtaaacactcaaccctaaacgctgcagtggggttgaagcccgcgctccccacgacctgcccttgcgcatgcttcccctaggggttctttgctgtggggcaccgaagaagcgagccactcctcctgtcacatgccctgggagggggataaaggaaaacttttcctgttttaataatttccatctatttcttttgtacccagccacttatttagttttgatattattgatattgttggtttttttctttttggccttttccttcatcatcactattattttctattgttccagaaatgtagatgatataataataattataaaagttaagaagaagtaaaattagcaattatcacagagagtatattgttatttacctattaaaaacattttttgagattttaatttctaaaatttccctcccattcatataagtaatttatagagctttgaatgtatagccttaattatcttgccctctatgattgacagattaacagagatgcagagatgtccaagtttaaatctctagaacccacgaatatattagaacggcatggcaaagaggaattaaggtggcagagataattaaagttaactgacttttgagatgaggagcttatactgggattaacagggcaggcccagtgtaaccacaaggggcgttataagtgaaaggggacagaaaggtgaaaacattagagagatggcagcaggacaaagactcagtcatatgctgggtttgatgatggagaaagggggccatgagccaaggaatgtgggtggcctgtgtaagaaggaaaaggaacggatcctccctagggtctccagaaggaatgcagcactgctgactccttaattatagcccagaaagacctatttcagatttatgacttcatgaactttaagataataaatttgtgttgttttaaatttgtggtaatttgttagagcggcaacacaaaactaacataccctctaaacctaacctttctgttccaatatgctatttcccttatatttatccttaaacaactataaaatctttccaaacacaagatttgtcaaaatggggagcatgtgattactatgctcccattcaagaaccacttggacgtttttcaaatctcttccttgcagatacggttggacagtaggatttctataacaacttccagcctctaaacagccatctatgtgttgtaaataagatttcttcctagcatttactaaatattatgaacttgatttcttcctagcatttactaaatattatgaacttgatttcttcctagcatttactaaatattatgaacttggagaaaaattaaaatctactcttctgtctgccaccaggattcttcctgtatccactctgttttatgagactaattatgtggagaaagtatgctgcatagttttaatttgtcactttcatacccattagttttttagagccgtacccacctaatgaatctaacatgcgatatatggggtctggtgcccaataaattaaatatattcatatgtatttttttcgtacaaggatggctactctgctttttttgtttgctaaagaccctgcagttttggtgaggtgcacacagcaaaggagaaactaagtaaatttctacctactttgaagttggcacagtactgctgacctaccaatttcactttcagtttcattctactggcgttggagttagtggaaatttccctagataccatttgaaacgggaagcctgtcttcaattctcagtaaacaatctcttcggcagtggctctttgaccttttgtctgcttatcttattaccagacaaatttgcgctgcccttttaaaaccatcttctaataacaaaactaagtactacaactagctcacaagggtaaaatcacaaatcagatttgtttagcagcagtgtccttgaaatgggtaaatttccactgtgaaagaaactctttgtccccatcaagatcctttttacattttgattaataccttacctaaatatccagaacaaaggcagaagtgaagacgtccgtgaatgcttgcgtaagtaccaggagatctggaacatctattaattatttttcaccattctgccatttccaggactcgaagtcagcagaattgactgaaatagtcttctaagtccaatccaaatatgtctaataatgaaaggctttgtaaggatatggctaaggtgatgccaatctagggatggatttcatgaacatgagtccgagaactgatcaggaaatgaaagattaaccagaggttaaaatgtgcacatagaacgattatctgggatgtcaatccagatggctatcaagcaaaaagttccaaaaattgacagtaatagagttgcaaagagacaatttattagcatcaggaatctggggtttcaacacagggaggtggataaccagagtgcacaccaggaatcaagaaaccagagcatcagaggtagaggggcttcaacacaattctgactccaggctctttcagagagcaatttatctgggatcgaaattgatctagatgaaggggttgtactatatttacaggtgaaggctaatttggcatttagaaaaatatggaagtcagcagccagagtcaataaacatcctcatctttcaactattaaccacctctactgagtgactacataatatattttcaaattcttgcacaggcatgcccaatctgatacattgatcttttgagatattacattttattttgctttgtaaatttatctcatacctgtctactcttttcagttcaattaggtagccagacttcttaaatttcttgaatcagagattttggaagcaataagattaagaaaagatcaaagatgcctttctttcacaaaagcctaaccaaaatgaagagactgataggagacctgggcagaagggagcagagagaatatctgtgcagcagataccagtttccaccaaatagggaaaagagagagtcttcaatctttggaccagaggctggtgcactaactagtccaaggcagtgtctgatgaggtattcagacctcagagagatgtttcttagtttaccaggaatgcaggacccccaaaatgatacagaagcagaactgtaaaagctcaagaaaccactacattatgaacagtgcagctgcattagggttcaccagagaaagagaaccaataggatatctgcatatataataggacattaattataggaactggctcaagtgattatggagccaagaagtcccatgatctaccatctgtaaactggaaaaccaggaaagccggtggtgtaattcagcctggatccagagggtggagaagcaggagctcctatcccatgtccaagggcaggagaatatggacactgcagctcaaacagaaaaagcgaattctcccttcctttgcctttttcttctattcaggttctcagtggattgggtgattctgaatacctcaatgatttattaaaggaaatctattttgaaagatactgagaagcttacaatatcaaagaaaaactggaatgatcaggcctttaaaaaaatatggaatcagccaggcatggtagctcacacctttaatcccagctctttgggaggccgatgcaggaggattgcttgagcccaggagtgcgagaccagcctggacaatatagcaagaccctgtctctataaaaataaaatttaaaaataaaaaataaaatctagaatcaaggccagctcttctctctatagcaggaactcatgaaccttgagtattctcaagatagcatagcacccaacagattcatatgctttgtaacctctgtctatcactcataacttcaggagaaagtctgataggttccactgagaccatattcccacctatgtctaagactggaaggtgggcttactggcaggcactaccagtaatgctcattgtatctccttcggcttggctccttagttgacatatatcttgtgctcaaagaattaatgttgaatttaaatattctaaatggccagtttttaatgaaggcacatgctggtaagcagtacagctattcttataatcctagacttttgttctttcctatttattttcacatttttctatgctcccgtttttgtcagaaatctgttggaacagttattatctctatttcttccatggtgtctaaaactagagagctatttttccctctgcaatgtctttttttttcctctctttgccatgcttcagtgtaacttgtcagtccttcatgttatgtactagaggaattgctgtctcaccagaaaaagtcgctgaaagaaactgcttctgagcttgaacacaaatcaattcctttcatctcattcttgctaagttgaatattgatctgtgtcaaagcaatatgcatgactttttcattaatatttaattgttattttatatgacttcaagcaaagagacatctccatggttcattgattcatccattcttttggccaaatgccaaatagcctgtctccaagaaaatgtatctgcccttttcaaatgagactctttgaagaccaattcaattcaatcaaataattaggctatcacatcatgttattatcctactaaaaagtatagttgagaacagtacatattctaaagtagcagtgatagaaaaccttatgttacatgtaaaaattacacatgaatgaatttttggcgaatacaaaacggaaaaatggaacagaatataaatataacaaatctgcatataaaattcagaattaatgcgctagttacacccagattaaaatgaattactttatgtacaatttcattgtaaaaggaaccaacgctccatggttgattgggagactggaacagagattgtacaaggtacacttgtgcaatgagcctggaacttcttgtggtaccaaaaaaaaaaaaaaaaaaagaagtgctaaaatttttaaatagaaataaaaaggataagagcacatcaaagtgacacagttgccaaatcttcccacggtcagagctggaccaatcaaacaataaaagaaataacacattatggattataagtgtcacactggattgaagtatccataagcccttaataataaaaaatagctaaaaagaaagaggcaactcttctttatggaataattccaattaataactatagaagaaatgtgggaaatagaaaaccaactttaaaacaccacagtaataatttctgctggcaagattcaatgctgtatgctacagtgggtagcaaaatttcaagaacaggatagtggcctagattcaaatatcgcccttttttttttaattcttgttgtgattttaatatacactcatgaagtttttggtaattctctctttaggggggtggaacttaatttgtctctccttgagtgtggaattacttttcttaatgactcactttcaacaaagagagtatagaaagggaacaacagtaacttcacagtagagaaactggcagacatcactgtaataaagtgattttaaggttagcatcaccaacaataagtcatgttgatatcatgctactcttgaaattataaggacacatcacctttgtagcattctcccaaaatatagaaactcaactaattatgagaaaacatcagacaagccccaaatgaaggacattctacaaaatttctgaccagtactcttcaaaaagatcaagattataaaaaaacacataaagactgagaaagattgggagagacaaaatagacgtgacaactaaatgcagagtggtgtcccagattggatccttaaacaaaaaagagacattgatgtaaaaatttatgaaatccacacaaagtctatagtttagccaatagtatcatattatttagttttgaaaattataccatgattacgtaacatgctaacattagagaaaactgagtgaagggcatataggaataatcagtactatctttggaactttcctgtaagtcacaaaacaaagagttccaacaattaaggtgaggtcaagacaagaacatttgtcataagtagtctcacaccagagaaaaaggacaaaactttagaaaggactaaagagaaccagaaaggtcaaatatgagagtaaatataaaataatcttaagtgcttagaccagcagtataaatgtcttggaggttgataagatatattgaagtaccatatatgaaaatagctcaaaggtaggggtacaggtaaaagaaattactgtttgaagtttcttgtatggaaagttgtaaaatcattaaggcaaattataaaaagaaaaaatgcatattgtaatctctaggcgaccaataaatgaatttttaaaacatagtgataaaatgctgataaaagaggtaagtcgtttttttctttatcttaatgaacccaaaagaaggaatggaaaagtaacaataggaccaaagaaaagattgtaaaattggaaacaaaaagaaaggtggcagaactaagctcaaatgcatctgtaattggaataaatgtaaatgaattacacacctcaattaaaaggtgtgtaaattttcaaaagagttctgaaaaaggcccaatctatgctgtttacactttagatataaggacacaggaagtccttacgtcggaagaaaaagtatgggaaaaggaatacctaacgtattcctttaggtaacgtgaaaacgttacctaaacatggtgtggctacattaatatcagacaaaataggtttaaagaggaaaaatattattagagaaagtgaatttcataatgattaaggtccaattcatcataaagaaataataatcctgaatctgtaagtatttaataacatgggcttcaaaatagaaattgatggacctaagaggagtaatttaaaaattcttaacctgagtttggagtttgaacacatctctgtcagtaactaacagaacaacaaaataaaacattagtgaagctatgaaatatttaaacattttttgctaaccctttctcattcatatttatagagcactacccctttaatgggacatagaacatttacaaaagaaaaggaacagaaggaagaggagggaaaaacactggaagaaagataagaagaaaaagagaaaggagagaagaaagagaaaagggggaaagcaagcagagaattaagtcagaggagtattaaaaacattaactttatcactgataaaattagtctacagaacataccttgaactgtggctagaaataagcttccaaataatttatccccacaagtaaatttaccctgtggtcacaatcagaatacatgggcaatggtatattgtcaccttagagagacagagatgcctcagtgttgtaggaaggagtgaggaacacagtgtgctccagacaaggtggtccacaataagggagaaagaatttgtgtcacgtgtatataaaccaaccacttttcctagtttcagatcgatgggtaaaaagaagcgtggacccttctctccaaagatacaaacaatagacatttgtatttaagagtcgcagggtgtggtgcactggctcatacctgtattcccagcactttgggaggccaaggtgggtgaaccacttgagcccaggagtttgagaccagcctgggcatcatagtgagaccccatcactacaaaaaattaaaaaataggtgggcatggtggtgtgtgcctatagtcccagccactcaggaggctgaggctggacctgaacccaggaggttgagactgcattgaaccagaaactcataaaactcatgaaaaacaaaagagtgattactactgatcacatgaaagaaagagtatctgatttcaagcattagagtttgatagttcctccgcagattccatcaaagaagtaatcactggaattaagagagaatccactaagggcttgcaaccctgcagtatgttggtttatgaagcgctcatattatggcaggatgcggtggctcatgcctgtaatcccagcactttgggaggcctaggtgggtggatcacctaaggttgggagtttgagaccagcctgaccaacatggagaaaccccgtctctactgaaaatacaaaattagccgggtatggtggcacatgcctgtaatcccagccactcgggaggctgaggcaggaaaatcacttgaacccaggaggcagggttgcagtgagttgagatcgtgccactgcactccagcctgggcaacaacagcgaaagtctgtttcaaaaaaaaaaagcgctcatattcaaactccgttcagccataaacaggaaaaaggattcagccagctcatgagctaagtgaacaagtcaagtgtgatctacaaattttctaaaacctcaacagcaaatttggggcccaataaaatctctcctgtccctaagagaagtgagcatttatatctactttttaaagcatataaaggagtcatattgaaaagcagacataaaaatgctttaacataaaataaaaagaaacttaaaataaaatgtcagcttgctctcctgtgagaagatgcaaaagacatgctaatagacaagaacagaaaagcatgtagaggaataaagcttgtttattatttttttaagtgaaaataacagttaaagtcgcaagatagcctaaagtatttttatggcaatttataaattcaattccccctacagctctatgaaactgttattactcctctcccagttttgcagatatgaaaactgagaaacaaaagatttaggtaacttgtccttaattgtacaaaagtgaattcgtagaactgggatttgaaccaagagattctggctccagaagcctcatactgaacaccagagcactgtttccatcagggaaatacaaacacaaatagacataattatggagttgaggttcatgaaagatttccaagaaactaaaatgtccaaagcaaaattaaaattcacagtagagttagtttaaaactgaaactccatacaattaaggaaccagtaacctttttcagcgtttactaagtgtcaagcattgttctatttgctttgattcattaatttatatgatcctcccaatagcaatagtagatattactattatccttattttatatagaggatcaccatgttatgcataaatacgatgtaaatattattgaatttctggaacgtgacagataagattttctcatttcatgatcatgaattggatttgcttaattttctcaaaatattgttttatatttcaattatatttctagctttttagcttattttcacattattttgccctattactccaaatcacagtctcaagaaaaacatatgtatagaatatatttataaatggaatattctttaaaatcaaactattctgacatttcttcaaaaatggaggggaggttcatggttgcaacatcaatttcacatcctgtaaaaattgagtaagttattgaattcaatctaagcaaggttgaaacaatcactcgtttttggtacaagaaacactgttttgtgatttttctaagaagagttaactactctttagcataataaataaatgtatgaataattggtggccaaatttcctgtgatttaggatccatttatcaggagaccaaggctacagtgagtatatttctaaaggtattttccatccaaatccctccaaataatttgctcaagtattttttttttttgaggggggaacggggggatttatttgattattctctaaaaacttacttttattttgagactgtgattattggaaaattccaacaaatatgcaatttgtacaaaagtaggtaattcattcccttaaatggaaagctataaaaaattacaaatatttattatgagataaccaactccagacaggggaacccaagaaaatattctgatgtttccaaggaaagccatgtttgaaaaccagaagctttagctcccttattcaaagacactatcctgaaaagtatatgtttaatcctacattgtttattttttcagtaaatgatctacatttttgtcaaaatacggttaagaaatgtgcatttattatatgtctgtctgtcaataaagattgtctatttcaaaacaaagccaaaattgaaaatgatgtgtagcttactctgtttcaggcatttgtctgaatagtttcctaatatttatcccttttatttagcaaaactcttttgaaaattaggagtatatctattgttacagacaatacaaaagcaagttaacttgcttaaaattcatatagataaatgacaaaacatagtgttctttgtacctatttgtgtattcattacttcctttactacttgattaaaatgtccacattgggtcctgtttagctgtctctctggcatgcagaggattagaatgaatctcaaccaaagcagatttctgatcataaaaaccatatgtagctttggccttaattaaattaattataaacaatttcattttccttttcaggacaagatagttatggagtaatcctcacaactgctatctcaataattgattaacatgaggaatttttttctaatccacattctattgtttgccacttaagagtgctgtgttcacatataaacatgaaatacctccttcactggccatagaaatgacattgtaaccacacctgaaggaagtattcttttttccatgtgaaatcctacctcaaatattaattaatgttgatgcattcttcacttttattttgccactaatttatactttagctttttgaaagtcttgaatagaaattttgttgttgttttgccttatgcattaggttttatttccactaaagttctattaacaggaggcaagccactgaatggctttagaagtagctttgtgaaagctaacttttcagctgagagaaatctccctggggatattacagagacacagaaactttaatagtattttgttttcctcagcacatccccagattttaacgtgtctgaatttaatgcattagaaacaagcatatgtggtcttaagctaaaatctcttcttgtatctagaaaatctatcacaaaaatactagctactgaatatatttatatataaagagaaaatactaaaacaatgaacaaaggacacaattacagtataatctgcaaagcagaggctcttgctccttgagggcaagtaatagctcatagatatttcccaacatctatcttccccccttagtttgcctttgcagatcagatgctatctgaccacacatggtctgttcaaaatgataaacagtattactcaatgtatcttctctgaaatgctaatgcgttgtcaaaatgctataatagcccctattacatctatttatgaaaatagaccattcaaggaaaagttaatttaaatcatcttgtactctaaaatgtcagtaacagtaatcatgaatggtcagcaacaacaatttatgctgtaaatgtttttagactttttctctaccaaaccagttcactacagcaatgcttatgtaaattatacattctctggaagtttctataatacagattgaaaaaaatgctatgttttaaaattttcttttcggtgctattagactttaagtaaatcctcaaaatggggtgtaatttgggagcagatataaatcagcacacataaataatatgcttaatttgctataccatttgatattaaaaacatcctacttagctggtgagggaataaaatgtattatttttaatttaacctcttttttgatgcagaaatgcacctaaagtttctgcttttgagcatatattaattgaattctaactacataatatatgtaagacacttttaaaacatagaaaatataacagtccatatttctctactcaagtcactcagtcttttgagggtgacagtataaccacatacaacataagacacatttgatgtactgtattatgagaaccatacaactttcatgcaagatagctgactgagcacatacaaggtcctgtcctccattttcaatttaaataatttagtgatatattcatacaatgggctactacattgcagttttaaaaagaaagataaaaactattgatagatgcaccagaaaggatgaagcttacaagcattatgttgagtggaagaagctactcaccaaaaaatgacacaaactatgatttcacatatacaaaattcatgaacagacaaaacttgtctatagtaataaaagtcagaatagaggttacctcattggtgggagtgaagaaaggtagttaatgacatggaagtagcagaacagaacataagagggtgatggagttatataagcttatgtatgtgtaaaaatgccctgaggtttaaattaatgacttgcgtatttacaaccagtatactttcttccctttactatatgtatatgtgttaagcttcaattaatgggttaagaaaagtaaagttttatgtaatacaataaagctgtgatggaagagtgtgttagcctaaatcaaactactttatatgtgaacaggtttctgcaagacataaagaggatacaattgagttcatgaataaattagagcagaggaagttgccatccagaatatgcacaaaataaatgtatgctatacctgaaacggaagctattcaagacagagttctaactgtaagttagttctaagttatgtttttctaatggaaaaatcagtcaaacttcagtccttcttcctgtatttttctccctgacagagccggggctctgtcctcaggggaaaaaaaaaaaaaaaatggagggatatagacaataaaagatccaatttcttatattttgactttcaaaagtgatgattcagaaataagaaaaggtctccaagaatgcttgacttatcacaagtaatgttctcttgcccagaatatatgaaagagaagtagagagtagaaaggaaaggaaagagaactgaaattggtattttaaaaagcgttgaaaaaatattcctttaacaatacaaaaatagttttcaatgaaatacctgaacattcagagtctaggatatttaaatatcaagcatgaaattattctatagatatagcctagaataagactgtccaatagacccttctataatgatggaacagccctacatctgtgctgtccagtagggtaccccttagccacattggctataaagcattttaaaactgattttataactaattttaattaagttaatgtaaatttaaatagttacctatgactaagggctattgttttggacagtgaaggaatagaaaataaatctgagatctagaatatagaatgagatcaaaatataaaatatatgaaagaaacaagaaacagaaaggatgtattgaatactttcagtatttatctaatgagagttacataaagtgaaagtgagaaaatgtataagagaaaataaagcataaaatgaaccagaaaagaaaagagagacactggttatcaatcagtgatagcccttaaatagaagttcttaaccaaaaaaaaggcggggctcatactttcatatgtttcttaaaatttattttgaaatttaaaatttacagctttattgtattgtataaaactttacttttcttaaccccttaattgaagcttaacacatatacatatagtaaagggaagaaagtatactggttgtaaatacacaagtcattaatttaaacctcagggcatttttacacatacgcaagcatgcctaaaatttccaagaaaaaaaatcaaattgactacaattgaatgaacataagaccactgccgtatttctcagctgtaacactttctcctagaacaacaagcagcaatggattcaaacaaatgacagaaaacaaacaagccaaaaaccaacaacaacaaaacaaaaagcattctgaattctatatacccagacatattataaatgaatcataggcataataaagaattttccaaacaagcaagaactcaaagttgacctcctatgaactccttttgaaataattacctcagaacatattctaacaggctttggaagggatatggaaaggaagaggctataaggctactcttcaatcatttcattaccatatctggaggacaattttgagaaagaaagaaggcagatgatctggtcacattgtattgtaaacgtgtaaacaagagactttatggtaaataaaccaatggtacttactaggagaaaaatcctaatctcagaaatcttttgactaaaatgtttctagttagtattgtttatggtaaagaaacctacagtctgtggatttataagaaatggctccctggaaaatatcacatatattttctaactccatggatataaaatgaaacaattaaaatacttgttacttaaaacagatgataaagagatttagggtttgttactaacttaaaaaagttattgcatacggatgtgaaattattccagcacaatttttgaaaagactatcacttgttccatttatttgcctctgcactttggcaaatgtcaattactgtatacgtgtgagtctgtttctggactctcatttcagttacactctatatgcctattcattggccaattccatactgagttactatctctagctttataaaaagtcttgaaataaggcagcatgtgaatgtcaagtttgtttttctaggcaaaacaattttggttattcttgttcatttgccattccacataaattttataatctcttgtgcatttctatgacaaatattgccatgacattgatttggattgtatttactgatttgatcaacttggaatttggacatatttggcatcttaacactactgagtctttcaatacatgaatataatatgcctctccatttatttcagcctttttgatttctttcttcactgttttgtagcctttaccatacacatcttttaaatattttattacatttatacctaagtagctcatctttttccaccatcaatggtggtattcccatttcttactgttcattgtcagtacctaaaaataccattaaatttttaaattgtgatcttgtatcttcagtaactttgttttgtacattctttgaaatcttcttcaaatacaatcatgttgaaagtgaataactacaattgcacatatttttttttctatttgtatgcctagttctttttcttattacactgcctagaacctccagtataatgttaaatgtgggtggtaagaacatttttcttttgccttagagtgagggttcagtcttttatcagtaagtatgatgtttgctgtaggttttctgtagctgtttcttatcatgttgggtaaattccattctacctaaaatttagagtttatcatgaatgaatattgaattttgtaaaattatttttctgtatctatagagaatataatttttttctatatctatagagaatataatgtatgtagggtctgcaacaatgtcctctttttaatttgtgatataataatttgtgtcttcttccttgttggtgagtctcatcataggctttcactgatttttctctgctgctccatttccaattttatttatgttctttattattactttgcagttacttactttggtttaatttacttttttcaagtttcttaaggaggaattttaaatcactgatttaagacttttttcatataaacatgaaatgctatacatttctctttaaattgtgctttatttgcatcccgcaaattttgcatgagagagagattattttcttttattcaattcaaattattttcagatgtcccctatgattttctctttgacctgtgagttattaggttggtaaaaaaaaaattgtggtttttgccatttaaagtgatatttagatgtgtgctcatcagtaaaaatattcggcaattattccagatacctgtttgtgatttctattttaattccattatgatcaaagaatatactatgtacatgtttttaaatgtattgaggtttgaattatggccagaaccacgatatatagactatactatatgttctacatgcacttgaaaattatgtatattctgcttatatttagtgttcaataaaagtcgatttggttggtgaaggctttgataatactgttcacatctgcgaattcattattgatttctagtcaatcaattactatccaatcaattactttgggttctctgaagttattatatctatagtttgataaattattctttaaaattttgtaaccactatctcttcaaatatttcttctgcctcacattctctctctgttttctctaggatttcaatgacacatatatcacactaatgatattttcttacggcatttgagtgttttgtttccttttttcttcactcttttatcatttgacagtttaggtaattactattaactgactttcacatcctctatcactttgcttagctgtgtcaagtctactggtgagcccacccaaggcattcttcatatttcttatcgaggttctcatttctggcactttcctggggctctttcttgtcattttcatttctctgctgaaatctttatctatccatgcatgttgtacatctttgtttacaacctttaacctattaaccatagttattttcaattacctgtctgattgttgcaacatctggatcatctctaagtcttgttcagttcattactttgtctcttgacagtaagggttgtgtgttttgtttttaatttgatttttgtgtctgttaatttttttattaatttccagacatagtgttcagagtggtagagactgataaaagtagtatttatgtgttaggtaaatgtcatttgtcttctgctaggctattattgtgggaaggtgagtaaatttatctcaagagttgagcccaattttcagttttgttcaccactgtctttaaattcctgtttgttcttaggttggagatagtttgctggtgggttttcacgatgtttctgctccactcattagggcttccctgtgccactgcccctcacagggaaattctctagtcatctccagtgttaatctgttgcttctgtcttggaggttgaggcgttacggttgtggacgaggttctctgtcatcctgattcagcctcagtttaagcagtcattgtctccctgagtcttagaatatggattttctcagtgagcttcttccaactcaatggaaggagacctttactggtctgggctcttctgagcacatttcttgcttcgacctatggataaagtatttcctttttttttttttttttccttcccctacctacaatggagacatcttctccttgcactgggccaagagctttctgctattccccagcatcttaaaagtcttttttccttatgtgagaagaaaccaaagatgggttcctgtgtttcctacagcagtggatgcacctcttcttcaggctgcatctccaaagtagtctatattagtacctgccctgccaataaacttttttcatcagcacatagtgaagtctatggagaaaagcctgcaactggctgtcttcatagcttccatactctcacagtatcagagaagcagtctttgaaaattaattaaaagtcactgtgacttctttttattcacttgtatggtggccttctcttactcttatgctcttacacaggtgaatccatgcttgttctctatctgtccgcagaggcacctgtctttcctcagatgccaggctacttgttgtcctgcagcattagctctccaataggttccagaaaaattaggattttgaggaccatctatctttctcttgctagaaggcagatgggtactccttctagatgtctacattcttaggcagaagtcagaagacctgggatttgtgttgttattgtgggcaggtattaaagtcaatcactttaatttttccagtaagcttccagatatgtccacacaagaaaccatgcagatacgttcttcattgttcattcatttagggcccatttccccagatcatacagcaggacctttggttaaagtgcaagagtctgtaaatatccaaacactcgcctgtgaaagtctaacaagcctccctctgctaattccactgctattgcccttgtgcaaacccgaacttgctttcttcttcaaggctttacaaaacggccctgtggcccttattctgtattctcactctagaggatcctttcagtggactaagaagccaccttttccatgactgggagagaatggtaagacccagactacacagtatccttagtgggctctatttttggttctatagtcagcgaagcaactgctaatataaactgtaggctcccctgaagttaccctcttagcatctttctaatatactgtctctaccttgtgaacaagctttgctatgctgcactcctcctatctgaatgtctctctgatatcacccatggcgcaatcagtatttctgtcctcagaattttctgatgcccttcagtagtgggagtggtttgaaccaaccctcagtaacaatctcacttttctctcctgagttgtatatgctaaacaactcagcagttttagccaaacttcaagagaactcactgaatagccctattcaatttctgcaaattcctgcaatctgcatatgtactggttacaacaacttcaaatattatctgagtagatggatcgtaagtgtccagtgaaaatatctgtgccaacacccttggtatatctttaacacttgtttctgcaaaagccccactcaaattcagatttatttttagtgacattacggttcaggccaacaggattaatagataaatatgattcaaccaaaaccccaaaagccctgccagtctctaagtttcctgcctatttccagtatatgagagaaccagtaatttatttctcaaagtagaagaactatctctggtttctcctgtctatatacattcttcagaatttcatgggttggaataaataaattaaattttatttaatttaataaatcccgcttaaattttagcaggatttatcagccagcctctgtttttcatttaggtgcctctcttctttagctcaacctgatctttctctgaagaggcaattctcatactgtcagtgtagtaaactgactttctatcagtgatttttaactccaaatccttcatgagaatatggcaaaatgctagtaaattttaaaatccccatatcaatgcatgaaataaatactgattcactttctacaagaatgcaaattgttactggctgggttcccaaattggaatggctataatagtgctaaattaaattaaatttggcctgaagcaaccttcatacattgaatccctaagaatgaactgcaacctaagagtttatttttgtaagaaatagttgagtctcagccaatcacagccactaagctccaaacaaacacaggctgccaactgatcagaccatgtccatatagggccaatgcctcatcacaagacgcaaattaggcaaacactcaactgtaaccaataaagctgtttctgtatgttacttccttttcctgtctataaaaactgcttgccacatggctggacgaagttccctgaacctcccctggttctgagtgctgtccaatttgtgaatcattctctgctcaaataaagtctactaaatttaatttgtctataaagtttttcttaaagatagcataccatcccccgtgatctgtggtacttcctttatagcctttacaatatcagttacaatgaaggtaatcagaaataccaacctgttcaatccttcatactggtaacctccaggatccatctgtcttaagtactgaccagacaagaatttggaaaagagagttagagggaaccaaaacttctacttcaacaatttccttgatcagaacaacaatctctcattacttcaagagagtctgtatttattgtataccaccaaagatgtctccagtcacattttcccattagcaaatttacccctaccctgctttaaagtgccttacagagtatcatctgtataccccacagcgattactggacaactagtgtccatatctggtgaccctaagaagtttgcatatcacctctacatcacttcatccaaaaaagccattgcaataagcctaaggcttttttttgttttatactgtaagggatattttaattatatggacttttgaattttaattcctagaaattacctttattattattttctgtctagaacttctatatctggatatttgcacttctatggatatttctcagctgttcgatcgtatttgtttccttctaggaatgtgctggtatcccaccttacaaatgatgaattctttcttcagctatattcattctcatatgcaatctattatgcttcttattcagctgttaacttctttgcacctagtgtttctatttgattatttttcattacatcttattcttgtttcctattggtaatatccttcccttgttgcatattttctctatttcaaattctgactcttccattttaatacttatgatatgttgtccaatttacattttttaatttaaggaagatatatttctgaaatgttcaatttaaataagttatatcttagtattttggcatttaataatattattaatttggcttatccctgaagagatagatacgttggctgttaatatgaacaggggaggggcagaagaaggaatctaggtcaatccttagaggtcaaaggtttatgaagggatgggctttcaggtgaagaactcaagttaccacaaaccagaattaaccactccaatttggtttcaccgcaccaagtaacttttcaagtcaacactctacattcaaacaccaaggaaaaggaagactgcctaaattgtcatccatcagccctggaagtttggaggaaaatgaatgaaagagagaaagccaaggctgttgagtcctcatccattagttttcctcaattctccaccctgtcagggattttgcattcccttgattttatccctacagaaggatgggccattggaagtattggccttcaaaggtatgggcaaccattgccaaatcctgcaacaaaaaagaaggcaaaggggaagccaagacagtatttcaactgctcttttctaatttctactttaacagctgagccaaaagccctttgctgtcagctgcagccatctacctgccttgccacataccagttcaaagtagctgtcttttttcctaaggatttctcacatttttatgagtctgcatcgagttttccttctccccccgagtttccctcgggttgatttgctggagagcagcagcagcttgtgctaatttgcagtcttggcataaattggaaactctcctccaagcaggtttatgaacaggaaacagaagacaacatcgctgtaatagaatcaaagtagactactgaatagtcttctgagatatataagatccaaattctggaagaaacctcaaacatctaattgtacatttgactaccctgctggaatatttaactgttaattcctttaacaatatggtctcaagtgaatggactagatagacaattttaaagtgtagaataaactgaagaaaagttttacagtttaaagtttaaattattttaaattttgacttaaaacttgattagaaattatcttaattttaataaagaatgaaaaacaaatttgagaaatcttcaaactgctttccacagtggctgaactaatttacatagccaccaacagtggataagcattaacttttctcaacacccttaccagcatcttttttttctctttttaactttttaataacagacattctgactggtgtgagacagtatctcattgcagttttgatttgtatttctctgatgattagtgatgatgagtatgttttcacgtctgttggccacttgtgtgtcttcttttgagaagtgtgtgtccatgtcctttgcctattttttttaatggaattatttgtttcttgcttgctgaattgagttccttatagattctggatattagacctttgttatatgcagagtttgtacatatttttccccatgctgtaggttgtctgtttatcaatagtttgtttcttttgctgtgtagaagctctttagtttaatcaggtcttacttgtcaatttttggtttagttgcaattgcttctggggacttagccaaaaattctttgccaagaaagcctcagaaaggtatttcagaggctttcttctagaagtttaagagtttgaggtcttacatttaaatcttaaatccatcttgagttaatatctgtatagagtgagctaccatttgacccagtaatcccattgttgtgtatatccccaaatgaaaagaagttattataccaaaaggcacatgaactcatatgttcatctctgtgccaatcacaatagcaaagacatggaatcaacctagatgcccatcaatggtggactgaatttttaaaatgtagtatatatacagtatgaactacaacatagccatagaaaagaatgaaatcctgccctttgcagcaacacgaatggagctggaggtcataatcataagtgaattatcacagaaacagaaacctaaatatggcatgttttcaattataagtgggagctaaacatggagcacagaaggacagaaacatgggaacaacagacactgcagattactagagaggggagggagagagggggacatgggttgataaaattatttgggtattatgctcactacctgggtgcaatatacccatgtgacaaacctaaacatatacccccatatctaaaataaaagttgaattttataaaaataaaaataataaaatatgttaaaaaagaaaaaatagatatcagtactggtaaaccttaaactacagataaattgcaaagttctaggtaaagtgtcaaaatccctacttttagctgggacatctatttgagaaaacctgtatccagctctttaaatataatttgcattgcggttgcttgaattcacaaatttgaagcaatcatcatataatgctcctggcattggtggtgaaaataagtcaaagcatatttaagcctgtatttttgaagcatgttaactgtcctaatgcccatctcctaatgtcctcataacagcaatattttatttttacattttggtttctcttatattcccaaatatagagcccacattaaatgaaagctaactaaacaactatttgggagttcctagaacctactcttttccagccgtctctctaagtggactacccttgttcctcaaattccaccacattaggtcttttaaagttaatcatgagtgctctacattaaaatgcaaaatatcctagaaagaaagatatttttacctactggtatataagtgtgtattattttatcagatccttggtatggtattgaccatacgatggtcaatgaattagtattgaataccaggatttaaagcaggcttcaaaagacactgaggaacgtagatcaaagagagctggtgaaaagttttaggataccaggtgggacatggaaactagcagcacctttaggccatttgccaaagtggggaaaggagaaaatattttaaagcaggtgggagtatgctgatgtaactaccttcttcacgctttcatttagagccactgtgcccaagagactgaaaatacttgcgaaattattacacatatcccaaagtcagggctataaattgtgatgcaacaaaagacctgactttcccaggctgaccacccagcttgcttacacctccctgcacagcaacatacacaagttccaatttgaggccctgctttagaaatttctcacctgtccaaaagaaattcacctgaatcttcctctctactccacctaaaactgatgaatcttccttacttctggttgtagaaagaatgaatgaattcatttctcagaaaagaaagttaacactgagatgatgggggaaatgttggcagatattcatatatggacaacttttcctcatctctaaaatcatactatgcctaaagccaatgttcaggttacacctattataattattttgcaatatttagatagatacctaagtcagagacgtcaaagcaagggctttccttcgcaattataacccctctaatcctatcccaaattcccagctatcttcaaaacaaagccagtggatttctgtgcataattaacacccagactagaccattcttaactggctcctcacctgtaacacaaaattaacgtcaggaaatacaactacacctatcattagctgcattccatattccaaaagagaaaaagatattgctttgaatatatcttcctcttactttttcaaatatttccttatttgaattcctttgggtaaatgtcatttcctgttaggaccccaaattcgaattcctttttgagattcaaaataacaaccagttgttggtttcacaatagcactgcaaaagactgaaagttcttataaatccctgaaggaacaaaaaaccatgagagtttttatctacctaacattttgagttttgatcctttggttttagtttgatatgctaatattttatgcaactaattaataataactaattttaataaactcagaacatctgtagaaggtacaatttaggcaactactaaatcatgcacctctttcctggattcattccgtagttttaaaacaaattagtgtccattaaatacaacatatttccattttaaagaaattatttaaattccacgtaatactttatgcatgcatgaatatttgaacatgtaaaacaaaaacaaaaatgttagaacttgtagttagcactctgttcaatgttctagttcaatttctatttttttcgtctatcctataattgtttatcttgattctattattaaatgagtatgctgggtttataagatgaaattaattccaatctagcaatttctaaattcacaattttataagtcttagctatgtgaaaataaatagaaacagacctttttgctgattttataactaaagaaacctgaattgaataattaggacataaaaatatgtgatagtaaagttttctgagaaatggccaccaaaaacaagattcattttcaagtaaacaatgcaaaaattcactaagctgtttgccaagtagtttttctctttctacctttatacttgcactagctctgctaaaagaagcctaatatatctatgattgaggccatgcctttattggaaatagtgaaaataggataatacattcaatattggttcacttaaggtaagcctaaactacaggagataaagaatgccattagccaaatagaaactgtcttaaagatacaacatctaagaagatgatgacaacagcataatatgaaactccagttagttagcaacctgctttggtgataagacttgagctcataggggtatgcgtcccaataaaataattcaaaacgtggaagaaaaaacagagtgtgacatcagaaaattgctgaaattatttctatttgaatactttttttctgacccagagaggtacaatttatcatggaatgaatggaacaatatgtgacaataagaggaaccaatgagaataaattaggctagattgctgtgatacagtgttttgcttacttgaattgcctacaagtttctttgctaaattcaagttgtttcctatactgcttaacgtgccaaatttgttttgattcaaaatgcagtaatgaaaagaaaaaattacattggcattactttatacggcaaagttatttttagatattaatatattccacaaacaaatttattgtactcattctagttgaccttaaaattctgttattctgctattttcctaaagaatataaagatccagtatgaatgttagtgtaaaaaaatcttacaaagctctacctggctttgatgacccgtcattacacagtaagatccctgctgctactggcgctgaattctcaatcatgatagagctgctccacaatcatggaaagatttgttaatttttgcatccacaccccttcactctagtttgaccacacgctaggttgcctctttaatgccaggttccaccacgtgacttgaattagccaatgaaatgtaaacagaagttacacgagcctcttccatgcaccaggtgcaaatcttgtctcattttcttctatctctttcctcccccgcactgccacatgtgaagctgctgattgcctgggttctggactgaagatcttatggagatgagcaccagctggtctcacgcatgtagtctgagcaagaaaccattgtttatctttttttaaattttctgttactgcagcataattaagccttagatcattaataaaatgtgtatttagaagactggaagaaatatattttatcaaatatatttatatcaaattgtaaacagtaacatatgctggatgatatggggtcaaggtaatcttttcattttttgtttttctgcacttaaggaaaaatatctatttaaatattggaatcaaaataatgctttctatgttctcacttatttgtaggagctaaaaattaaaacaattgaacccatgaagatagagagtaagtagaaggatggttaccagagactgggaagtgtagtgggggttgggggagaaagtggggatggtaaacaagtacaaaaataactagaaagaattattaaggactagtatttgatagcacaacaaggtgactatagtcaataataatttaattgtacattttaaaataactaaaagaatataattgtattggttgtaacaaaagataaatgcttgaggggatagacactgcatttatcctgatgtgattattctgcattacatgctggtatcaaagtatctcacgtaccccataaatatataaaacaatgtacccactaaaattaaaaattaaaaaaatactttataaatactataaaatcaaatgctttgaatatattcatatgctgttctaattccatccattgcaggcagttaaaaatttactgtgataaataatgtatcctaatctccctaaatgggcagatagaattacatactttttaccctttaaccctggaagaatagacgtgtctattggcaatttagaggacaaagaaagaagtgtgcagaaaccctgaagcccttactgtccaattctttatggcaccaagagatgttctcacagtctgcatcaagatggctggtggctggtaataagttttatgctagtaagtacttccgtgaaattagttatttgctggatccaaaacttcattagcttatgttaagggagaattatcttcaaagcaccctctcaactagcagggtatgccccatagacgtttgggccagaaagctcatggctgagtctatccaccccattcccttcccctacatttgcatttctgttccttaaactgcttcctgcttccattcatggaagtaagaccctcctcttccctctaaagatcacaccagcagaaacacctctcccctaagtggctttagttttccactcctaaacttattttatgttgtattgtatttgttcgtcttcattagtaaaagttagaaacttagaaacaagaaagcaaaaagtatttagtgattttataagaatatatgccatgtctcaaggagtgatataaacttaaatattttaaatgtttacattctgctaatttctctctttattggagcaaaataatcgtaacgctattctttaagaatacccataaattcacctcaagaaaaacggaagatttaagcaaagatttaaataatgttgtttactaaaatattatttgtaaaagttaacgataaagagaaaaattaacaaacattgattacactgttatttccaaagaagtaaatatgttgcagtaattaaaacttgtgatttttcaaagacgttttgagaaaataagaaatgcttatgatataatgttaaatggaaaataatttaaaagtatgaatatataacataaatattcccattttaattatttcaattactttaaagaaaaaatggaaagaagcaacaagcatctcaggatcacataattaggaattacatgatagtattgttgccccaaaatacataggttttgtgttttttttgtgtgctttcaaatttttcaacaaaataaggcttcactttcacaactgtaggaaaacaaattaaaggaatctctacatgtacataaattccagttttcagtaatccaaacgctattcaaccaacttcttagttgaattaataatacagcaacaatacagtatccattttaaaatccccatagtaaaaaaaaaaacaaaactatttctctaacattttgaggaataaagttggctactatgctctgctatgtagctgagaagacaaacaaacaaacaaaatcctaaagctctttcctggcagcactgcaaaatccgaacattaatgaggggaaagtggcatatatatgtttattcatagtgctcagattgtgtcctagagattaaagcacttgcccagagcaaaactggaagttattcaccaatagggaaacaactgtggcctcctgagtgctaactgaacctttttctttgtaaaggaaatcacattttaagtgtgtacatcatttcacttcttgcccaacatttagccataaggaatgcttaaaatgtgagactggactttacctttaaatctcattaactttagtaagggacaattttttaaagcttttctttgaatttaaaattaaacttaacagccaggtgcatacattattgtaagtgacaagttgttattaaaaacatgtgtattaggctcttaaatgacctgaacttactgtggtcataccaactttgacagaacattatccaaacctttcatgaagtatttgggatagcagcccttatacctgttgatgttataaattctaacaagctagatttaaaacagagtaaataaaagaataaagagtatatttacagaaacttcaattaataatagcttctttcaatagaactattcgtcctcagaaggcacaatcttgaattactaaacattttttattcttttttaaattttggtaaatttaatcacttcattttctaattttgttttctgttgcttctatttttatgtattcctgttttctgtatgcccaacagcaaaaattgacagcctgagccgtgaacttaggcccgcacagaatttcctataggatgcaagcatcaacatttataactgaataagtcgattatacttacatgtcatgtaacttatatgtaaaataaaaataataaaatatgttgcaaaagaaacaaaaatagatgtaaatactggtaaactttaaactacagataaattgcaaagttctttgtaaagtatctaaatccctacttctagctgggacatctatttgagaaaacctgtctccagctcctcaaatataatttgcattgtggctgcctgaattcacagctttgaagcaatcatcatataatgctcctgtcactggcagtgaaaataaagtgtatttaagcctatatttttgaagcatgtgaactgtcctaatgccaatctcctaatatcctcatgccaggaatattttatttttatgttttggtttcacttatagagcccacactaaatgaaagctaactaaacaactatttgggagttcctagaacctactctttcccaactgtctctctaactggactaccctggttcctcaaattgtaccatattaggtctttttaagttaatcattgctctgcattaaaacatcactgaattttattgtttttctactgttcataatatgcttttattatttttatctataattctgtctctgataatttcccctaattcattctgcgttgctttttcctcttcctgaaacagtctttcctcagatgtccacattactcattccccacgagtcaagtgttgactcaaatattcttccttcagtgtggccttcttgcaccatcctatttaaaattgcagctatcatcttcccctttattttgagccacagcactcaccatcatctaacatacttcctcgtttcctatttattttgaactttattcatctctgcctactctaattaaacttccctgggagcacggtgtttaggctatttttttttatactgtgacatacccatcatattgaagagggctctttttttttttttatactttaagttttagggtacatgtgcacattgtgcaggttagttacatatgtatacatgtgccatgctggtgcgctgcacccactaactcatcatctagcattaggtatatctcccaatgctatccctccctcctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttctaagtctttgctattgtgaataatgccgcaataaacatacgtgtgcatgtgtctttatagcagcatgatttatagtcatttgggtatatacccagtaatgggatggctgggtcaaatggtatttctagctctagatccctgaggaatcgccacactgacttccacaatggttgaactagtttacagtcccaccaacagtgtaaaagtgttcctctttctccacatcctctccagcacctgttgtttcctgactttttaatgattgccattctaactggtgtgagatggtatctcatagtggtttagatttgcatttctctgatggctagtgatgatgagcattttttcatgtgttttttggctgcataaatatcttcttttgacaagtgtctgttcatgtccttcgcccactttttgatggggttgtttgtttttttcttgtaaatttgtttgagttcattgtagattctggatattagccctttgtcagatggggaggttgcgaaaattttctcccattttgtaggttgcctgttcactctgacggtagtttcttttgctgtgcagaagctctttagtttaattagatcccatttgtcaattttgtcttttgttgccattgtttttggtgttttggacatgaagtccttgcccatgcctatgtcctgaatggtaatgcctaggctcaacacagtgtaagtgttttataaataatggcctaaataaatgaatgaattctccattttgtttatttgtgtcttctcccttgttattttcctcaactagtcagtccatgaatgtgttcattttattactctttcaataaaccaccacttaggatttgttattcactttttaaaattatttttatctaatttgttgatttcttttcttcacctctgtctgtttggtagggagggagatttgttcctccatttttccatgcaaatctaagtacatagattttccttttcccaacctttgtgttttcattcccatgctatcataagtatacagctttgtctcttaagaacctgtggcaataaatactcttagcctcattcttgactgtaattcagctggccattcatcgcataaaaaaaaatagaagtataaatcatgtaacagtttttttaatgccctagaaaactgtgatctgtgttttgattcattttattcattatttcttttttctttttctggtgaatgactattcaaatagtgatacccagtgagttaacagctgtaatcagacttgcatttactgctgcttttaaaaaattgatttaacggggttgaactcattttaccacatttgattatttaactgtagcttttcagtctataggtataaaaggtcaaatgctaaatttgagtacttaaagtgaggagtaattgaggttgttatatcaagaaaagatttaatggttggtgatgacacagtatttacatgactaatgttgatttttttactttaagttttattcactaatactctattgccacaggagagttctagggctgaatattattcagatgaagtgaaaacattgaacctaatcaattttaaacagttcatttgaatatctattataaaccgtgtgcattcactgccatagttgtaattaacttagctttatgctcagttttaagcttttttatttaatcaaaatatacccattttctgtttgcatgatgaagaatacaaaatctgtctgttgacagtggaattttgatattaaactgttattttaaaacttttaagtatagagtaaaaaaaaaaaatatgtcttacagaaaggcagccaataaagctgatttcagcataaacatgaaaaggcttatgtgttatttatgttagggatattcattactggatgctggtaaaaatctatagagttcattttcttaatgtgacactttatattaactgaatccttttcttaaagaaggtaggatttcagccaggtatagaaagaggattttaggttcaaataggagctttttgggtcatgattacagcattaaactgtctgtatttcctctgattttgaaccaaagaaaattatttaccttatgtaatgatatggttgggcatatgaagtataaaagtgaattagtacagaaaattaaaactaatgtgagcctgttatgaactaaacatttgtcctccacccttcaaattcatatgttgaaatcctaacctccaaggtgatggtagtgagagaaggagacgttggaggttattaagtcataggagtaaagtcctcatgaatagaattagtgccttgataaaagtaacccagagagctctgtcgctccctttctaccatgtgagaatacaagaatgtagaagtctgcaatgggaagggagctctcaccagaatccaaccatgctggcaccctgatctcagacgtccagcctccaaaactgccagaagtaattttttgtggtttgtaagccacccactctacggtactttgttataacagaccaaactgattaagacagagtccttgaattttgcaaattcatttcgtattcagatcatataatttcattgctagaaatgaatatagaatatactcaactaatccctcaattttaaagatataaaagaagaccaccaaatgaccagggcgaaattgcacagagaggagctagttttccagagatgaagggcatgaagtttcctgtctagactccatcatttaacattgaactaccctgaggaagccatttttctaagtttttacattagtgaaagaaaaacgtaggtaagataaagtgattatgaagataaaatgagtggcagacaccctgtaagtatttaaatgtaatgacattttatgtatgaaactcatttaatttttacaataatcctgggaagtaggtaatattaacttccctgttttaggttaacaaactaacgcatagagaagaaactagcccaaggtaatagagctggtaggaaagagagtcatgattcaaatcccagctgtctgatttcaaagcccaggctctttgccattatatactatgacctacaaattggagaagtgtcttagcaagagaaataccaagaagccaggtatgtgtattttaattgtgactcttggtctgtcctttggaccgcagccttttcaacttcaggcttataattttctcccctgcatttcattctttctactctcctagcaatgatgtctcatttagttattcttttaattttttaattgacaaattataattgtacatagtcatggggtacacagtgatgtttcagtacatataatgtagggtgatcaaatcagggtcattagcatatccatcatttcaaacattgatcattttcttgtgttgggaacattcaatattctccttccagctatttgcaactatgtaatatattattgttaactatagtcatcctacagtggtatagaacattgaaaattatttctccagctagctgtaatttcatatcctttaacaaatctctccctcccctctccccttcccatcctctagtattctctgttctactctttacttctatagatctctcaaatcctatcaacccaaacctgtgcctcagcattttccaccaccatcaccctttcaaaactacctccttttatgctgggaaaacggcaaaaaaaaatttcttgaacccatcaaggacccgaggtcacagctaatcaaataatctgaattccaaagacaaacaagacactacaaggaaatatgaatggttccttcaggaagcgtaaaatcgtgtcaagtaaacaaaggtatgttcaacctccactgaagagtgaagcactgcaacttaagcaaaaatatgtcatctgttacaaaaatatatagctgtcaggctacgaagctggaatgggttgggttcctatataataagcgaacctaagcccaactcaatgcaaacagtaagatggaatttatgcttaaccaatcagaagctgccaaactaatctcttactagggactttccacttttatcaatcaaatatattttcatttgcgttttataaaattttccattctaccctcctcagtggagggctaaagcatttgaggtttggtactgccaggctcgtgactagttgaatgctcaaataaaccccttaaaattccaatgtacataagtttatcttttaataaaatttgtacacataagattggtaacataagaaagctgaataacgacaagtattgacagagaagtatgagaggtagaaacctcaggtactgcttctgggcgtttaggcagaaatagctacaccagagatgagctggctgaacttaggaggataaagagtaaagtagaaatcatggttcccagaatatgcccaagaaatttcaacaggaccataaaaggacatgtgtaaatatcctcataaaattcttgtttactaagaagacaattgatagacgtctatcacagagagaattaagaagatacaatagctgtttactcaagttagatggaatgggtataatataaaacctcaaatttcagtaaatcttaaatgactaatgtgtgaaaaagtaagacagataataatatttaccaattcttgactttctctcttttatagtgctttaatttctgcttgaatctttacaaaaactgcttttttcttcatcctaataagtttttgtttggcggtttcaaggcatttgttcatgaactaatttccagagttaaatgtgttagcttatttatttttattcatttttgtttaattttgtttaataatgaaatttattcaatgacttataatttgcctctggttgttggttttgtcatagtttatatgttttaatacaaaatgttgtaatagaaatattgtgtaattgcaaattaatttcttttttgaccatgaaattattttgcaatatgtttcatacttccacagggtaatgaagaagtaatttttagtctgttgctattttccaggtcttttattgtagtcagacaacatatcaaattaaaaaaattcacttctttagatttattggcttgttgaatgtgtgattacttttaaaaatatatttcatgggcttttaaaagaggtgaattcttgtaagaaactgaaattggcaatataccattaagtcgaagaaatagtttaatattataattctcaatttctcattttcttttttgatccaatgaaaatcaaaggtattgcattaaagtttaatatccagttgcattcctattcctttcttcttatattctaataacttattatgagaaaataaagtatacttagtaatttattatgtttgtaatagtttatttcctcaatactatgatttttcatgagtaatattttgattaaaaattgactttttgttattataaaaaattgtttttgatctagtttattaatactggcctataactccttgtaacattctgctttttgtttggtgctcttattttcatatttctatttttaatttgttttatcaccttattttaggttatttacattaaccaaatcatcagtaatgaaatgcatctattttgcatttgaaaagaaaaataatttgcttaagtcaatatattaattaccctagaaccaaaaggagaagaaatagatacattgatttgaaactctcctgtctaaccaataaaacacagaaacttaaccaacaagcacatacaaaccctagattggatactgttttctgctgaatatcaataaataaagtgatagatggttgcatttcaaagctgattacatgaaacttataaagtctggatatctacaagtaacttttatctacaaattacccttcaaatcttattgtgcagatgtaaatctgatacctaaatttttatttctcatcatggatcagcacatacattctttgtttctctgttcaaagacaaagaatattttcagactctagctcctcattaaagttcccaaattactttatgacttagaatcctgcttttcacactatctgattaaccaaatcatatcttagaaactcatcttgctacatgtgctaattataagttcacagactggttctagtcattattttattaaccatctttggaaaaggagagagagagagagaatgtgtgtgtggtgattatactttctatgttaggaaaatgtaggtttatgatgttataattgtttacctctacagctctatagtcttagacttactttagccccttttcatcattaccataccttaaactagatctgcataaaattatctcttttctgtctctgaggctggttcttccatcttatttctaaatacatagcatgtattaaatttattgcacttcttgagatacttcttgataatgtttttctaaaagttgctacttacgcaatgttctataatttatataagctctactaccacatacaatcaaactattacttctaatattactacacaaacatatgcatttccttaaagattaccaatgcataacaaatatatcctagctctcagcctggagtatcttactgacttcttttcaaatgagacttgataaaacatgagcaatatttgcactcttttattgacaataaatctagatccatgaaattttgtatacaatccatagtcttctttcttctttgtttctttgtttcttcctttctttctttttagacagggtctcattcttccacccaggctggagtgcagtggtactatcatggatcaccgaaacctcgaccccttggactcaagtgatcctaccacctcagcctcctgagtagctgggactacaagtgattgccatcatcccctggctaatttttcaattatgtgtagagataaggtcttgctatgttgcccaagctggtcttaaacgcctgggctgaagcgatcctcttgcctcggcctcccaaactgctgggattacaggcctgagccacatcacccagcctaccacagtcttagcgtccactgttttggaatgaataggctcacaaagccagcagagtcagtgctaaattgttttaaaataatagtatgttctttatctctatgcagttccatacattggaaatgttattacctaaatcattgctcttgaattataccatggctacaagccttcagtttgagtaaactggggaggtgatacatagctttcaataaattatttcagctttttgtttgtctcaaaatatcattaccttcacttttgaaaaataatttttctggctatagaatggtgcactaacaggttttgttttcaatattgttctacttttttctaacaagaagactcttgtaattcaaatattagtttctctgtatgtgttttaactatatcccccattctctttctcctccacccttctcctctcctttcattattttattttgactttgatttttggcagttttttctcctctgtaactatgtatctcaccagcagtatatgaaaattccatttgctctgcattcttgacaatacttgatcttgcctaggtatttcattttagtcattcttgtggttacatatagatacctcacattgactttaatttgcatttccatgatgactaatgatattgcacactttctcatatgtttgttgcctacttggagatcatcttttgtaaagtgcctgttcaaatgttattcttctcttttagattgactgtagttttctttgcagaaatcatttttatatatcgtttgcaagttctttgtgagatatacgtactgcatatgcatcctccaaatttttagtttgcctttcctcttttaatgttatcttttggtgaacataatttaaatacaaaaattatcgtttttcttttatgagtaatatattctgtctagtttcagaaatatttgcataatgcataggcataaagatatccacctatgttttattataaaagttttattgtttgatctttcacattcagatcagaaattgatttgtgtaaaagatgcagggaaagtttgttttttgtctgcatatagatagacatctaattgactcagctttgtttatcaaaaagacaatctttcatcattgccacttataaaacaggagactgtatttatttatattggtttctggcctctttattctatttgtttattttttgccaacatcatgcatgttaatatctacagttcttaatgtcttcatgtctgacacagtgagtattctagctttgttcttcccgaaagccaccttagacacacttgacctcctgtatttcctcatgatttttgaatctatttgtcagtttccacaagatatgattacaagtgttttttatacttgtagttgcaacttttacacaagttgcactgaatgtataaatcactgtggaggaaactgacaactttataatagcaaagcttttactacacgaacattgtatattattccatttaagtaggtcttcttcagcctctcagcagcaatttacttgtagttctcaatatcaacctctcaaacatttttattctgtttatagatatttggtattttctgttcctcacatgatattatttgtatattttattttctatttgcttattgatggtatataaaatatagtgtgcatccagcatactttctaaaatcactcaatacttttaagtttggaaattctttaatagtttagcagtttgaatcttctacacacactattgtgttatctgttttgtaaactgattatatttcttgctttctaatatctatacctgattgcttaacaagttttcttatccatcactggctggaaaatcccatacattattgaatagaagaagtgataacagatgtcctaattttattcttggccttagggagaaatctattaatattttaccactaagtatggagttggctgtaggtttgtttttaactactctttagaaggattacttcatttatctttctaagaatttttattatgaatgattgtcaaattttccaaatatatttttctccatctgttgatatgcttatatacttttctccattttctgttgaaatttggagttacattgattgagttttaccttttaataaactttgaattcctaaaataaaaccaacttggtcttgatgaattcaactttatatatattgctgaattaatttttctaagattcctttagatttttgtatccataatcaagagattttgatctgcagtttccctttcttgtaacgacttaagtttcagtatcaggttatagtagcctcaaaaatgaatttggaaactttttttccttttctattctctagaagatgtgttgttccttatatgtttgatagaattctcttgcaatgccatatggttttcatttgagaaaatttataagtaacagcttaaatttatttttagaaaaacacaggcttatactggctttcttgcatgattttaaagttcagttttttcagaactttgcccgttttatctcagttgtcaaatgtatagattgatgttgttcaaaatcagttgattgtctttttgggggaaggaagggagttaaatttttcctttaaataattatagcttcacaagaagttgcaaaaaaatgtacatagaagtctcgttgactctcacccagtttctcccaatggtaaaattttgcatatctatagtacaatattaaaaccagaaattaacatggatacaatccacagagattatttgaatattaccagttttacatgcactcatttgttcaagagtgagagagagagagagtgtgcatgtgtgtgtgtgtgtgtacaactttgtcacatagattagcgtcaccatcaccacaatgggggttacaaaactgtttcatgatacaaagcttccttgtgctagctgtttatagccatgcctatctctctttccccaattctaaccatggtgaccactaatctgttctctatctttataattttatgtcaaaagttagataaattgaattatatgctgtgtaacctttttagattggctattttcattcaaagatacatctaagttattgagtgttatcaatattttgtctcttttattgctaagtaatactctattgtatggaagtatcacaatttgcataaccattcacctatgacatggtatctgaattgtttccagtttttgagctattatcaataaagctgctatgaacatttacaggcaggtttctatgtgaatatcattcggtttctctgagttatatgcctaagagtgtaattggcaggtcattaggataagtttatgtttattcttatagtacactaccaaactattttctagaattctgtaccattttatatgattaccagcaatttatgagtaatctagtttctccacatcctcaccagtatttggtgttatcactattttaaatttttgttattttagctattctaataggtatgtagtgatatctcattattttagtttccatttccctagtggctaataatgtggaatatcgcttcatgcacttatttggcatttttatatctttttggtgaactgcctgttcatgtcttttgtatattttctgattggattgttttgtttattactctcaaattttcagagttctttatatgttatagatacaagtcccttgtcagatatatggtttgtaaatattttctccaagtatgtagcttgtgttttcatactcttaccagggtcttttatagagaaaaagcttaaatttttatgatatccaatttatcagttttttcttttttaaatcatgcttttggtgtcaactctaaaagctgcctggccctaagtctcaaagtctctttactcctctcttctaaaaatgttttagttttacattttacatttaagtccatgattcattgtaagttaatgttatgaggtatatttcttaagtcaagactttttttttttttttgccatgttgacctattggaccagcatcaattgttgaaaaggctatcctttcattcaattgtttttgcacctttgttaaaaatcatttgggcctgggtatggtggctcatacctgtaatcctagcactctgggaggccaagaaaggaacgttgcttgagcccaggagttcgagtccagactgggcaagatggtgaaactttgtctctacaaaaaattttaaaacataaaaaatagctgggcacagcagcgcacacctgtagtcccagctactcaggaggctaaggcaggaggatcacttgagcccaggtattttttgttgttgttgttgttagatgagtcttgttctgctgcccaggctggagtgcagtggcacgatctcggatcactgcaacctccgcctccctggttcaagcaattctctgcctcagcctcctaagtggctgggatcacaggcgcccgccaccacacccagctaatttttttgtatttttagtagaggcagggtttcagcatcttggccaggctggtcttgaactcctgacctcatgatccacccgcctcggcctcccaaagtgctgggattacaggcgtgagccactgtgcccggccgagcccaggaatttaagatggtagtgagctgtgatcacaccactgcactccagcctaggcaataaagcaagatccatctatttgaaaacaaacaaacaaacaaaaaacccatcatattggcaatatttgtgagggacacttattatgtgttctttatgctcttccattgatctatgtgttgatccctctgccagtattacttgatgctgttttgattatttcagctctacggtattttttcaattccagcagaatgtttgctcccactcttttattcctttttaatattgtcttaggtatgtcacttgccttttcatataaattttaggcatcatgtattgtctttttaatgtctgtaggatctatgattatgttctcatttttatttctactatcagtaattcgtgtcttctcttttgttctttattcattttaaattttgtattatatttaatatttcaatacagacttatatgctatattaaattaataccttagtattaattatttttatttatttatgccaaagttcatccattttatttgtctttttggagaactaaactttgattctattgggttatatattctttttaaaattactgattttacctttagtactttttatttcctttctgctttctttgggtttactttgcatgccactgatagcctcagtttattgctacataagacatctcaagtctctaatcctaactgggcatactatccagttcctgagttacctgtggtggctgcacagttgtcttagttttctcccattatctcaagtaactcagtgcgaaactttcctcggccctaaaaaatacatcccagcttttaaaattatcattatttttaagttttcattttttggtgggagctgtgaccaggactattttcatagccaaaacagtctctactttttggcaagggtcaatacacattggttccaattttctttgtaggagctgaattcctggcgatctatgcttatattcggtcatgtagaactcagttggttttgcacttcagtgcacacttactgttttgcacttccatttagactagtccactgacatgatttgtcatggaatttagcctttatgtcttctttaaattttccagtttatcagtcattgctgtgtgatagaagagacagggtggaaggtctgtctcttctatacaaaccttcagtgtttctggaccaactacttcaaagggtatttttgcagtcacacaatcttagggggaaaaaatgaagagaaaaaaataactgtcagaaatattatgaagttattccatataagtggagtctgtgttcccaatataatatcagacttagaggcaatattttacgggacaaaaatcacaatctataggagctgggccctctacattgcaatatacattcagtgtggcagggattttgcaagaggaagataaaaattttgttagttctattatttcttaaatctttaattttgttgatctagatcttgctgcctggttcattccagaagcaaaaggaagagggcctctttaatatttaagtcataaaatagagctcattcatccagaagtagtgatgcagaatgtgcagtgggaatagctatcaggaaacgcaatgatattacatttatcccttttaaaagataattccgatctacttgacacaattaggggagaaatgaaagtaagtacaggcttagaaattctatcagtaagataaatgctttaaatgaagatcaattaagagccaggtagagtgctcaaaacaagtgtcgggaagtgggcaaattgatagtatcaaagctatgaaaatcactaggaaaagttaataggttggcaaagataagcaagccaatatttggaaaagctaaatagttgtgctaagaacagagtgactcactgaagtacagaattcttatttcttttaatatttttctcactgtttgtttctattaatactggttagagaggaggcagatatactcctgggaaaaggtaagaggatctctggagtaaatgataggaaggagggccacatataggtagattgaaaaatggtttgaactactatcttagacacataaaatactgaatgtgaagttctgcaaaacattagtgacagttgagaatatattaaaaatataattgcaaaaatgattgctaacatttttaagaattagaaatgacaattcactgttaaataaaattatttgctaatttttctctaacttatcaccaatatgaacaaatgaacctactgtatatgtgagtataaacaaaaaatgctctgcctgcttaaggtaagataggcattgttcatatgatatgtttttcagatacctaatcaacttgcagcaatttacaccatatgaaagggaagtgctttggtgaatttataaagccctctaactccaaaacatttgtattttttctttattgatgtaggcaaagagttgcgttgctcatagcgataatttcagggcatacagtgagcattatctgagcaaagtcactataattttttacataattatttatcactttttattcccatacccatatattatccaatgtacagtgtttttttgttttttgttttgtgttttttactttaagttccaggatacatgtgtagaacgtgcaggtttgttacataggtatatgtgtgccatggtggcttgctgcacctgtctacctgtcacatagattttaagccccacatgcattagctatttgtcctgatgctctccctcctcttgcaccccccacctccaacaggccctcatgtatgttgttcccctccctgtgtccatatgttctcaatgttcaacgactcccactaatgaatgagaacatgcagtgtttggtttgctgttcctgtgttagtttgctggggatgatggcttccagcttcatctatgaccctgcagacgacatgatctcactcctttttatggctgcatagtattccatggtgtacatgtaccacattttctttatccagtctatcagtgatggccttttgggttggttccatgtctttgctattgtgaatagtgctgcaataaacatacgtgtgcatgtgtctttataatagaatgatttatattcctttgggtatatacccagtaatgggattgctcagtcaaatggtatttctggttctagatccttaaggaatctccacactgtcttccacaatggttgaactaattttcattcccacaacagtgtaaaagcattcctacttctccacagcctctccagcatctgttgtttcttgactttttaataatcgccattcactggcgtgagatggtatccaattgtggttttgatttgcatttctctaatgaccagtgatgatgagcattttttcatatgtctgttgccgcatagatgtcttcttttgagaagtgtctgttcatatcatttgcccactttttgatggggttgttttttcttgtaaattctgcatattggacctttatcggataggtagattgcaaaaactttctctcattcagtaggttgcctcttcactctgatgttagtttcttttgctgtgcagaagctctttaattagattccatctgtcaattttagcttttgttgtaattgcttttggtgaattcatcaaaaaatatttgtccatggctatgtcttgaatagtattgcctaggttttcttctagggtttttataattttgggttttacaattaggtctttaatccatcttgagttaatttttgtataaggtgtaagaaaggggtccagtttccgttttctgcatatggctagccagttttcccagcaccattcattaaataggaaatcctttccccattgcttatttttgtcagatttgtcaaagatcagatggttgtagatgtatggtcttacttctgagctctctattctgttccattgctgttttggttactctagccttgtagtgtagtttgaagtcaggcagtgtgatgcctccagctttgttctttttgtttaggattgtcttgattatgcaggcccttttttggttccatatgaagtttaaagtagttttttttttttctaattctgtgaagaatgtccatgttagtttgatgggaatagccatgaatctataaattactttggacagtactgctattttcatgatactgattcttcctatccatgagcatggaatgtttttctatttgtttgtgtcctctcttacttccttgagaagtggtttgtagttcttcttgaagtggtcattcatgtcccttattagctctattcctaggtattttattctctttgtagaaattgtgaatggaagttaattcatgatttggctctttgcttctctattgttggtttataggaatgcttgtgatttttgcacattgattttgtatcctgagactttgctgaagttgcttattagcttaaggagttttggagctgagatgatgggttttctaaatatggtatcatgtcatctgcaaacagagatattttgacttcctctcttttcttttttaataccctttatttctttctcttgcttgccttgactagaaattccaatactatattgaataggagtggtgagagacggcatccttgtcttgtgccagttttcaaaaggaatgcttccagcttttggccattcagtatattagctgcaggtttgtcataaatagcgcttattattttgagatatgtttcatcaatacctagtttactgaaagtttttaacatgaaggaatgatgaattttatcaaaggccttttctgcatctatcgagataatcatgaggtttttgtcattggttatattaatgtgattgattttgtttattgatttgcatatgttgaaccagccttgcatcccagaaatgaggctgacttgatcatggtggataaacttttggatgtgctgctggatttgatttgccagtattttactgaggatttttgcatcagtgttcatcagggatattggcctgaggtttcctttttttgttgtgtctctgccaggttttggtatcaggatgatgctggcctcaaaaaacgagttagggaggaacctctccctttcaaatgtttggaatagtttgtgaaggaatggtaccagctcctctttgtaatgtccagtagaattcagctgtgaatccatctggttctgggctttttttggttggtaggctatttattgttgtcggtctattcagggattcgtcttcttcctggtttagtcttgggagggtgtatgtgtctaggaatttatccatttcttctagatgttctagtttatttgcatagaggtgtttatagtattctctgatggtagtttgtatttctgtgtggtcagcagtgatatcccttctgtcatttttttattgtgtctatttgattcttctcttttcttcttatttcttgtcttctgctagcttttggattggtttgctcctgtgtctctagttctttccattgtgacattagggtgtcagtttgagatctttctagctttctgatgtgggcctttagtgctataaatttccctcttaatactgctttagctgcattccagagattctggtacattgtctctttgttctcactggtttcaaagaacttcttgatttctgccttaatttcattatttacccaggagtcattcaggagcaggttgttcaattttcatgtagttgtgtggttttgagtgagtttcttgatcctgagttctaatttgattgcactgtggtctgagagactgcttgttaagatttcatttcttttgcatttgctgaggagtgttttactcccaactatgtggttgattttagaataagcaccacgcagaaccgagaagaatgtatattctgttgtttggaggtagagagttctatagatatctattaggtccacttgttccagagctaagttcaagtcttaaatatccttgttaattttctatctaattttgatctgtctaatattgacagtggggtgttaaagtctcacactattattgtgtgggagtctaagtctctttgtaggtttctaataacttcttttatgaatctaggtgctcctgtattggatgcatatatatttaggatagttagctcttcttgttgaattgatcccgttaccattatgtaatcccttctttgtcttgtttgatctttgttggtttaaagtctgtattatcagagactaagattgcaaaccttgcttttttctgttgtacatttgcttgataaattttcctccctctctttatcttgagcctatgtgtgtctttgcacatgagatgagtctcttcaatacagcacctttctgtttgttagttttccttctaacagacaggaccctcagctgcaggtctgttggagttctagaggtccactccagaccctgtttgcctgggtatcagcagtggtgtctgcagaaccgcagattttcgtgatccgcgaatgctgctgtctgatcgttcttctggaagttttgtctcagaggagtacctggccgtgtgaggtgtcagtctgcccctactgggggtgcctcccagttaggctgcttgggggtcaggggtcagggacccacttgaggaggcagtctgcccgttctcagatctccagttgcatgctgggagaaccactgctctcctcaaagctgtcagacagggacatttaagtctgcagaggttactgctgtctttttctttgtctgtgccctgcccccagaggtggagcctacagaggcaggcaggcctccttgagctgtggtgggctccagccagttcaagcttcctggctgctttgtttacctaagcgagcctgggcaatggcgggcgcccctcccccagcctcgctgccaccttgcagtttgatctcagactgctgcgctagcaatcagcgagattctgtgggcgtaggaccctctgagccaggtgcgggatataatctcctagtgcgccatttcctaagcccgtcggaaaagcgcagtattcggctgagagtggcctgattttccaggtgccgtctgtcacccctttccttgaccaggaaagggaactccctgaccccttgtgcttcccgagtgaggcaatgcctcgccctgcttcggctggcacatggtgcactgcacccactgtcctgcacccactgtctggcactccctagtgagtgaacccggtacctcagatggaaatgcagaaatcacccgtcttctgcgtcgctcatgctgggaactgtagacaggagctgttcctattcggccatcttggctcctcctggttcttgactctttatccaatttgccagtctgtgtcttttaattggggcatttaccccagcaatgtaaagtgttgaataaatatttttgtttgtatgcagtcttcaaaaatatgtatggttgttttgtggacacataagtcatacccgtatgaagatatagaacatttctatcaccctagaaagttaaatcatgcccatatcacgtcaatcccacccccgcccacaaatcaattactgttctgctttccattatttgcctgttgtagaactttatagaatcaaatcatgcattatatatttttttgcttcttgtttcttccagtcagtataatatctgtgatattcctctgtgttgtgtttgtattagtagttcctccttttaatctgtgaattctattccactttaagactggattttactttatcatcatttccattttatccagtttgcatattccttttcttgctgatgcacctgagctgtttccaggttttgaatatgatgaacacatctaccatgtaaattgttacacaaggctttttgcatcaacatgatttcatttcttttagataagtacctagaagtgggaattcctgggtcatagggtaggtgtatattcagtgttataaacaatcacaaaacctttaggttttgtgatattttgtgtctctaataagaaaggatgagaattacccttcctcaacatttttcccaacacacggcattatcagtccttttaattttagatacttaaaacagtgtgaaatggtatctcattgtttcaatttaacttcagaacctatgaaaagttttacattcagttttaatgtaggtgtctgctaattctaacaactatacaaattctgagtcaattgattagtctcctcatattggtcttgttttctggtttcatttttcatgcctagtcatcactgaatggatataagacatcatgaattttaccttgatagttactggatttcaaaaattcttataaatattcttgagggttttttctgaaattcattttaaattactgagaaactgtctgatactcttgggtgttgcttttacgatttttagtgggtctggagtggtgctcagtgtagggttaattattactcaccactgacacaagatactctgcatagactacccaatgccctatgaattatgagctattaggtctaactgttgtgaataggcattattcccacccctgtgtgagtaccgggcactgacccttttagttgtttcagaattttttttttttttttaccaggctgaggctcttttctctaatgtatgcactgataatattcagatgaatccttgaagttactctccacagatatttggggttctttctgtgggcaactccctttttgctagagtttggactttttcttagtgaccagagaatagcaatgaaccatcattttataactgaaacaaaaaccataacccccaagtctacctatccatgatctgtagttctcttccttttttgattgctatttcttccccagtgactcttatactgtttgtaggcctagacgttttgtttgtgcatttttttgtcttttgctattttaatcccaggttatgagagccagctgggtgtggtggctcacacctataatcccagccctttggaaggctaagatgaggagattgcctgagaccagcagtttgagactggcctgggcaatatagagagacctggtttctacaaaaataaaaagtaataattagtgggtatggtggcatgcatctgtagtcccaactacttcagaggctaaggtaggaggatcacttaagcccaggagtttgaggctacagtgagctatgattttgccacttaatttcaacctaggctacgaggtaagacctatctctaaaaaaagagagcttgtcaccttcctctctctcactttgggacacttacaagggtgaatataaggaaagggaggtgttaacacatactaattcatcatcatgtcataaatcaaaagtctggcaagctggtttcaatgacaaaaatacattcacacctactagtctacattgtcattggataaaatccttatcgctcataaaacactaatcaaccccagctacatatgtgaaatatagctttgatcctaattctttttcatttttttctaattttctgcttaacagaagttcaataactaaaggtgccactatttctaaacaaaatattcattatagtctaagatatgttcagacttttgagaattctgactgccatattgagagaaaatatccttttaatgtgctattagaaaagtttattttctacaatatacactaaataaaagtataaggaatttatattttatagatatgacgaagtattattttccttaccttaaagccatctcttaattgtaggattagttcaaattagaacatctatttaatggcagaaaacagtcttaaaactagggatcttgaaaatacttctccaaatctctatttcaaattcctatgaaaagttgttttatgtatcttccaaagtatatttgttttattttttctaagaagtaggatatattttaaagttttcataaccacctagatttatttagtaacttttctctaagaaattaaagtgggcttactcttgtagatttaactcaaaaaaaagttctaataaatagatgcaatgagatatattctattttatttttattttatgtattatttagagttttgaacttttcatccagcaacattctgcctggctgcctctttgactgtaaatcagatcccctcagatagagcattgctccaatgaggacttgagagtgctcataggtacattacttactgaattgcactccagcgtcctgacagaacaaagcactggcaagtgtaacataaatttccacaaagaaataacttcagcaataaactctatttagggataagaaagaggagaataacagggcaaactacataaacgtcatcacaacacagcacattagatgacatttttacagtgacatataaaaattaccttgtagaatcttgataggaacttacagccaaactttcttacaggaacataaagccttcttgatatcatgaaaatctgttgcagttcttctcaggaaagtggcttttcaggaacattgtaattctgttttaatatggatgtaagtgctttcaattaatattcactataccgaataagcaggtctaaacaatgtaatgaaattaattaataagtgatgaattaaaccactgattaaacttatttgaagaccaattttactaagtacatataacgttctgacttacatgattgaacatatagatttaataggataaaaataaaatgcaatttactatctctacgtatgaaaaataaatatataacacaaattttgttagctgaaacaaaggaaaaataattcttttataaaataatcctcctgaatgagaaacatatatacataaactgggaaaaattaaatatatatgaatacatcattaagctgtagagacagtgaagaaaccacagagggctaaaataacatgtaaacagaagctgagaagcaaatgaaatgtgtgaaattcagcttttattctgaaaatttctgccaaattttgggagactaaagtttcccgttcccctaggactgtatgggctagaaagaacagaagtttttaatgtgacatgggtagtttaataaaatatgcctgataaatctggtaccccaaagtgccctatgataagccaaagaatgaatgaaaaatgaacccattataaagaagggacagcaaaaatatttatccattttaaacttgtaactggatgaaagaaaagaaaatctcccatgatattttgtaaccatgaactgagtgtcacatggatttttgcttgaatttatgcttacccacatgttcaggagtaaaacttggagcagaaattttaatttaaagtatggtaaggtttgcagtgctccctgatgactgatagaagaaagtaaaatcatctctagggatgtgcaacatcaattcattaaacaaaaactttccaaatataaagttccaagggaaatgagcagttcagagtcaaaaatcataaaagaaaccacataagttacagatgaccctcaaagaatgtaaatatcagaattatcagacgattttaaatatctgaagaaaagaaaaaaactgggaacaagagcctatagaaaacaagtaagatttgggagagaacactgcatttttataaataaagaagacttcaaatttaacatttaaaacaaagattgaacaataaaaaatagcttagctaatgaactagtagacagcttattctcaaaagctatgtggtagtaatatgttttaaaaactagaattgacattttaaggacaaacttccaatttacagtctggtaggtagagagcttagaagttgtcactcattcctaccaacaagtaaaaagctgaaccaactggcgcggtggctcatgcctgtaatcccagcactttgggaggccgaggcgggcggatcacaagttcaggagattgataccatcctggctaacacggtgaaaccccatctctactaaaaatacaaaaaaattagccgggcgttgtggcgggcgcctgtagtcccagctactcgggaggctgaggaaggagaatggcgtgaacccgggaggtggagcttgcagtaagccgagatgttgccactgcactccagcctgggcgacagagcgagactccgtctttaaaaaaaaaaaaaaaaaaaaaaaaaaagctgaaccaactgaaaaatcaacgactcttcttagatctgtcagagaagtaatgtcacagggaaaatcactggcctccaaattggagagacagatgaatacagagaatcacaacttaccagagcaaagacccacaagctgaaacctccatggggaccagtgctgggtaagaaaacctgagctgtaattaataaattactagaggctcagtatagattattttgagagtcaaaaagtccagggaaacccagttaaaggagtacccctacacttttgtgagctttagctcctagagctaaaccaggttttgacagtgaaagaggagaagagaaatgaaaaagaaagaagagaatttaaaaattccttcatgctccttgcaaggggaagaaaaaagtaatcattttgaaatttaccaaagtattctgctattgataaggcctgcccctagaaaaaactgttttcccagagcctagactactgttttgtttgggggcctaactaaactgggggaaagggaatacccaactctagccttctctagctttccacatagaagaagaaaaatacccaactccagtccaatctagctattctgtcccacctggggccagggatggggggaatccatgggagaagtgagaagcacatgtgaggttaacagtccagaggcataagctcattaaaacactgagacctaatcaggcaactgtaggacactttccctcctctgacatcttatcacctcattcctaaaggcctatttatcctgttacccaatacatcatgtccagctatcaggaaaaaattacaaggcatactaaaagtcgcaaatatagtttgaagagctagaacaagcataagaaccaaactcatatggcagagatgatggaactatcagatgagaaatttcaaacaactatgattattgtgctaagggctctattggataaaggagataacacatcataacagatgaacaatgtcagcagaagttctaagaaagaataaaaaagaaatgctagagatcaaaaacacactaatagaaatgaagaatgcctttgataggattactattagactgaacacagctgaggaaagaatttctgaacttgagaatactcaacgaaaatttcaaacactaaatagcaaagagaaaaaaggctgaaaaaagaacccaaacagtatttaagaactgtggaagaactacaaaaagtgtaacatatgcaaactaagatgaaagagaagaaagcaagggagagaaaagaagaaatacttgaagcaataatggatgaaaattcccccaaattaaagtcagacaccaaagcacagatgcaagaagctcagagaacaccaaacaggataaatggaaaaataaaaaaaccctagccatattatacttaaactcagaatatcaaagacaaaagaccttgaaagaaaccagagaaaacaaaacatcttattaaataggagcaaaaataagaatcatatccaattacttctcagaaaccatgcaagcaaaaagagaataaagtaaaatatttaatgtgttaagagaaaaaaaatcccagcaacctagaattctttgtcctaagaaattacccttcaaaagtgaaagagaaataaacacttcttcagacaataaaatttgaggaaatttgtaaccaatttatttgtatacataaaataaatgacagcaataataaaataatgagggttattttattactataaagtactcacagtactaaagcagcattaaagagtggattttaatgaattgtaaatctatattgctaactctagggcaaccacttaaaaataggaaaaaaaatataactgttatgctaagaaaggagataaaatggtattaaataaaatgctcaattaaaagcatcaagggaagaaaaagtagaattcaaaactgtgaataaaggacaagggtaacaaatagaaaacattagcgaatacagtagatgttattccaagtatgtcaataatcactttaaacatcaacggtctaaatataccaattaaaagacagagattgtctgagtgaataaaaaaacaagacctaaccatatgctgtttacaagaagcacactttaaatataaagacacatatatattaaaagtaacggattgagaaagatatatcatgctaacatatcaaaagaaatgaggatccagacaatggaatcttattcggcactaaaatttgagtaaggtattgagcgatgaaaagactactcagggaggaaccataatgcacattacaaagggaaagaagccaatctgaaaagactgcgtactgtatgattccaactaaacgacagtctggaaaagttaaaacttatagagacagtgaaatgatcagtgtttgccagtggttggggaaggaagaagaataggtggagcacagaggattttcagggtggtgaaactactctctatagtactaatgctatatatatgtcattatcaacttatcaaaacccatagaatgtttaacaccaaaagtcatataaaccatggactttgataatgatgtcaatatagattcactgactgtaacaaaagtaccactctggggcaggattttcatgataggggaggttgtgtacaagtgggtgcaggggatatataggaaattcatgtatcttccactcagttttgctgtgaacctcaaactgatgtaaaaaataaagtctatttaaaaagttaaaggaaaaagttttacttccagacacaaaggtgtaactgaatcagaccagctattcccccatagtcaaaataactgattgtcatgttctccctccctctctgtccttctatattactttctgcacagggatagtgttagtgccttctgggatgggagaaaggtccttcgaaagctcagaagattcaaagaagtctgaggaatcaaactggaggagggataaattcacccagataacactatccttggggtatggtgccaggttctccagctagggccctgactttgacatctcacaactacatctgtgcattgaactgtgttgaaagttcacctgctctgactcttagacaagggtttggtcttcagctctttctgctaatctactgcatgagataagggcttctttgtaagctgccaaagcactctggctctcatgcttagttttcaatgacttgctaattgagcatggcttgcattgtcaaaccactcctcatgccaactatgctagtcaggttctccagcaatcagacattgagataacattagatttacagaagttgcactgacaagtaacgtcttagaaaaaaaccaaacaccgcatgttgtcactcacagatggaaactgaacaatgagaacacagggacacaggaaggggaacatcacacaccggggcctgttgtggggtgaagggagggggaatggatagcattaggagatatacctaatgttgaatgacgagttaatggatgcagcacaccaacatagcacatgtatacatatgtaacaaacctgcacgttgtgcacatgtaccctaaaacttaaagtataataaaaaaaatagataaaagaaaggaaaggagaaaggcttacggagaagaactcatcagacggtgatataagatctcgcaaaatattggccaaccccatgggaagctctggaacaaagatttgcttttagaagagcctcatattgggttaagccattggcaagaagaaagtaacctcaactcaaaacctgaggtagaccctaatggagctagcagctagaggctgacagctaaccacactccttgctatgggtagaaccatttctttacaaaggatctaagatattctttttcatctgacacaaacactatcaaataagtagacataatggacatttggacataatggacatatggacatctacaaatggaatgaatatctacagatggaattccatgtattctaaagatacatggaatatttactaagatagtccacctgctgaggcataaaagatgtcaaattcagaaggactgaaattatatagaataatattcctgaacaaaaatggagttaaactgtgaagtaacagtaaaaaaaatcttaaacttgtaaaactcagattatggtaattagcatatccatcatctaaaatattcattatttctttgggaacaaatttaaggcatggaggcattatcctaagcaaattaagacagaaacagaaaagcaaatatcgcatgttctcacttattgtaagtagaagctaaaaattgggtactcatgggcataaagatggcaacgataaatactggggactactagagggagacaaagtgcggggacaaaggttaaaaaaataattcttggccgggtacagtggctcatgcctgtaattccagcactttaggaggctgaagcgggcggatcacctgaggtcaggaattcgagaccagcctggccaacatggtgaaaccccgtctcttctaaaattacaaaaatttgccaggcatggtagcaagcacctgtaatcgcagctactcgggaggctgaggcgggataggataattgcttgaccccaggaggcggagattgcagtgagccgagatcacaccactgcactccagcctgtgcgacagagcgtgcctctgtctcaaaaaagaaaacaaaaacaaacaaacaaacaaaaacgccacctaattcttgggtactatgctcagcacctggacgacgcaatcaactgtgctccaaacctcagcatcacaccatatacttacataataaatacttccaagcaactgctgattctaaaataaaacttaaaatttatttttaagaataatatgataaaaataaaataaaacatgaatgtaaaaaggcagtttatcatttaagaggtaatctagcttaattttttatgaaagtgtctctctagcctgttattaagcacatacaggattgaggaatttattctctaaagtagcctgattcattttaagatgttctttaatggttggaaattattttatgttaaagttaaattttccctcccattatttccacttttcatcctagttctctcctccagaacctctcaaaatcaatccaaaccttactacacatgagtccttaaaaataatcaaaaacagttatcaaatttctgattctttccttctgcagatgaaacattctcagctccttcaggtaccttctcatgtgatttacaatgacccagaaatattctcattccttgcccttcaacattcttcaatttgattaaaagacctccaaaggtgagctttccagaagagaacacaatatcttaggtgaggtcttccccgtgtgaaatacagaagccacatcccactctcacaaaaataaaataaaataaatttaaaaggcatgaagggcaggcaggagttagcttggataatttctttggtagacatacgattgattacttctaattataatctccttcttgggactcatcaggccctaaaactggctaaatagttttatgcctcatggcctttgcacaagctgtcctggtgaaactaatatttgtactaaaaatacaaaaattagccggatgtggtggtgggcacctgtaatcctagcctcttgggaggctgaggcaggagaattgcttgaacccgggaggcggaggttgcagtgagccgagattgcgccactgcactccagcctgggtgacagagcaagactctgtctcagaaaaaaaaaaaaaaaagaaagaaagaaagaaagatcttaccatactcttcatattcaccatcccaaaaaggctgttccttatcactttttccagggcaaccttttcaccattattctctgaccgagtctaatgtttattttcttcagaaaagttaccaaagatgcaattattaatttgcttgttatcttgtctttgtctctcccactagaatataaagtaaaagtttggtaaacaaacaaacaaaaaattaaaaactgcatctgttcatttcattaatatcctgccagcctttcgcacagtgcatgcatagtgtacaattaacacccaaaaatacttggtaagttaataaattaaaaaatgaaatggtgaccaacaggtttttggttttgcgactggatacataagccaagactaacattacaaaaggacaagtatgttgtggggggaaaaagagaatcatgaaggagtctaagttttttggggtctgtctaatgtctagattagaaataaggatctggatctagaagccacacctaaaaaataaatttatatagcacggtcaccaatctatttgacatagttaaagttgtaggattagatgaggaaataatcagatgttataataaagaaataagaaactaagggacacagaatgagaaattaatgtctaaggaaattaaaagcaatccgagaggtagaagtggaactacagcccaataattccattgtttcaagaagacagaagtgacagataccgtcagatggcaatagaagagacctgaaaaatgtttatgggttttgaaatttagcagttattagtaacttttgagagagagcagtttaatggtattttcggagcagaagcccgagagtcatgcagtaaacaggtcagaaaataaaagggtaaataagagcactctgtcaagatgattgattgaattgcatataagaaaatcaaggtagcaagcagagaagtacccaaggacaaagaaggtgtttttttttttttagtttgtttttagatgcaatagatttgtacatatttatcacctaagggaaagagccactggaaaggaaagcattaaaaatataaagaaaatggggacatttgaagaatgacttatgtgtgatcacaggaagacagcggaatgagtattcatgagtataggcattagatattaggtaggaggcacctgtacctcctgcttgtggggaactctcattggtgcacagaagttaaaagaatgataaatgtttaaaggcatttatatcacaaagatacaaagacagagtagacaagtaaacttattcctcaaaagcacggaggcccccttggagttggagatcatttacttgtagtggcacaaagtggcaccaaaaaaatgcatgcctatgttatgttctccatcactgttccactcacttggtaaaagatagtacaaaaagataaaaggattgaccttgggctggaagtctgtaaggcagatggagaagaataatttgagggaggaggattaaaggatactgcctttataaagatggaaagaggcctagcagtgtaatttgacaggatatgtgaaaaataacaaattaaaggagagaccacaaagcaagtggattgcagagagggataaaggtccatctgagatttgtgaataaggagatgtctaatctatgtccaaatcaaatacatagttggatacttgagtctgacataaaggaagaaatacggactggggttataagtttggtattcatcagcatcaaatagtacttaaataggtgagaatgatatgatcacctagggagtaaacaaagatagaggagaaaggagaaccaaagactgagccctggggctctggagcaccaagacgttgtagagatgagagaagaaggtttagaaggagtacagcagacagaattcttaaattcctgtctcctggtgtacaaaccccaaataatcccctccccttgactgtaggtgggacttaataacataattagatcttactcccatgaataggttatatcttatgggaaagatgtaattaaggtccctaatcagtagatttaaattactaaaaaaggaacttattctgtatgggcatgacctaatccagcaaggtattttattattttattctgttttattttactgagaaagggtcttgctctatcactcaggctggagtacagtagcatgttcactgctcactgcagccttgacctcctgggctcaggtgatcctcccacctcagccccctgaggagctgggactatggatgcacgtcaacatgcctgcttaattttttataattttttcacagagacaagagtttcaccatgttacctaggctgctttcaaactcctggactcaagtgatccacccgcctcagcttcccaaagtgctgggattacaggtgagccactgtaccccactaaaatgtaaaatattctcttcctgggcttgaagaatccaacagccatgttttgagaggtttttgagagggccatgtagcaaggacctgaaaacagccttaggagtgggagtgaccccgatctaatagccagcaaaacaacagaggcctcagtcttaaagctgcaagaaatgagttctgacaataatatgaaagaactcaaagtgaattcttttccagacaaacctctagatgagaaaatacccccgccaacactttgattttacccttgtgagaccctgagccagatttttggccagcagaaactgtaagataacaaatgagtattattttaagccacaaaatttgcggcaacttatgacacagcaatgggaaaacaacactgagagtaatcatagaaaattacgagtgctgttctggaagccaaatgattaaagagggaagaataattaactgttgtcaaatgctactgacaaatgcagtacaatgagacctgcgtattaattgttgaatttactaaagagaaaaattgtggaattatagggtaattcaagaggagatttgcagaagtatagaggtgaagctcaaaggagacaaaaaagtggagggttacctaagttagtaaatgaataaaattaaaattttccaagcatgttcattcttctggagtgtggcatttctgaccaaatgtaaatttaatactttgggttgccttcttgtcttcagaagaataacctcatctttcagcgcatctaaatgatgaataattaaaaggatcctcttgcccttgcagcatttccaaaacaagatgaaaattgagaggcatctgaacaacaaaatttccacaaaaataatgttttcaatatagttcatactttgtgtgttttataaattctccccaacacacacgcatacatacacacacacacataactgtaaattctcctacttttacaactctaattattctgtacaggtagtacagaaaagcaacttgaagatgaagtgcagaaaactatcttcagattaaggagtaatgtattatttctataggctatattcaattaacagaacatttagcataagcaattttcaaacacatacacacacacacacaccccccaacacaaacataaggtaaaatacatttattgcaaagacatacaatcaactacaacagtgtagttaaaggaatgcgtctttctgtagttactaacccagctgaagcaaatgcattttttcctaaagtaacaatcatttattgttaaataactattgtttatgtttatcgaaaaacaatgcagtgtaaagctaatatctctgttcctatttcttagtttatttcttttgaagattggtaaggtgtagagatattgattttattctctaataatcattccttaaactgtatttctgaatgccattacaaccccaggaaaagagagcaagaacaagtttagtgctctgtttgcccatttgtgtagcacaagtggtaccaatttctaataatgtgcctacatttatggagcagccgtttgagttttcagccttgctggaatcgtgttttagttataaaaaggccataccgatgagttttagagtggatatgcgttcatgtgaatctaccctagaagaggaagcactgtgtatccacaggagtctagtgttgaatctaaaaagagaagcaaatggtatctcaattctgagaactgtttctcacatcaaattgcattcacttgaacatagtgaaagttgttttggtgcatctattcccgtgattcagtaaggcacatgctttatcttctcatcataaaaggtgtaaacactcttatatgagtttcctggttactgaaagaagacaccagtgaagaggtatttatgctaaagtgaatatcctcattaacttagtcactgatctactattgtaagaggaagtctatgctagttgtacaataaatacattatgatggaacttatataaaataaactcttgccttttattcattttttgaatgattgttacctcaccttgggagaacaaaatacactctttgtgttgctgttggctggtacagaaagtattggcatgagttaatctaccattgttgtgggtagaaaaaaatactctttttctctgcttgaatcctaagactagttacaagttttcacaacaaataagatgatataagaatagtacttggctttttatacagtaaattacaccagtgacatgtaaaaggtgtagagaaaaaaatattctctgacactgaagaaatatttatagatttataggcacttgtattagtcagagttctaccagatatagacagagatgagacagagatagagataaagatagatagagatgatagagataaacagagatagatggaaagaaggaggaagacagaaagggagagggagggagagagaaaaaaagagagagatttcaaggaattggcttccacaactgtacgggtggcaagtgctaaatctttagggcaggttgacaaattggacagtctcccgcaggaggtgacactgtaatctacactcagagtttcttcttcctcagagaagccttggttttgctcttaaggccattcaactgattggatgacgccaacccagattatcaaggacaatctcctttactaaaagtcaactgattacagatgttaaccacatttacaaaacactttagttagtgtttaattgaaaaactgggtactatagcttagccatgatgatgaataaatctgaccatcataacatccatgacttaaaaggcactgggctagcataaagaagtctagattgagtaagccctcctggggcttagaagctgatagagagaatcatgtttggaacatgacataacaaaatttgttataaaaacagagaggagtctggaaatcaggctgcatatgtaatacacattataaagatatcatatgcctagtacaaaaataacacaaacaggaaaagttctgaatggaacctactacatactaaattaccacatgatataagaagcatcatcaatcaacccaaaaattgtcgattattgaagaaattgggctgggaaaattgagtactagggaaaaaaattgagtttgacactgctatcaaaaattggtttgaatagttgagaaaagttaaatgtggaaattctgataaaatggcaatgtaggaaaagcatgtgacactcatgaccaaacccccactataactccaactccccccgaccaccaccaatgcttgaggaaaacaagtgaatataaaaataagtaaaaccttatatcagcactgaaaactagcaaacttgtgatgcacttttaccagttttgaagaattgttgctatataaagcacatgcgggatcgaaataaaagaaagaataagttcaagacagctcactagtaaatgctcagtgctcattccacgatcagaaaaccttaacagaagatttcaagaccttctacctcagaaagttaggagcaacactgaaacaaccatactgttatttaaggctttcaccttccctgggtgcctacaggaaagcagttcagacaaaatatatcttatcatgtaaagtaagataagataaacgaataagaaaactgataaattagatataaaggatatgttagaaagtataaacaagtattttataaaactgtaagctaagtggctcacacctgtaattctagcactttgggagacagaggtgggaggattgctggagtccaggagtttgagaccagcctgggccacacggtgagacaccatctctacaaaattagaaaattagccaggagcggtggcatgcacgtgtattcccagctgctctggaggctgaggtgggaggatcacttgacccaaggagttcagagttgcaatgagctatgatctcttctcaggagaccaccaagaaatacatgaattattggggtaaaaggactatttcagggaaatccagaaaactaatgagttttgctttttaattaaattggtttgatgaatgggctctgtgttcagaaacaggagctcagcaggagaggccatgaagcagtgaagtgctaggaatgggaacataccttgcttgggaggccaaaggggcacacaccaaatcagtgaagataggaacaaaatacacctgggtccccaaagggcaagaggaactttgatgatatatgagttccacacatttaatatatgatgtgcccacccaaattaaggaaaagtaaagaaatggatgaattaatcaaaaatgtttgcttgggatgagtggttaacaaatcagttcataataatgataatattaaaactgttagaacccgaaacaatttacataataacttccataatcattgagaattttataagaaagcacaaacaacctagatgagagtacaggggaatatttatgtaaccttagcccttcattaaacaaaggcatatcagaaattcttcacagatttgatcaaaaaaattattaaaatcataagctcaatcaaaaggtaacagggaaaatttatggactgatttcttctggcattatttttaatttaattattgatatcaagcattatttgtatagcaagaatattaactgttttctgtaaaaactgtagcaatgaacataaacagttaattcccaagaaaacagccataaaataaacataacttttgatccagtgactacagttataatgtaagaaatgatgaaggatataaacaagggggttggctgcaaagatttacagtgcaccactgttttctcctccattggatacactgcccactgttcccatgatgtaggcacactgaaagctcagacttcactactatccaaagtatccctgtaaccataaaccacttgtacctcgaaagctattgaaatccaaataaacttttaaaaaacattgttttcaatggcaaaatgttataaacaaattaaattatctactaagacagaaataagtgaattatggtcatagaaaactcaataatcaaattctagacatctattaaattgaaattattaaagaatagttaaaaaacattcgtcaaaatatattaaatggaaaaagcatatcatcctacccaatctgaattttatgaaagacatttcctaagtaggatccatgaatttctatgaaaaatgagatttaagactttgtggggaggagccaagatggccgaataggagcagctcctgtctacagctcccagcgcgagcgacgcagaagacgggtgatttctgcatttccatctgaggtaccgggttcatctcacttgggagtgccagacagtgggcgcaggtcagtgagtgcgcgcaccgtgcgcgagccgaagcagggcgaggcattgcctcacttgggaagcgcaaggggtcagggagttccctttccgagtcaaagaaaggggtgacggacgcacctggaaaatccggtcactcccaccagaatactgcgcttttccgaccggcttaaaaaacggcccaccacgagattatatcccacacctggctcggagggtcctacgcccacggagtctcgctgattgctagcacagcagtctgagatcaaactgcaaggcggcagcgaggctgggggaggggcgctcgccattgcccaggcttgcttaggtaaacaaagcagccaggaagctcgaactgggtggagcccaccacagctcaaggaggcctgcctgcctctgtaggctccacctctgggggcagggcacagacaaagaaaaagacagcagtaacctctgcagacttaaatgtccctgtctgacagctttgaagacagcagtggttttcccagcacgcagctggagatctgagaacgggcagactgcctcctcaagtgggtcgctgacccccgagcagcctaactgggaggcaccccccagcaggggcacactgacacctcacactgcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaacactaaaaagcagagtgcctctcctcctccaaaggaacgcagttcctcaccagcaacggaacaaagctggatggagaatgactttgacgagctgagagaagaaggcttcagacgatcaaattactctcagctatgggaggacactcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagacgaaatgagtgaaatgaagtgagaagggaagtttagagaaaaaagaataaaaagaaatgagcaaagcctccaagaaatatgggactatgtgaaaagaccaaatctacgtctgattggtgtatctgaaagtgatggggagaatggaaccaagttggaaaacactctgtgggatattatccaggagaactttcccaatctagcaaggcaggccaacgttcagattcaggaaatacagggaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagataagaattttcaacccagaatctcatatccagccaaactaagcttcataagtgaaggagaaataaaatactttacagacaagcaaatgctgagagattttgtcaccagcaggcctgccctaaaaaagctcctgaaggaagcgctaaacatggaaaggaacaaccggtaccagccgctgcaaaatcatgccaaaatgtaaagaccatcgagactaggaagaaactgcatcaactaaccagcaaaatcaccagctaacatcataatgacaggatcaaattcacacataacagtattaactttaaatgtaaatggactaaatgctccaattaaaagacacagactggcaaattggataaagagtcaagacccaccagtgtgctgtattcaggaaacccatctcacatgcagagacgcacataggctcaaaataaaaggatggaggaagatctaccaagcaaatggaaaacagaaaaaggcaggggttgcaatcctagtctctgataaaacagactttaaaccaacaaagatcaaaagagacaaagaaggccattacataatggtaaagggatcaattcaacaagaagagctaactatcctaaatatatatgcccccaatacaggagcacccagattcataaagcaagtcctgagtgacctacaaagagacttagactcccacacattaataatgggagactttaacacccaactgtcaacattagacagatcaacgagacagaaagtcaccaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaatctgctcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcgacactgatcccacagaaatacaaactaccatcagagaatactacaaacacctctatgcaaataaactagagaatctagaagaaatggataaattcctcgacatatacactctcccaagactaaaccaggaagaagttgaatctctgaatagaccaataacaggatctgaaaatgtggcaataatcaatagcttaccaaccaaaaagagtccaggaccagatggattcacagccaaattctaccagaggtataagaaggagctggtaccattccttctgaaactattccaatcaatagaaaaagagggagtcctccctaactcattttatgaggccagcatcattctgataccaaagccgggcagagacacaaccaaaaaaagagaattttagaccaatatccttgatgaacattgatgcaaaaatcctcaataaagtactggcaaaacaaatccagcagcacatcaaaaagcttatccaacatgatcaagtgggcttcatccctgggatgcaagggtggttcaatatacacaaatcaataaatgtaatccagcatataaacagagccaaagacaaaaaccacatgattatctcaagagatgcagaaaaagcctttgacaaaattcaacaacccttcatgctaaaaactctcaataaattaggtattgatgggacgtatttcaaaataataagagctatctatcacaaacccacagccaatatcatactgaatgggcaaaaactggaagcattccctttgaaaacgggctagccatatgtagaaagctgaaactggatcccttccttacaccttatacaaaaattaactcaagacagattagagacttacatgtcagacctaaaaccataaaaaccctagaagaaaacctaggcattaccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaataggtgctggcgaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttagaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcacccataggtgggagttgaacaatgagatcacatggacacaggaaggggaatatcacactctggggactgtggtggggtggggggaggcgggagggatagcattgggagatatacctaatgctagatgatgagttagtgggtgcagcgcaccagcatggcacatgtatacatatgtaactaacctgcacaatgttcacatgtaccctaaaacttaaagtataaaaaaaaataagaataacaaaataaatccaaaaaaaataaaaaataaaaaaaatttaaaaaaagacctttttatctttttgcttttctacgtattatgtgatgaacatacagtatgtaaatatacattattaattatctaatgacaagaggaaataagctatttttgaaaccacctttccaatttataaatttttcttttaattgcatgcaattaatatgtattaggtagagtaaagaaatgattagaaagtattttcaaaaatgtatagagaacatttgcagaaagctaacaaattgagagtcgtagcttctacctagaaaacttgccttattgtgtatagaagtctggaccatcatgaaccatatccagacctcatggggaaattccatgtggttcaaagagctataatcaaagaggtaagtcattcacacacacacacatacactgtctctcacacacacagactcacacacatccacacacatatgcatacatatacacacatgtatacacccaaaatacaattatggagtagaaaagagaaaactgtgacaaagtgtcctggcttggagttggaatatactcagttctcggtttattctatgaaaggagcccccttacctgttcttttttgttgttctggactttactgtccatgatagtctttcttgtccattttcctccatggtcacatatgccatagactttgaagtcacgtcttggcgactgctttctattaatctggttttgaagcttagccatggcttcagaagtcaagtaacgagaggctactacaagccagacttttcatttctttggcgccaacccctcaaaagtttctgttctatttgcctctagatggttacatattcacgttaccacagctgaagttctcaactgggatcatttttaaacccgaaagctctgatcatttatttactggcctctgtgttcttactactcttatccctttcaatttagtggcagtcattttgacatgtcgtttacaataaggaaaaaagaatatcccttagaaaagtatttgttagtttctggatggtgtctgtggtctgtcaaagaaaaattcagggaagctgcttgtgaggagtttgggcttagaaatcttgtctccagcgacagtatctgttcagagccatctcatacaaaggcttcattttggaataaaagcagttggctttttcaacactggattttaaaacccagaggctccattattagatttcattctgttgacaaccttttcatctcagcgagcaaaatgatgtattacagcccaaattcatttcactaataggactttactataaaaggtaaaaataaccaacatacatcaaatttctgcatttttcttaacatgtgctctgtaggcatacaaactgacttccaagatatcacagataatggatttgccacacatactggtatgacatggcaagtgtcacctgctggcaaacctgcaatatcggcacccttgctattgccacccgaccactgagactatgcatcaagttttaggttctgttaaggcatcccatttccagacactgtactaaggctggtgattgttcaaatgttgctttggactccttagggaatcctaaaacaaacaatgtttaccttaaacaaaatagatgtcacaacaagcccaagaaagtaggtcaagtctcctctgctaagccctcagggacacagacaacttctgtcttgtgtccctttaatcttcaagagaagcttcttccatcttttgattcaagacagtggttccagtttctaccctgggaatggagaacaagaccgtatcacatgctgttaaagcacagcccaaaatgtcatagctcattttcattcagatgtcattgaccatagtttagccacatgtccatacccagctacataggaagctggaaaatataatccttagctgtgctgagtccaaaagtctatgatgtatgaaaaagggtgaatgtattgtgaggaaaaaactagcagtttgtatcacttacataagatgcatatttaagtaatcaaaatgatgagtgccccaaaggaaaaattggcagacagaagcaaaaaactctaaaaagaagaaagaaaagttattaaaccatttaaaagtaaacctacctagagatccaagaatgcaactggaaacagtgaacatatacatatttctatcaaatttaaaatagtctaaaaaattataatacctgttgtcatcatgatttcagtgagacatacatctccatattgttagaagtgtgtaaatgcgaacaaactgcaggaaacaaattggtcatctgtctcaagagtgtttacattatgcagtccttttgctgcagcaatttcatttctagaaatccaccttaaggtaacaatgatagatgagataagcgattttcataaaagaatgctcactgacactgtatttacaattgcaaaaatttaaaaatctaaatgcccaataaaagagaatgacaataataatcatgattgagacacatactagaatagtaatcagctgttaaaaatcatgtttcaatagaatatttggcaaacttccctaatgcaacactcgaataaaagtaaaactaggatatgacattattttataaaatggagtctaaactgtgagtaggtattaaattttatatcaaaatacctcaaaattataaagcaaattgtattttttatgattttttgcatttccatgttatctacagtgtacgcgttttaatttaatagatcagaaagtcaatgatgttatattcaaagttattcagatgaagatgactatgttcctcaaaactcaaaactaaacctcagcagattatcaggaaatcgtcttcatttgctcagttcataactgactctaacagctgcttgttcatttatattttctttacttctctttttgctgaacttgttaactcaatgaattgatagatatttgaaaaatgagtttcatatgaaagaaaattcccttactcatcctagtctttctttggctaatgtattttgttattcattacagtgtcctgcccacatgcgtagtggcataaatgtctgctctttgagctcagtcagaaattaatacttttacctttatgctgatttttcataatatatggaatgagttaatgggctcaaattttattttcaccaactaaaattacggagaagaaaattaaaggcaaaaatattgtttaaattgacatgaaaaatatattttaagtaatcacagaatagcaatggttaaccttctctgattgtgccagataccacactaagtgcttagcagttcttggcctattgtgtcctcacatcaattctctgaggcaagtgctatgattagcttcattttacaggcgaggagtctgaagcacaaggagttatatacttgtccaggattgctcagcagtgaggggtggagttgcaacccaatccaaggcaatgtggctacagcgtctgcacatttggccagatcacaacactgtctcatcatatcaagaacgatgatagaatcacccataagttttcaacagcacagcctctggtaacaagagaaagttatgtcctcccttattacagctaaagaaaataaattgcttctatgttgataccatcagagacagtttctcatttttacttttagcagatctgctgtggtacatttgataactcggcagaatccaataaagggaatgacagagggaatatcagattcagaacagacatagctggtcagtggcgagaacaataataaaacatttgatcaccttgagtagtaagcactacataacatcacgatatgcattcatgaatgtgtgtgtgtgtgtgtgtgtgtgtgtcatgtcttgatatgccatatatctgtcctttgaagtatcttcttcaattcatcatccagcttcaaattcagacctgcaaaaatgctctaggcaaaaggtgtcctttcaactgatctgtttgttattgtaatgagagcacattttatgtgcatagcccaatattttagaattaagagcatatacaaaaaatgatacaatattcagtgaaatgttcatcaaatccatccagctgcaccagaggcagcttttatgattctcaaaaggaaagtcggattccttggaacaataaaacaactgcacttatgtaactgacatttgatgaggtgagacaaatgttccttcagatttccagagctggcatatccaaagtagcaggtcagtgtagagcagtgtatgcgtgtgtgcatgttgtacatgcacatcagctactgtttggtctaataattggagcccagctattgtgctggatgatgctctgatctaattattgcattctgccatttcaggtaactctgacaagccatcctgtgcatatgcctcatgactttaattgcaaggagctgaaaataaagctatttctcaagttttttgtgtcttcaagtgccacagcatccagctctcagaactctttacattccctttatgctctatttagggtttcattgaaatctattatatttcacatcataatgagaggggagcaatcaagttgttttgaaagatatcagcaaatatcttggaccaaattccagaggtagttttaatgctcccaggatctttttaacattaaaccctattgacctaggatctagcaatcactcctttcacagtggccaaaaaatatacatgtatctgagatctgggggaaaaataatgactcaaaaatatgaaaaaaataaaattttaaaaaattatgtaatttctgccaacacagcactgtgtcatcctgtgagctacaactcaattattagttacatatgaattttgttacattcattttgatgttgatatattttaaagagtgagaaataatgtacaattgtcatcataaattgaaagaacctaattgcctaaaccctattttaattaatagtaggattgtcacaattctttaccctggttctccagatgttcaaatgtatgagttaatcatttaacataaatgatatatatcattacggtctgttgaaggttggctagtttgggttaaaaatcagcttctaagtctggtccctaccaccagttacacaagggcaattagaaataagcagttatgaaaattctgctacaaaaccagaagactcttttggcatgctgaactttatcttatattcatagccaaaggagaagcctctttttcattaacaattatcacttttgttatagccctggttcataaccttggctgcacatcagaatcccatatagagttttcaaaattacatacacccaggcatcacccaacacctctgaatcagaatctcagaggaaggcccaggaatttatttatattatatatatttttttaaaaattacaggtgatttagatgtactgctgctgtgggaagaaatagcctaacaagttaaaatgggcagatgtcactgatgccttatcatcaaaatgaacttcaatgcggctgacggtgtcgttaatggtgcaatgtgtcaaatttggtcatgttttcaagtgccatttctggttacgttgctgccttgttttaaatggactgaggttttttgtaacttcagttgcagacaatattttctgagagtgcacgagaaatatcaattttctgcagagattataccaccccctaacagagtggaaagccactattttacttctttaatgctgacaaggcatctaaagggagaccatttatctttcctgatagttcaggaaaaagacaaatgcacgtctccttactgtattatcaaaaccaaacaaacaaaaaccaaattaactcaccaaatttgtgaaacaatgacacttgtaatgagagccttttgagataatagaataaaaatattacctgttaaaatgtacacactacactttgaacagaatgacagtttattctcttacattctataaccttaagaatgatttgctttctcttcatcttcactctgtaagaatgcttaccaacagacaaaaagaaacttcccgaattccaacaacaaagtaacaatggatttgaagaaagggaaaacagtaatctgacaacattcagtctttccactgatgacctgaccctttcaaagttgtccaaaataacaagtcaagaatcacttgaggtcaggagttcaagaccagcctggccaacatggtgaaaccccgtctctactaaaaatacaaaaaattagccggcgtagtggagcacacctgtaatcccagctacttgggaggctgaggcaggagaatcgcttgaaccggggaggtggaggttgcagtgagccaagaccgcaccactgcactccagactgggtgaaaaagcgagattccatctcaaaaaataataataataaataaattttaagaataaaccttttgtgttagggtcctggggctcctgaaacaaagtaccacaaacagaatggcttaaaacattaaaaaaaaacaaaaaacaaaaacaaaaaaaacaaaacagaaatgtaatctctcattgttctggaggccagaagtccaaaatctagatgcccacaaggttggttccttctggaggctctgagggaggaagtctgtttcctcctggcttgtttgctgctgacaaactttggtgttccttggcctgcagatgcataatttcaaactctgcctctgtcttcacatgtgcatctctgactctttcggttgccttcttataaggacactggttgcaggatttcagacccatcctgattcagtgtgactgcatattaacttgatcatatctgccaaaatcgtatttccaaataacgtcacattcacataaggtcctgaaggttaggacttcaacgtatattttgggggaacataattcaatccacaacacatgctttcattaattacacagttttaaaaaataacttgctaactttgagtttgagtaaagtaacatttcatttacattcctgaattcagccccattcaaaacaggcgatcttgagtaagctacttaagcctgctcagcctcagttgactcatttgcagaagaccatctcatagaactcttatgaggtctaaatatgacagtgtatataatgcacataatactactacttattgagggcttattatctaatccaaaagtattctttaaatgaacaaattgacacactaaagatttgaatgacttcctaatggcaccagagctaggagtgaaacacctaaatctaaatcctaaatctagaatactttcctaaatctagaatactttccactacatcattttgtgcttatgaaattataaaaatactggatcatttttccatttatttctcaatgttatctatgttagtgagcctcagtcagaagaacgacaactttaaaatttgctttgcaatacaggaagcaagcagatatgctatgtgtgatcttatttcaataaagttgcaaagtaacacaaaccaagtattcacacatacacagatacaatgcctctgaaatggcacctaaaaacaacatgtgtgtagtgtgtgtgtgtgtgtatgtgtgtgtgtgtgtgtgtgtgtgtgtatacttggtttctgcctctttgcaaccgtattctcttctacttataaagtagtatcctcatttcttcagttttcttcagctacaaggaagcctggggcatcaccagccacaagcttggccaacttcaatggaggcagccagaataaaaaatttgacagggctcagttaaccagcactctttcaccaggaaggcatttaaatttgttaactgcaagtatggcaagtataactctgccagctttacttatgcaataagcttagtaccttcaaataaagtgaacttaactccattactagaccaggcaactcaactatttcaggtttcaataaaccacatttaactctcacaatgtcaacttagctataatcaatgtcagcagaaaaaatggttttgttattaatataagagcattttgagctaatcatattatttactaattaattcatcatttcttggctactttgtcttttaatacttggttttaatctttaaaattgtattatgatcaattaaaatagcctgatttaatttcgtctagctttttttgaataaacataattgtttttaaaagaactgttttattgtgtaagtatatttctgcatttctagatgtaatgggaactatttactctaaaggaattaagagatttattgtcaagaattctgctgtgtcataaactaaaacataaaatggaaaatcactgtgaacttactatgaaaaagtgataaactttgttgtctaatgctatgattcataaagctttactcaaaatcctctggctcaattttagaaaccttataatcagtttttctgtttaaacctataatcacttccatttttcatgtcagcagtttgtgacactcagaattccttccgaagtattttaatttcatcaaaaatatgtaacacagataagatccccttctacagcacacaggataagctttctcactgttagcaggattgtcctgtctttttcaggtaaatcttctcaaaatgtaactcacctgatacttataaaaggtataagcattattataaaggtaataattttgatatttttgtataacatgcaataatctgacatagaggtattagtaccaccaattattttaaaagatctatgcatcaggcaggttttgtagataattcaaaatcatattcaaaaagattaaatgaattaagatttaattacccaaatattctcaaaatgccaggcagtatgatagctagtatctattcctcaaatcacccacctcagtgattctaaaagaaataaccccatagggaaatggcacaagaaacatcaatttgatgttcaagacttggttgatcttgccatttatgcccctataatttctatcttcttaaaagcaagaaaattttgtgcttcaaatagcatgagttcactcttatacagcggagggtaattcaatatgtggttttcttccaattcaaagcaaggagagaggacagcaagaggaactttgcagtaaagaaacccaacagacactacttctgccagttggtcaaggtcaacatcaattatcacaagtcatgtcgatagtatgcatccttgatataaggagatgaaaatgatgctatatctgttcttccttccaataactatagcaccagttttatcataagaaaataatcagacgaattccaatattgggcaacctacagaacatctaaccaggattcctcaaaattgtcaagggcatcaaaaacaagagttgtctaagaaactgtgacagctaagacaagcctaaagagacacggcaacaaaacgtaacgtggtatcctgaatgggatcctggcgcagaaaaagaaacactacgtaaaaaactaaagaaatctgaataaactgtggatgtatatgttaataacaatatacaaatattggttcactaattgtgacagatgacccacactaatgtaagatgttaataataggggaaagtgcacacagactatatgagaatcctctttactggcttcttaatttttctgtaaatctagaaatgttctaagaaaggaagtccattagaaaaatcccaaaagtccacccagaaaaaaaaaaaaaggcgagtgaaggcataaaatgcattcacacattttcaacaaaaaaatctactgtgaattaataagatatccttaatcatttgccaagagaatatattgatattctttatccatgcagagattttctcttttttttttttttttttttttttttttgagacagggtcttcttgctctgtcacccaggctggagtgcagtggcgcgatctcggctcactgcaacctccacctcctaggttcacgtcattctcctgcctcagcctcgcgagtagctgggactacaggcgcgtgccaccacgcctggctaattttttgtatttttagtagagacggggtttcaccgtgttagccaggatgatctcaagctcctgacctcgtgatccacccaccttggcctcccagtgtgctgggattacaggcataagccactgcacccggccttccctttctgtcaaacaaacaatgaacacatgtgcaatgatattcagcaaggcaatttagttagaagaggatacaaatcaagaattatgcagaaaatataggccaatggggctagtatcattagtagttttaattagtagtttcttgctattaacctaggtatgtcatcagatgggctccttaatgaattggtcctctttcttgctttatgccactgggctcaactcaatttccctcttaaaaatttgccaaaaacaaaagcaactgtccatcacatgacacgtaaatgggagtacatacctatttcatttaagcaaagcacacttgttaaaacacaactatttttacatgtcagcgaagatggcattgcgagttggcacactgctctcagcttctcattaccacccttcttgcttgcttgcttgctttctcttccttctttttaatgtaaaattctttgctgaagcataacaaagaaataagaaagttcagcccaatggattttcaaagtgaatacatccacgaggtaagcacctagaaacagagcattactgaactcctgtagccccagtgtgtccccttccagacagaagcctccaatggtaaccactatctcaagatctaaaagaattggtttgttttgcttgttttttgaaatacatataaatggaatcctatggtgcatattttttttgtgtgggtccttttagccattattatgaatcctatggtgcatattttttgtgtgtgggtccttttacccattattatgtttgtcagctttatccatgccactgcattttaaaaatttttctgtgattgaattatgccattgtatgaatacataacgacttacccattctactgggttgggttgtttccagtttagcactgttgcaagtagtattgctatgaacgtggctataattgactgttaccctctggttaactttgctgcacctccatggcctagaatctccaggaaggaagtcaactaaatatttcctgaaatcacaagcccatgtgtttgtgcaaaatcacttttaaatttctgcatacctttaatgatgccattcaaaaagggccaaggccacatttttctcagtctacctggtaagtgatgaaagtgttcctctaagtgtaggcaagcaaagaagaaggatggtggtattgaaaacagaaagggctacacttcaggcaggagagaagcttagcattagctgatgtcaatgcagtgtaacgagtgggcatttaatgttatggttatggtataatacaagaaaccaacagagtcctgaacaaaaataaattcctgctcttggacactttacccagctattgccacacaataactttggactaattactagacctgtttctttggtctctgatgacaaagttccccttcaagaggatttccgctgctttccagccactaaaaactctaggtggtaagtgtatatgtgcatgtgttgaaatcctcatacttgaagtagatcttgttaattactacataattgagttaatccaatgtcgcagcaaaatattcttctgaatcccaagttgtctgaggtacaaatttgtcactgaacatcatctgaaactctccatgcaaaattcgtttactgaagcccaggtgagaatctgtaaggaataatttaagcatatacagacagtccccaacttaagacggttcaatttacaatttttcaactttacgatggtgcaaaagcaatatgcgttcagtagaaaccatatttcaaatacccatacaacccttctgtttttcactttcagtataatatttaataaattataggagatatttaacactttatgataaaataggcttcacattagatgcttttgcccaatggtgagctaaggtaagtgttccgagcatgtttaagataagctaagctgagctatgatgtctggttaggtgtattaaacacatttttgacttaatgatattttcaacttaccatggatttactgggatataaccccatggtaagtcaaggaacatctatatatttattttcagcatgtattaatcataatagtattttaagagacattttacaagagagatgaattatagattctgaggctatgacatggccattaaataacctctgctgacaaataaattcagaaaacccttagaaaagaaaaaagttattctccataatttcctctaatgttgactaaaggaaaagaaagtaatcaaggtaccaactttttctgagttgaagtaaaattgatcacaaggtctttcatctgtttatacccgaggctaaagattgcaatcaagctaagaggtttcctttacaataacgtgtaaaaaagatgcttttgtagagagaatttagtatagcctcagagttgcacatttttctaaacctccatagtaggaacatctctgagatagagacaacattggccaaaattttaagtcctcaaacctttagcctacacattacctccctaaaaggggccaaagaataaatgcagagggccgggcgcggtggctcacgcctgtaatcccagcactttgggaggccgaggtgggtggatcatgaggtcaggagatcgagaccatcctggctaacacggtgaaaccccgtctctactaaaaatacaaaaaattagccgggcatggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaaaaaaaaaaaaaaaaaagaataaatgcagaggaggcgagtgggcagagagacatttctcaacactaatcatgattgggctccaaattcttgtcttctctctcactcttgagagaggactggatcagatgggtcaagaatgccatttgctcctagagcacacataaggaagatgagaccaagtttttggataattaaatattttaccaaatgggaaaggcttagaaaattactagctggtaatgagcatgcaataaacatgagctttcatttgtatcattccctaggctcactacttgatcctgaccctatagcttttaatattctgatggtgataagaggcataaaaacataaaccaataaaaatagttttctcactagagcatctcattctgtcatttcttttgtgtcctaaccttaaccatatttggcttctaaagttgcagaaaacttccccaggctcatttgaccatatcgatgtcatggagttctgagagaaagaattcagggagaagcatgattaaagaagggagtgatccctgcaaaagatgcctaacaaatatcaaaacttccccaggataatagcctcaatgtgtattacgtattgtgattaacagctcttacagtggtgcaaggaagcaaaaccaaggggaaggaacaaatcccaccacaatgaagagaggtatttgggccatacaaactcttataaaagcctggttctctactcaagagtctgaggcagaaggattgcttgagcctaggtgtttgaggttacagtgagctatgatcgtgccactgcactccaacctgggcaacaacatggtgagaccgtgtctctaaaaaattataataataataacattaaaaaaagttctatgagctgggtttaacatgtgctactcacaaagtgctttctgtagtataaggataaaactacatccttagaatcttcaagacagaatgctatttatttcccattgtctgtcaacccgaagttgcccccacaaaaacggaggatctaaatgtcagtttaaaatggggcttacatatgtatacatgtgccatgacatgtaccctaaaacttagagtataataataaaaaaaaaaaaaaaaaaaaaagaaaaaaaaaagaaaaatggggcttacaaagtgtgttccattcctaatcacttttgcgaatttgctaaatagtccaattaattggttttcttccagatattttctggttctgcaattccattttgaatgtttctagcatactttgatacaaaccaatcagcaactaagcccatagacaacaataaaataactccaggaaaaaaaaataggcatggttggtgttggatatgaacaacaaacaatatgtgaacataagcaaatcattagggaaaatcttcattttctccgatattttcattttgatttaataggcacagaaaacatatgctacaattatggaaggtaatacatcaaatgaaagatacatcacataacacaatgagcctttggagatgtgtgaaatgatagcacaaggccctgaaaactttaaaaatagaggcattctgagtctctgcaaacctttggagaattaagagaaccaaataaggcaatttattactttctacagcttacaatcctaagagatttagggaatgtacatttatatgcttcttgtataaggttggttaacacaggaggtcagggtattttctttacatttcatttctgtagaactcttgaaattacatagatttgaatgccagagggaaaatagaagtttccgttgcatgtttgataagaagcatttcaagttaaaggtcaatggtcaatgttctgatgagtggcctacaagcccgagcttttgcaaataatggcatgtgctttccttctccaaaaataatgacaagcagatgagaagggactcccagatggggaggccaattgaagggcaaatgagcctgtcctgcacttgaaaatcagagcatgtgacagagagcaagtaacacttttcagagctctagtgggctgatttgcatccaaatagcaactcgagacaagcaatccattcttttaatatatattatttgtcttttggggcataggaggctatactaagaaaccatgaatttcattcctcaaaaagtttaccatcaaagaaaattataggaaataaaaattactaggtacctaaacaaacaaacaaacaaacaaaaaacagcaaaaaaagaggctcaagaaaaataaatttgttggatcaaaattttacatattagaaaaatatatatttgtgcaaatagtaaacccaatctaatgtacaaaaactttaaaatattaaggacatccaattggtaacacaatatgttgctattaaaaataatagagtacttctagactaactataactttggtacgaggatcttactgtttccttcaaatcccaataaaagtgatgaaagaaaaataaaatagaggagtaattgcagaacattgaacagaaaatcaaggtgacattcacgtggcgcaatctttgaggtagttccacataaattcctaaagatctagcaaattctttgaaaatcatacatttacataatgaatcctggggggacaggaagaatatggaactgagagcaaacagttcaaaaccttgttgacatctgctgtactcagaggcaaatgctgtgagataggagttcagcagactccgcagataaaacaggatgcagtaaagaagctggccaaacctcccaaaaccaagatggcaaaaaaagccacctctggtggtcctcactgctcattataccctaatcataatgcattagcatgctaaaagacactcccaccagcaccacgacaatttacaaataccatggcaacatccagaagttactgtacgtggtctgaaaggaagaggaaccctcagttccaggaattccacaccccattcctggaaaactcatgaataatccaccccttgtctagcatgtgactaagaaataatcataaaaatagtcaaccagcctatggagtagccaccctttcattcttttatgtcttaataatttgctctcacttaactctgtctgctcactcttgaactccttcctgtgcaaagcgaagaacctatatgacttctcaaactgaaccccaactttgaggttcgccctgtgacacaactatgtgaaataagaagcccagtggtggagcctttccctgacatggtaggccgtcctccaggatgatggtggacaccatccttgcccgctcacattctgctgagaatgaaggctcagtaaaaaattacatatgaaagctggcctttgccaaagaagcatagctgtctacagagaacaaactgtactaaaataaagtctgtttatttccccttatcccag

SEQ ID NO: 9 - DNA, 79634 bp, Homo sapiens
aaaatcccaaaccactaagattccttctaccctaacactattaacatgtagtagaaaacataattattatggagtccttagggtattcaagcagtttaataatatcacatatattcttaaataaattcagcatattccaaagacctgagaagaaattgggatggtgatgtccatgagatgttaaatcagaggatatcttctttttatttttatgcatacataaaagttttacatatttatgaaatacatgtggtatttcgatgcaagcatacaatgtgtcatgataaaatctgggctactgggatatccatcacctcaaacatgtatttcttggccttaggaacattgcaaatatactcctgtagttattttgaaatatataataaattattatctgttattgccctattgtgctaccaaacattagatcttatttcttccatcgaaccctattttggtacccattaaccaaccctctttatccccacctcactacccttctcagccttctctggtaaccatcattctactctctacctccataaaatcaaaatgttagctcccacatatgactgaaaaaatacaacacgtgtctctctgttcttggcttatttcatttaacacaatgttcaacagcatccatgttgctgcaaataacaggatttcattcttctttgtggctgaaaaatattccattatgtatatgtaccacatttgctttatccattcattgatggacatttaggttgattccataccttggctattgtgaatacagttgcaataaacatgggagtgtagatatgtctttgatatactgatttcctttcttttgaatatatactcagcagtatgatactagctgtgcatctgctgtataaggtctttatcatgctgaggtatgtttcttctgtacccagtttgttgagagtttttatcatgaagggatgttgaaagagtttttatcatgaagggatgttgttgaggcctcgctctgccattttctagtgatattactctgggttagtcatatcatcttttacgatctatttcacctgctgcttatagcaagctcaagtttttgcctgaggttcaatgacacagggcatctaaaaacactttgcaatctctgccatactatacaaatgctaactatggttatgttctgaaagtggtaaaaatagattttatgtacagtaaagtataccattatggtaatgggggagatattttacttatattgggctctttctctccctcaaaatactttttatctttttctttcaataaaagaattgtataaaataatggtgagatcgatggggaaattcttttcaatgaaaaaattaggctggatttggaaaaggtaaatattttagcatttaacactaatctcaatatatttactgggaaataagcaatgtgaatgtttagtgcattttttcatcctctgaacacttattcttatgcctctaccactgactgccatattcaaagtcctgtggtaccataaaacatttccttcttatccccatcataataaaaatatccacctttctttctgattaaactaaggagcttctgcacagcagaagaaactatcaaaagacaacctactgaatggtagaaaatttttacaaactatgaatctgacaaagacctaatatccagcctctataaggaacttaaacaaatttacaagaaaaaatacaacctcattaaaaagtggacaaagtttatgaacagacacttttaaaagaaaacatacatgaagccaacaagcatatgaaaaaaaggtcgacattactgaccattagagaaatgcaaatcaaaaccacaatgagatactgtctcaccacctcagtcagaatggctatatatcaaaatgtcaaaaaataaaaggtgccggtgaggttacagaggaaagagaacacttatactactggtgggagtgtaaattagttcaatcatggtgtagtacagtgcagcaattcctcaaagacctaaaaacagaactaccatctcacctagcaattccattactgggtatatacccaaagggatgtaaattgttctactataaagatatatgcacgtgtatattcattgtagcactattcacaatagcaaagacatggaatcaacttaaatgcccactgatgataaactggataaagtaaatttggcacatatatatcatggaataatatgcagccatgaaaaagaatgagatcatgtcctttgcaggaacatggatggagctggaggccgttatccttagcaaactaacacaggaacaaaaaactaaataccacatgccctcacttataagtaagagcttaatgatgagaactcttggacacagagagggaaaccacagacactggggcccattggaggatggagggtgggaggagggagaggatcagtaataacaaccaacgggtactaggcttaatactccgacgatgaaatattctgtacaacaaatgcccatgacacaagtttacatatataacgaacctacacatgtacccctgaacttaaaataaaagttaaaaaccaaaatcaaaatcttcatccttgagtggtttgtagcagtcatcttggtgaaaatttaatatctgatttaattaattccagagtcgaggtatcccaggaaacatattcttgccttttcttttcttctattattcccgtctctttttttcaggagtttatttaactaaaccaattactcaaaaccataagaattgtgaggacgaacccaattttttgagtgaggaaagaaggaacatcctaaactaggaagcatacacctattctctaactaggaaacttcacaatcctttaaagaagaattcctggagtaaactacattgcacagttgaaactatcagacagggatgttaaagtaattgtatttaatgtattaaaggtctagtggtaaaggtaaaaaaaatggatgaatagatggggtatttcaaccaaaagtaagaaattattttaagaacagccaaatggaaatatacctaatatcacaatgtcagaaattaataattccttagatggaattatcagggcattacacacacctaaagaaacaatcatagacctagagggcaggcaatagaaattatctgagctggaacacaaacagggaaaacaaagaaagaaaacaaaaggagaatccaagatatgtgaaacaataccacacagtctatcacatgtgcaacaggtgactcaaaaggagaaaagagagagagcgaggcaaataaatacttgaagggataatagccaagaatgttcttcagaaaattagtgaacaatgttaaatcatagatctaagaagcttacagaacttgaaaaatcagatgaactttttaaaaacgtagatgaatcatgattacattgctaaaaaaaaaaaagaaaaagaaagaaagaaaaaaggaagcttttgaaggcagctaggaaaaaaaaaagaaatgttatatggaaatgaaaaagacagaaatgatatcagactcctttttcaaaaatatgcaagcccaaacataaaagaaggctttaaagcactaaaataaaacctgtcaactcaaaattctatacctggcaaaaatatcattcaaaaatggtagtgagataaaggacttttcagacaatagtttaaagacctcattgccatttaaactgcactaccagaaatgttagattaaatactatctttttcatgcagaaggaatgtggatctacacaaaggaattaagactgccagtaatcgttaaaataaaggtagatgtaaatgtccttttttcccaaaaaaatgttagtttaaaagaatttgactttctgaagagtaactatatattgtgaggtttacaatatatgtattaattaactatatggcaacaatagcccagaggataaaataaggaaattgaggtatatggttacaatgttcatatactatatgtgaggtggcacaatattatttgaaagtaaactgtggtaaattaaagatgtacaggcataccttgttttatagctttgttttatcatgctttgcagacactgtgttctttacaaattgaaggtttgtggcaaaacggcatcaagaaagtccatcagtgaagccatttttccaacagcatgtactgtctctttctcagtattttttaatgaaagcatttataattaagtatttttaaatttaggtgtacacatcttttagacataatgccattgcacattatagtataaacataactttaatatgcactgggaaacaaaaacatttgtgtggcactctttattgtaaaatttttatgattttgatgaaccagaacaaataatgcaatagctccaaggtatgcctgtatattatcaacctttagcaacctttatattgtcaatattcatatatatagaatggtaataaagctatgtaattaataagccaatggtagaaataaaaagggattatacatactactcactattttttaaaaggtctgaaagggaaaaaaagaccaaagtcctagatgaggtgaaaagatacaattattaaaatggcagactgaaatccagctatgtcaattattacattaagagtaaacggtctaaacaggctgaatgaaaggcagacattgctggattgtctaaaacagcagatccaactacatgttgtaagagtaaaaactttatgaagacataaataaaagtattggagaggaaaaaaatgtgtgtatgcatatatatgtgtatatatatacgtgtgtatatgtatatttgtgtgtatacacatatatatacacacacacaaatatacatatacccacaaatatatatgcatattcatatatatgtacatatacacaaatatgtacacagaaataatatatgcaaacacacaaatatacatatacacacatatatatacacatatacatatatatctatatatatacacaaatatacatatacacacatacccaacactaatcaaatgaagactggagtggtgccatgaacatcatactaagtaatcttttgaagagaaaagatatactggggatatcttttgaaaagaaaatgttatcagggataaagaagaacattgcctaatgataaagaaatcaatttatcaaaaaaattaatggtaagtatatgtacattacacactccaatgtacgtaaaacaaaaactgatggaactgaaatgaaaggataaagagagaaatctacaattctagttggagacttaaactatcatctctcagtaattgacagactacatggatataagatcagtaagagtatagaaactttcaacaatactatcagccatattgacctagttgagatatacagaatcctctacccaagaacaacagcaaatactttactttcaagtattcatgaaacattcaacccaaatgaaaaatatgctaggccataaaacaaatctcattccataacaaaaggattgaaatcatatcctctcttgccacagtggaatctgatcaatagctgaatgtgttttatttgggaaactagtatattccactatattctgccgagaaatttggggatatcaggaagaaggacatacagacactaataaatatgaaataaagtttattactcagatagtaaatggcaaaagtattctccaagaaaagggatcagattccttctgtagtaaaacaaccatgagaagaatagatgaccccagcttattttggattaagaggtgaaaccaggtagggatctacatggtttgaacttctccgccaatgccaagggagggagctcctgagcttttttgtaaatcagttttccagatgtgaggcaaaaggtaaagagggaggggtggagctttaaagctgtcagtgatcaaacatcaaaataggaatcagtctttattatagaaagatatctggataattcttacatatttataagctgaacaatatgatagctcaatgtgaactatccagacagttcataatataactaatgtgttataatttacttgagaagatagaggatgaggtgaggtccttcaagtaagttaagtcttaacctaacacaaatactactcatgagatatagtctaaaatcaataaatcataatacattatagataattataatttgtatcataatacatataacactatatacatatgaaactatatacacatatataacatatatacatacattataaacatatgcatataatttagaaatatagagattgccaccagaagatatagctggcaaggttacaaagtgatttcagttgtcaagtgggactgagcacttcaggattttcaccttaatagaggtgtattttttaacaaaaaaacaactaggccaaattaaaagaaaaacaaaaacgaaaccaaataataagcaaactttctttccttgctctactcttcactatgagacgttaagagattcactttaactctgagtcacatgttcttaccttagtaagaacaaaattgagttgaataatgttccccaagggatgtccctgggtcacaactgttatacacgaaaagggttctgatgtggagcttggacttcagttttagttaaattaaacaattaaaacaattttgttttttactttaggatgtcttcaagtcacccaagcagtttctactgtgaatctttgagagggagattgcaaggggccatcaaaagtcattccaagtcaaaccaaggtaaaacctgatgacagtgatgggatttttctcagcaaatggtcttgggtctgctagaatatacaaatgaataaacattcaaggtccaaaagtttcttttacatttggctataggttgaaagcatgagatgtttatgaagtaaacacccaacatggccaaagtgaaatgtcagtaagacaactacagaaatgtgatctttgagataactttctaattcaccctctaagctattcataaaatgtatagctaaaacatgtatactaggatttgagtttttctcattcataagaccacttgcatctgttgcatgatatcttctattaattttaataagtatcagcaaagcaaaacatttcttcaaatcttgcattcatctggtttttctcaactctaactacaaaacttagggtttcttatcttttcattcatatgtgataccttttatatatttttttcttcatgaatttttcttcatttgcatttcttcttctcataaaaactatccttgagctcggtgcagtggctcatgcctctaatcctaacactttgagaggccaaggtgggaggatcacttgagcccgggagtttgaaatcagcctgggtgggcaacacggaaagagcccatcctacaaaaaatttaaaaaattagccaggcatcgtggtatgcacctgtagtcccagttaccaggaaggctgaggtgggaggattgcttgagcccagaaggtggaggctgcagtgagctatgatcacaccactgcactacagcctgggtgacagagcgaggccccatctcaaaaaaaaaaaaaaaagaaaagcaaaaaaattctttgatattttcagtaacaatattgtagttttcagttacaattcttttaagtttttctcaaaaaattctcaattgcttattttctcttttaggagataagctgttattttaactctgtctttattatctaaggcacttccaaatctgtttcttttgtctgcttttcactgtcatccaggatgtcttgtattctttgtacctgattcctttctttgtactcgacattatatttgcaaaattgttgtagaaaattatttgagagctaccacatcaccttcctttagagaggaattaggctgcttttgtctggtacttggatgcactaactatctgggatcacttcaattcaattccaaagattaaaatgattcatacctgagctgtagtccttgaaaaggtctatctattcctagttcttttttttttttttccaaaggtgtaattttcggcccctcactaaaggtaaaggatgcttagcagaaccactgcttttgatgggacctggactctaaaccctattaccctagttctgtgagactgtcagtagcaaaattcagctgcctgtcaactgccccgggattatcaataatctagggggaaaatagcccaagtgctagaatttgccaatcttggttttgttctcttcttgaatcctgggctggtatttcttcattaacactctgatgcctttttaaatagaaggcctttgtttgtattgtttaatccagtttttcaagttgtcctcagcagaggactgtcttttatccagtgttttgttatttacaaatattagaaataatacaaatattacaattacaataatactaatattacaaagaatatttatgttacttataaatattatttatgttacttataaatattatttatgttattattactaccactgtaattcatgcattaatcatctactgaactaagtctctaactggctttcaaggcttctgggctctattattactcccttgcatcaaacctgtctccacactgctcccagggtgatagtctaacacaaaaatccaataatgtcacttagatgttttaaattatttaaaaacttcactgcatacagataacattatgtagaaaaaataaagtggttatgaactttatagcaaaataaaccttatttcgaatcctcactctaacaacagctgcatgagtttggacaagctacttaagttctaagcttcaattttctaatctctaaagcaagcatggtattaacacctaacataaaaaagtgttttgaagattaagtaagaagtaaagtactaactatggagagtattaagaagataattctcttcttgttatagcattgcatgagttcaatagacattagaagttttcttttctctgaactacctctgacagtgcaaacattccataatttgtcttccttccattcctttccacatattattttatcctttaactaggagagaatccagaggaaaaatagaaataagtgtggtttctcccatattccacagtagttagagggccaaacactctttcctactgcaaaagaagctattcagagggcctctacccatgaccacttctttagattacagatggagaatcgatccacagaaaatatgataatactgaaatttgcttgatttttcttcatgggaatccatattccacatggttaaatgggattaagtaaatataggctattctccaacaaaaaagtagtggttacaataagacagagcaagaattcaagtttaaatcaagaaaaaatgtctgaggcctctatcaagggagaaacatactgatggcattttaacaaaagaggaaaaactcaatgtaggatgcaaatgatatacaagggagacacaaattaactgtttgaatgaattttaactactttagaaggaataaaattgccctcttagttctgataattttctgtcaccctagagaaaaataaaatgtgatttccaaaatagcagaaagagcaactctccttctaaaaacagaaaaatagaaatgatcagctggctgccaattgtatgttgttaaattaaattatattataaatgtatacattttctatataacatgatatatacaaccaaaaaaggaactattaaaatttatatctaaagtaatgtcatctcttagaaaatttctatcaaatgcacaacttcctaaagtgtctacatgattagcatcatgttaactctctttatttttcagattttcgggacccctttgttatctgattcttcaaatgagtcatccttctttaccccatttacaatcagggtatatttggaatttaaataactgtaaaaataagagaataagatataaaggacacataaagatataaaggtgacctttaaacttaattttaccatactgaagttgacaaagtagttgatgatttttaaatgtggcaatatagcctaaacatgttaaatacaattttccaaaaaatgacaattacaaatacattagatagtctaggaagaaagctgtagttgtttgatgctgtgagtaccatacactgactgagatggatatgcacttacttggctaatgagttcaccttcaaactctgaatgctcaaatggaaataaatcaccaggcaactacatcaccagccacagaaaagtaaaatgaattaataaattacaaacctaaaacatattacacactatcaaaataccgtatttcatcttatctaaagatgccatcagttacaagatgcactgttatctgatttaccatcaacaattttttttaaacactggcaattcacatggaacatactattgattccaagatacatcctgatttgagatatgaaatgtaaaaaaatcatatctttgaaaattaaaatgtagcattcttttatttattggctcttactcttgcctgttgtaacaaaaggaattctcagtctcaatcctagaatgcctgatatcttcaaaatccatttaggcacaagctgactttccaaacgcagacacacaattccacagtgccttggtcttcatagcaaagttgggggcactggggatacagttaaaaagcagaaaaataaaaattaaaaaaatttttgacctttggaaacctgtgtgcctgtgtgtgtgtgtgtgtgtgtgtgttgtacctacttaattctggcagtaaactttcctcttctctgtgttcctatggtaactttaactcttgtaaattgtgctgattgctaatgtcattgaagattatttttcctattgtctttccttcttcccacttcacaccccatagagtatatgtctgatccacatctgaaaggactgaactatcaatcctccagagagaaaaaagcagttacaaagcttccagccaagcattttccggtaaaaatcagaacaaaggagtgatctcttctacttcactaagttccagtaatattacatcaagatatagaagggatcactccactgattgcagcccccaaaactgtgctctagcaaaaacatattactgaacaaatactatttttacacccattcacaactcctttgctcccagaaaagacaaaatgtcctattaaaagctgtaagatgtctctttgagtgcagtaattatctaatcgcaaagcatttctgaaggacaaactgtacatattgttcttagaaataactaagacatagccacttccagtagtcagtggcagatatagatttagtaaataagaggggcttacagtgattgcctggtttttgtgttgggcagcctatagagacttttcttgaatctacatcttggtgaccctttacagaagactgaaaatctatttgttttacatcaaagaatttgaagtcagtggtgtaagtcatggagatcatgtggggaactgaagactagcccaaactttacctcagggctcaccactctctagactgataatgatatcaaaaaatacatcttgaactctcagcacagacacagcaaagcacatttcatttctccatgggtgtcaaagcacccatggagtccaatgtattcctatgaagatgtacatatccagatagatttggataaaatttagtaatatattttccctggagaaaaaaaagaatattcaagaaaaatcttctctcacaaattctaaaacccaaattattaaatatatgattttatttctaaaactttagttcttcttattcatttttcctttaaagtgccttttgagtacccaaaggtcaatattttttaatttacttttaatttaaaattaatcaatcatataggtctgcagggcaacacaacagtaatttcagcatgaataacagtattatacatatgtgacatatattttactcctaaatgacattaataatgataaattttatatcacattgatttttcgcctctacacagcagaaacagcatcatagatcatgattctattgttgctgcagggattcggccttgcagagtgggcaaaaactagaacacactgcaggtgggaaattgtaaggaaaaagttctgcatatattaaatataatacggagctcttgactctgctcaattatgtcttgctggaagtcaaaaaagttagtactcatgccaagtacttagactgcgatgctaaatcatcaagtaacatgataactatgacttttccatttcctttgttataggtaccacagcggaatattaacagtagccttacatgtgttcacgttcttacattgcctagcacattaaccaatttctaggtaaaaaaataataaaaccaaaattaaggccattgtttctttttctcaaaactataaaagttactgatttgtgctccttagttttacaaagcaatttatttggaatttttcataggtaatccaaagaaatccaatttacacattccctgaaaggtaaagttcccatatgactagaatcctttctattaatgcaaaggacaagtgtgtagagatgtctcattaattgatttttcctggaatgttaagaattcatcaatttatatatacagatcttgcttcaaatcagaagaaatgaaatgttctgtttagtatttgaaaattgcttctatttgtaacttttggcctactgtagaaatatcattatttggttttgttagttctttgttttgtcttccacatccttttactccttctcagtttttacactatttatggtttttctacaccttcttaaagagctcctcatttttgccactgtgtagattaaagaagtatcaattctgcttcttatgacagaaaatgcccatttcaatcttgttatttttaagagtatcttaacatttttaaaccttaataatattcatggtaaaatgtagaagtgcagaatgtgataaagtgaaatattattttctctgaaatctaatttgcattcacaagaagtacaccctgttaacattttccttcatacaatgtttactatgcctatatgacatgaatgtctattagtgtgcatatacagatgaatttaaaatgtatagccttgggtttgtagaatggctttcttcattttcctattcctaaactaaatttggtcctagaataaaaagccagcaggatacttactgctgaaaactggaaacgtttccattttagtgtgggacaaaaaaaaatattatttgtcatcagattatttgattgtgagatacttaaaaacttttaggttttttccaatctttttctatcataatattgcttcaaggagtgctgtttcacatatgccattttgtaaacatgggaatgaaatttctcttcctattgatatgaggtcttttgctctaaaatactatttgtacatatataaaaatgatactatatataggtgtatatatatacgtgtatatgattatattatatgtaatgtatacacttaaattatatatgcacattatcgtgtatatgatattatacacacatatataagttgcattatatatgtatttatgtattgtaatgatacgggaggtgagcagggaagcgctggatagagaaaggcagggtccctggtgaaggctccaccttcgggcctgtgcccatggacctatgtgaggagaggcactcctgttttcacacccaactgttgcatttttcaagaccactctggccagccaccctgcatccccattcctgtgcctataaaaaccacccagagaccctagtgggcacacacacacaaacagctggacattgagaggaacacaccagcagaagaacacaccaacagacaccgccagcaggaaccacatggatgccaaggaaaattcagccaagggcagtgggaggagagccaggccgctgaatgagcggctcacgcaggggaagaccaccttcccactccatccccctcctggctcccgatccgtctgctgagagccacttccaccactcaataaaaccttgcactcgttctccaagcccacgtgtgatctgatttttctggtacactagggcaagaaccccaggatacagaaagccctctgtccttggaataaggcagaaggtctaattgagctaattaacacaagccacctgtgttaaggctaagctgaaagagcgcactgtaatacgagcccactggggctttgagagctgtaaacactcaaccctaaacgctgcagtggggttgaagcccgcgctccccacgacctgcccttgcgcatgcttcccctaggggttctttgctgtggggcaccgaagaagcgagccactcctcctgtcacatgccctgggagggggataaaggaaaacttttcctgttttaataatttccatctatttcttttgtacccagccacttatttagttttgatattattgatattgttggtttttttctttttggccttttccttcatcatcactattattttctattgttccagaaatgtagatgatataataataattataaaagttaagaagaagtaaaattagcaattatcacagagagtatattgttatttacctattaaaaacattttttgagattttaatttctaaaatttccctcccattcatataagtaatttatagagctttgaatgtatagccttaattatcttgccctctatgattgacagattaacagagatgcagagatgtccaagtttaaatctctagaacccacgaatatattagaacggcatggcaaagaggaattaaggtggcagagataattaaagttaactgacttttgagatgaggagcttatactgggattaacagggcaggcccagtgtaaccacaaggggcgttataagtgaaaggggacagaaaggtgaaaacattagagagatggcagcaggacaaagactcagtcatatgctgggtttgatgatggagaaagggggccatgagccaaggaatgtgggtggcctgtgtaagaaggaaaaggaacggatcctccctagggtctccagaaggaatgcagcactgctgactccttaattatagcccagaaagacctatttcagatttatgacttcatgaactttaagataataaatttgtgttgttttaaatttgtggtaatttgttagagcggcaacacaaaactaacataccctctaaacctaacctttctgttccaatatgctatttcccttatatttatccttaaacaactataaaatctttccaaacacaagatttgtcaaaatggggagcatgtgattactatgctcccattcaagaaccacttggacgtttttcaaatctcttccttgcagatacggttggacagtaggatttctataacaacttccagcctctaaacagccatctatgtgttgtaaataagatttcttcctagcatttactaaatattatgaacttgatttcttcctagcatttactaaatattatgaacttgatttcttcctagcatttactaaatattatgaacttggagaaaaattaaaatctactcttctgtctgccaccaggattcttcctgtatccactctgttttatgagactaattatgtggagaaagtatgctgcatagttttaatttgtcactttcatacccattagttttttagagccgtacccacctaatgaatctaacatgcgatatatggggtctggtgcccaataaattaaatatattcatatgtatttttttcgtacaaggatggctactctgctttttttgtttgctaaagaccctgcagttttggtgaggtgcacacagcaaaggagaaactaagtaaatttctacctactttgaagttggcacagtactgctgacctaccaatttcactttcagtttcattctactggcgttggagttagtggaaatttccctagataccatttgaaacgggaagcctgtcttcaattctcagtaaacaatctcttcggcagtggctctttgaccttttgtctgcttatcttattaccagacaaatttgcgctgcccttttaaaaccatcttctaataacaaaactaagtactacaactagctcacaagggtaaaatcacaaatcagatttgtttagcagcagtgtccttgaaatgggtaaatttccactgtgaaagaaactctttgtccccatcaagatcctttttacattttgattaataccttacctaaatatccagaacaaaggcagaagtgaagacgtccgtgaatgcttgcgtaagtaccaggagatctggaacatctattaattatttttcaccattctgccatttccaggactcgaagtcagcagaattgactgaaatagtcttctaagtccaatccaaatatgtctaataatgaaaggctttgtaaggatatggctaaggtgatgccaatctagggatggatttcatgaacatgagtccgagaactgatcaggaaatgaaagattaaccagaggttaaaatgtgcacatagaacgattatctgggatgtcaatccagatggctatcaagcaaaaagttccaaaaattgacagtaatagagttgcaaagagacaatttattagcatcaggaatctggggtttcaacacagggaggtggataaccagagtgcacaccaggaatcaagaaaccagagcatcagaggtagaggggcttcaacacaattctgactccaggctctttcagagagcaatttatctgggatcgaaattgatctagatgaaggggttgtactatatttacaggtgaaggctaatttggcatttagaaaaatatggaagtcagcagccagagtcaataaacatcctcatctttcaactattaaccacctctactgagtgactacataatatattttcaaattcttgcacaggcatgcccaatctgatacattgatcttttgagatattacattttattttgctttgtaaatttatctcatacctgtctactcttttcagttcaattaggtagccagacttcttaaatttcttgaatcagagattttggaagcaataagattaagaaaagatcaaagatgcctttctttcacaaaagcctaaccaaaatgaagagactgataggagacctgggcagaagggagcagagagaatatctgtgcagcagataccagtttccaccaaatagggaaaagagagagtcttcaatctttggaccagaggctggtgcactaactagtccaaggcagtgtctgatgaggtattcagacctcagagagatgtttcttagtttaccaggaatgcaggacccccaaaatgatacagaagcagaactgtaaaagctcaagaaaccactacattatgaacagtgcagctgcattagggttcaccagagaaagagaaccaataggatatctgcatatataataggacattaattataggaactggctcaagtgattatggagccaagaagtcccatgatctaccatctgtaaactggaaaaccaggaaagccggtggtgtaattcagcctggatccagagggtggagaagcaggagctcctatcccatgtccaagggcaggagaatatggacactgcagctcaaacagaaaaagcgaattctcccttcctttgcctttttcttctattcaggttctcagtggattgggtgattctgaatacctcaatgatttattaaaggaaatctattttgaaagatactgagaagcttacaatatcaaagaaaaactggaatgatcaggcctttaaaaaaatatggaatcagccaggcatggtagctcacacctttaatcccagctctttgggaggccgatgcaggaggattgcttgagcccaggagtgcgagaccagcctggacaatatagcaagaccctgtctctataaaaataaaatttaaaaataaaaaataaaatctagaatcaaggccagctcttctctctatagcaggaactcatgaaccttgagtattctcaagatagcatagcacccaacagattcatatgctttgtaacctctgtctatcactcataacttcaggagaaagtctgataggttccactgagaccatattcccacctatgtctaagactggaaggtgggcttactggcaggcactaccagtaatgctcattgtatctccttcggcttggctccttagttgacatatatcttgtgctcaaagaattaatgttgaatttaaatattctaaatggccagtttttaatgaaggcacatgctggtaagcagtacagctattcttataatcctagacttttgttctttcctatttattttcacatttttctatgctcccgtttttgtcagaaatctgttggaacagttattatctctatttcttccatggtgtctaaaactagagagctatttttccctctgcaatgtctttttttttcctctctttgccatgcttcagtgtaacttgtcagtccttcatgttatgtactagaggaattgctgtctcaccagaaaaagtcgctgaaagaaactgcttctgagcttgaacacaaatcaattcctttcatctcattcttgctaagttgaatattgatctgtgtcaaagcaatatgcatgactttttcattaatatttaattgttattttatatgacttcaagcaaagagacatctccatggttcattgattcatccattcttttggccaaatgccaaatagcctgtctccaagaaaatgtatctgcccttttcaaatgagactctttgaagaccaattcaattcaatcaaataattaggctatcacatcatgttattatcctactaaaaagtatagttgagaacagtacatattctaaagtagcagtgatagaaaaccttatgttacatgtaaaaattacacatgaatgaatttttggcgaatacaaaacggaaaaatggaacagaatataaatataacaaatctgcatataaaattcagaattaatgcgctagttacacccagattaaaatgaattactttatgtacaatttcattgtaaaaggaaccaacgctccatggttgattgggagactggaacagagattgtacaaggtacacttgtgcaatgagcctggaacttcttgtggtaccaaaaaaaaaaaaaaaaaaagaagtgctaaaatttttaaatagaaataaaaaggataagagcacatcaaagtgacacagttgccaaatcttcccacggtcagagctggaccaatcaaacaataaaagaaataacacattatggattataagtgtcacactggattgaagtatccataagcccttaataataaaaaatagctaaaaagaaagaggcaactcttctttatggaataattccaattaataactatagaagaaatgtgggaaatagaaaaccaactttaaaacaccacagtaataatttctgctggcaagattcaatgctgtatgctacagtgggtagcaaaatttcaagaacaggatagtggcctagattcaaatatcgcccttttttttttaattcttgttgtgattttaatatacactcatgaagtttttggtaattctctctttaggggggtggaacttaatttgtctctccttgagtgtggaattacttttcttaatgactcactttcaacaaagagagtatagaaagggaacaacagtaacttcacagtagagaaactggcagacatcactgtaataaagtgattttaaggttagcatcaccaacaataagtcatgttgatatcatgctactcttgaaattataaggacacatcacctttgtagcattctcccaaaatatagaaactcaactaattatgagaaaacatcagacaagccccaaatgaaggacattctacaaaatttctgaccagtactcttcaaaaagatcaagattataaaaaaacacataaagactgagaaagattgggagagacaaaatagacgtgacaactaaatgcagagtggtgtcccagattggatccttaaacaaaaaagagacattgatgtaaaaatttatgaaatccacacaaagtctatagtttagccaatagtatcatattatttagttttgaaaattataccatgattacgtaacatgctaacattagagaaaactgagtgaagggcatataggaataatcagtactatctttggaactttcctgtaagtcacaaaacaaagagttccaacaattaaggtgaggtcaagacaagaacatttgtcataagtagtctcacaccagagaaaaaggacaaaactttagaaaggactaaagagaaccagaaaggtcaaatatgagagtaaatataaaataatcttaagtgcttagaccagcagtataaatgtcttggaggttgataagatatattgaagtaccatatatgaaaatagctcaaaggtaggggtacaggtaaaagaaattactgtttgaagtttcttgtatggaaagttgtaaaatcattaaggcaaattataaaaagaaaaaatgcatattgtaatctctaggcgaccaataaatgaatttttaaaacatagtgataaaatgctgataaaagaggtaagtcgtttttttctttatcttaatgaacccaaaagaaggaatggaaaagtaacaataggaccaaagaaaagattgtaaaattggaaacaaaaagaaaggtggcagaactaagctcaaatgcatctgtaattggaataaatgtaaatgaattacacacctcaattaaaaggtgtgtaaattttcaaaagagttctgaaaaaggcccaatctatgctgtttacactttagatataaggacacaggaagtccttacgtcggaagaaaaagtatgggaaaaggaatacctaacgtattcctttaggtaacgtgaaaacgttacctaaacatggtgtggctacattaatatcagacaaaataggtttaaagaggaaaaatattattagagaaagtgaatttcataatgattaaggtccaattcatcataaagaaataataatcctgaatctgtaagtatttaataacatgggcttcaaaatagaaattgatggacctaagaggagtaatttaaaaattcttaacctgagtttggagtttgaacacatctctgtcagtaactaacagaacaacaaaataaaacattagtgaagctatgaaatatttaaacattttttgctaaccctttctcattcatatttatagagcactacccctttaatgggacatagaacatttacaaaagaaaaggaacagaaggaagaggagggaaaaacactggaagaaagataagaagaaaaagagaaaggagagaagaaagagaaaagggggaaagcaagcagagaattaagtcagaggagtattaaaaacattaactttatcactgataaaattagtctacagaacataccttgaactgtggctagaaataagcttccaaataatttatccccacaagtaaatttaccctgtggtcacaatcagaatacatgggcaatggtatattgtcaccttagagagacagagatgcctcagtgttgtaggaaggagtgaggaacacagtgtgctccagacaaggtggtccacaataagggagaaagaatttgtgtcacgtgtatataaaccaaccacttttcctagtttcagatcgatgggtaaaaagaagcgtggacccttctctccaaagatacaaacaatagacatttgtatttaagagtcgcagggtgtggtgcactggctcatacctgtattcccagcactttgggaggccaaggtgggtgaaccacttgagcccaggagtttgagaccagcctgggcatcatagtgagaccccatcactacaaaaaattaaaaaataggtgggcatggtggtgtgtgcctatagtcccagccactcaggaggctgaggctggacctgaacccaggaggttgagactgcattgaaccagaaactcataaaactcatgaaaaacaaaagagtgattactactgatcacatgaaagaaagagtatctgatttcaagcattagagtttgatagttcctccgcagattccatcaaagaagtaatcactggaattaagagagaatccactaagggcttgcaaccctgcagtatgttggtttatgaagcgctcatattatggcaggatgcggtggctcatgcctgtaatcccagcactttgggaggcctaggtgggtggatcacctaaggttgggagtttgagaccagcctgaccaacatggagaaaccccgtctctactgaaaatacaaaattagccgggtatggtggcacatgcctgtaatcccagccactcgggaggctgaggcaggaaaatcacttgaacccaggaggcagggttgcagtgagttgagatcgtgccactgcactccagcctgggcaacaacagcgaaagtctgtttcaaaaaaaaaaagcgctcatattcaaactccgttcagccataaacaggaaaaaggattcagccagctcatgagctaagtgaacaagtcaagtgtgatctacaaattttctaaaacctcaacagcaaatttggggcccaataaaatctctcctgtccctaagagaagtgagcatttatatctactttttaaagcatataaaggagtcatattgaaaagcagacataaaaatgctttaacataaaataaaaagaaacttaaaataaaatgtcagcttgctctcctgtgagaagatgcaaaagacatgctaatagacaagaacagaaaagcatgtagaggaataaagcttgtttattatttttttaagtgaaaataacagttaaagtcgcaagatagcctaaagtatttttatggcaatttataaattcaattccccctacagctctatgaaactgttattactcctctcccagttttgcagatatgaaaactgagaaacaaaagatttaggtaacttgtccttaattgtacaaaagtgaattcgtagaactgggatttgaaccaagagattctggctccagaagcctcatactgaacaccagagcactgtttccatcagggaaatacaaacacaaatagacataattatggagttgaggttcatgaaagatttccaagaaactaaaatgtccaaagcaaaattaaaattcacagtagagttagtttaaaactgaaactccatacaattaaggaaccagtaacctttttcagcgtttactaagtgtcaagcattgttctatttgctttgattcattaatttatatgatcctcccaatagcaatagtagatattactattatccttattttatatagaggatcaccatgttatgcataaatacgatgtaaatattattgaatttctggaacgtgacagataagattttctcatttcatgatcatgaattggatttgcttaattttctcaaaatattgttttatatttcaattatatttctagctttttagcttattttcacattattttgccctattactccaaatcacagtctcaagaaaaacatatgtatagaatatatttataaatggaatattctttaaaatcaaactattctgacatttcttcaaaaatggaggggaggttcatggttgcaacatcaatttcacatcctgtaaaaattgagtaagttattgaattcaatctaagcaaggttgaaacaatcactcgtttttggtacaagaaacactgttttgtgatttttctaagaagagttaactactctttagcataataaataaatgtatgaataattggtggccaaatttcctgtgatttaggatccatttatcaggagaccaaggctacagtgagtatatttctaaaggtattttccatccaaatccctccaaataatttgctcaagtattttttttttttgaggggggaacggggggatttatttgattattctctaaaaacttacttttattttgagactgtgattattggaaaattccaacaaatatgcaatttgtacaaaagtaggtaattcattcccttaaatggaaagctataaaaaattacaaatatttattatgagataaccaactccagacaggggaacccaagaaaatattctgatgtttccaaggaaagccatgtttgaaaaccagaagctttagctcccttattcaaagacactatcctgaaaagtatatgtttaatcctacattgtttattttttcagtaaatgatctacatttttgtcaaaatacggttaagaaatgtgcatttattatatgtctgtctgtcaataaagattgtctatttcaaaacaaagccaaaattgaaaatgatgtgtagcttactctgtttcaggcatttgtctgaatagtttcctaatatttatcccttttatttagcaaaactcttttgaaaattaggagtatatctattgttacagacaatacaaaagcaagttaacttgcttaaaattcatatagataaatgacaaaacatagtgttctttgtacctatttgtgtattcattacttcctttactacttgattaaaatgtccacattgggtcctgtttagctgtctctctggcatgcagaggattagaatgaatctcaaccaaagcagatttctgatcataaaaaccatatgtagctttggccttaattaaattaattataaacaatttcattttccttttcaggacaagatagttatggagtaatcctcacaactgctatctcaataattgattaacatgaggaatttttttctaatccacattctattgtttgccacttaagagtgctgtgttcacatataaacatgaaatacctccttcactggccatagaaatgacattgtaaccacacctgaaggaagtattcttttttccatgtgaaatcctacctcaaatattaattaatgttgatgcattcttcacttttattttgccactaatttatactttagctttttgaaagtcttgaatagaaattttgttgttgttttgccttatgcattaggttttatttccactaaagttctattaacaggaggcaagccactgaatggctttagaagtagctttgtgaaagctaacttttcagctgagagaaatctccctggggatattacagagacacagaaactttaatagtattttgttttcctcagcacatccccagattttaacgtgtctgaatttaatgcattagaaacaagcatatgtggtcttaagctaaaatctcttcttgtatctagaaaatctatcacaaaaatactagctactgaatatatttatatataaagagaaaatactaaaacaatgaacaaaggacacaattacagtataatctgcaaagcagaggctcttgctccttgagggcaagtaatagctcatagatatttcccaacatctatcttccccccttagtttgcctttgcagatcagatgctatctgaccacacatggtctgttcaaaatgataaacagtattactcaatgtatcttctctgaaatgctaatgcgttgtcaaaatgctataatagcccctattacatctatttatgaaaatagaccattcaaggaaaagttaatttaaatcatcttgtactctaaaatgtcagtaacagtaatcatgaatggtcagcaacaacaatttatgctgtaaatgtttttagactttttctctaccaaaccagttcactacagcaatgcttatgtaaattatacattctctggaagtttctataatacagattgaaaaaaatgctatgttttaaaattttcttttcggtgctattagactttaagtaaatcctcaaaatggggtgtaatttgggagcagatataaatcagcacacataaataatatgcttaatttgctataccatttgatattaaaaacatcctacttagctggtgagggaataaaatgtattatttttaatttaacctcttttttgatgcagaaatgcacctaaagtttctgcttttgagcatatattaattgaattctaactacataatatatgtaagacacttttaaaacatagaaaatataacagtccatatttctctactcaagtcactcagtcttttgagggtgacagtataaccacatacaacataagacacatttgatgtactgtattatgagaaccatacaactttcatgcaagatagctgactgagcacatacaaggtcctgtcctccattttcaatttaaataatttagtgatatattcatacaatgggctactacattgcagttttaaaaagaaagataaaaactattgatagatgcaccagaaaggatgaagcttacaagcattatgttgagtggaagaagctactcaccaaaaaatgacacaaactatgatttcacatatacaaaattcatgaacagacaaaacttgtctatagtaataaaagtcagaatagaggttacctcattggtgggagtgaagaaaggtagttaatgacatggaagtagcagaacagaacataagagggtgatggagttatataagcttatgtatgtgtaaaaatgccctgaggtttaaattaatgacttgcgtatttacaaccagtatactttcttccctttactatatgtatatgtgttaagcttcaattaatgggttaagaaaagtaaagttttatgtaatacaataaagctgtgatggaagagtgtgttagcctaaatcaaactactttatatgtgaacaggtttctgcaagacataaagaggatacaattgagttcatgaataaattagagcagaggaagttgccatccagaatatgcacaaaataaatgtatgctatacctgaaacggaagctattcaagacagagttctaactgtaagttagttctaagttatgtttttctaatggaaaaatcagtcaaacttcagtccttcttcctgtatttttctccctgacagagccggggctctgtcctcaggggaaaaaaaaaaaaaaaatggagggatatagacaataaaagatccaatttcttatattttgactttcaaaagtgatgattcagaaataagaaaaggtctccaagaatgcttgacttatcacaagtaatgttctcttgcccagaatatatgaaagagaagtagagagtagaaaggaaaggaaagagaactgaaattggtattttaaaaagcgttgaaaaaatattcctttaacaatacaaaaatagttttcaatgaaatacctgaacattcagagtctaggatatttaaatatcaagcatgaaattattctatagatatagcctagaataagactgtccaatagacccttctataatgatggaacagccctacatctgtgctgtccagtagggtaccccttagccacattggctataaagcattttaaaactgattttataactaattttaattaagttaatgtaaatttaaatagttacctatgactaagggctattgttttggacagtgaaggaatagaaaataaatctgagatctagaatatagaatgagatcaaaatataaaatatatgaaagaaacaagaaacagaaaggatgtattgaatactttcagtatttatctaatgagagttacataaagtgaaagtgagaaaatgtataagagaaaataaagcataaaatgaaccagaaaagaaaagagagacactggttatcaatcagtgatagcccttaaatagaagttcttaaccaaaaaaaaggcggggctcatactttcatatgtttcttaaaatttattttgaaatttaaaatttacagctttattgtattgtataaaactttacttttcttaaccccttaattgaagcttaacacatatacatatagtaaagggaagaaagtatactggttgtaaatacacaagtcattaatttaaacctcagggcatttttacacatacgcaagcatgcctaaaatttccaagaaaaaaaatcaaattgactacaattgaatgaacataagaccactgccgtatttctcagctgtaacactttctcctagaacaacaagcagcaatggattcaaacaaatgacagaaaacaaacaagccaaaaaccaacaacaacaaaacaaaaagcattctgaattctatatacccagacatattataaatgaatcataggcataataaagaattttccaaacaagcaagaactcaaagttgacctcctatgaactccttttgaaataattacctcagaacatattctaacaggctttggaagggatatggaaaggaagaggctataaggctactcttcaatcatttcattaccatatctggaggacaattttgagaaagaaagaaggcagatgatctggtcacattgtattgtaaacgtgtaaacaagagactttatggtaaataaaccaatggtacttactaggagaaaaatcctaatctcagaaatcttttgactaaaatgtttctagttagtattgtttatggtaaagaaacctacagtctgtggatttataagaaatggctccctggaaaatatcacatatattttctaactccatggatataaaatgaaacaattaaaatacttgttacttaaaacagatgataaagagatttagggtttgttactaacttaaaaaagttattgcatacggatgtgaaattattccagcacaatttttgaaaagactatcacttgttccatttatttgcctctgcactttggcaaatgtcaattactgtatacgtgtgagtctgtttctggactctcatttcagttacactctatatgcctattcattggccaattccatactgagttactatctctagctttataaaaagtcttgaaataaggcagcatgtgaatgtcaagtttgtttttctaggcaaaacaattttggttattcttgttcatttgccattccacataaattttataatctcttgtgcatttctatgacaaatattgccatgacattgatttggattgtatttactgatttgatcaacttggaatttggacatatttggcatcttaacactactgagtctttcaatacatgaatataatatgcctctccatttatttcagcctttttgatttctttcttcactgttttgtagcctttaccatacacatcttttaaatattttattacatttatacctaagtagctcatctttttccaccatcaatggtggtattcccatttcttactgttcattgtcagtacctaaaaataccattaaatttttaaattgtgatcttgtatcttcagtaactttgttttgtacattctttgaaatcttcttcaaatacaatcatgttgaaagtgaataactacaattgcacatatttttttttctatttgtatgcctagttctttttcttattacactgcctagaacctccagtataatgttaaatgtgggtggtaagaacatttttcttttgccttagagtgagggttcagtcttttatcagtaagtatgatgtttgctgtaggttttctgtagctgtttcttatcatgttgggtaaattccattctacctaaaatttagagtttatcatgaatgaatattgaattttgtaaaattatttttctgtatctatagagaatataatttttttctatatctatagagaatataatgtatgtagggtctgcaacaatgtcctctttttaatttgtgatataataatttgtgtcttcttccttgttggtgagtctcatcataggctttcactgatttttctctgctgctccatttccaattttatttatgttctttattattactttgcagttacttactttggtttaatttacttttttcaagtttcttaaggaggaattttaaatcactgatttaagacttttttcatataaacatgaaatgctatacatttctctttaaattgtgctttatttgcatcccgcaaattttgcatgagagagagattattttcttttattcaattcaaattattttcagatgtcccctatgattttctctttgacctgtgagttattaggttggtaaaaaaaaaattgtggtttttgccatttaaagtgatatttagatgtgtgctcatcagtaaaaatattcggcaattattccagatacctgtttgtgatttctattttaattccattatgatcaaagaatatactatgtacatgtttttaaatgtattgaggtttgaattatggccagaaccacgatatatagactatactatatgttctacatgcacttgaaaattatgtatattctgcttatatttagtgttcaataaaagtcgatttggttggtgaaggctttgataatactgttcacatctgcgaattcattattgatttctagtcaatcaattactatccaatcaattactttgggttctctgaagttattatatctatagtttgataaattattctttaaaattttgtaaccactatctcttcaaatatttcttctgcctcacattctctctctgttttctctaggatttcaatgacacatatatcacactaatgatattttcttacggcatttgagtgttttgtttccttttttcttcactcttttatcatttgacagtttaggtaattactattaactgactttcacatcctctatcactttgcttagctgtgtcaagtctactggtgagcccacccaaggcattcttcatatttcttatcgaggttctcatttctggcactttcctggggctctttcttgtcattttcatttctctgctgaaatctttatctatccatgcatgttgtacatctttgtttacaacctttaacctattaaccatagttattttcaattacctgtctgattgttgcaacatctggatcatctctaagtcttgttcagttcattactttgtctcttgacagtaagggttgtgtgttttgtttttaatttgatttttgtgtctgttaatttttttattaatttccagacatagtgttcagagtggtagagactgataaaagtagtatttatgtgttaggtaaatgtcatttgtcttctgctaggctattattgtgggaaggtgagtaaatttatctcaagagttgagcccaattttcagttttgttcaccactgtctttaaattcctgtttgttcttaggttggagatagtttgctggtgggttttcacgatgtttctgctccactcattagggcttccctgtgccactgcccctcacagggaaattctctagtcatctccagtgttaatctgttgcttctgtcttggaggttgaggcgttacggttgtggacgaggttctctgtcatcctgattcagcctcagtttaagcagtcattgtctccctgagtcttagaatatggattttctcagtgagcttcttccaactcaatggaaggagacctttactggtctgggctcttctgagcacatttcttgcttcgacctatggataaagtatttcctttttttttttttttttccttcccctacctacaatggagacatcttctccttgcactgggccaagagctttctgctattccccagcatcttaaaagtcttttttccttatgtgagaagaaaccaaagatgggttcctgtgtttcctacagcagtggatgcacctcttcttcaggctgcatctccaaagtagtctatattagtacctgccctgccaataaacttttttcatcagcacatagtgaagtctatggagaaaagcctgcaactggctgtcttcatagcttccatactctcacagtatcagagaagcagtctttgaaaattaattaaaagtcactgtgacttctttttattcacttgtatggtggccttctcttactcttatgctcttacacaggtgaatccatgcttgttctctatctgtccgcagaggcacctgtctttcctcagatgccaggctacttgttgtcctgcagcattagctctccaataggttccagaaaaattaggattttgaggaccatctatctttctcttgctagaaggcagatgggtactccttctagatgtctacattcttaggcagaagtcagaagacctgggatttgtgttgttattgtgggcaggtattaaagtcaatcactttaatttttccagtaagcttccagatatgtccacacaagaaaccatgcagatacgttcttcattgttcattcatttagggcccatttccccagatcatacagcaggacctttggttaaagtgcaagagtctgtaaatatccaaacactcgcctgtgaaagtctaacaagcctccctctgctaattccactgctattgcccttgtgcaaacccgaacttgctttcttcttcaaggctttacaaaacggccctgtggcccttattctgtattctcactctagaggatcctttcagtggactaagaagccaccttttccatgactgggagagaatggtaagacccagactacacagtatccttagtgggctctatttttggttctatagtcagcgaagcaactgctaatataaactgtaggctcccctgaagttaccctcttagcatctttctaatatactgtctctaccttgtgaacaagctttgctatgctgcactcctcctatctgaatgtctctctgatatcacccatggcgcaatcagtatttctgtcctcagaattttctgatgcccttcagtagtgggagtggtttgaaccaaccctcagtaacaatctcacttttctctcctgagttgtatatgctaaacaactcagcagttttagccaaacttcaagagaactcactgaatagccctattcaatttctgcaaattcctgcaatctgcatatgtactggttacaacaacttcaaatattatctgagtagatggatcgtaagtgtccagtgaaaatatctgtgccaacacccttggtatatctttaacacttgtttctgcaaaagccccactcaaattcagatttatttttagtgacattacggttcaggccaacaggattaatagataaatatgattcaaccaaaaccccaaaagccctgccagtctctaagtttcctgcctatttccagtatatgagagaaccagtaatttatttctcaaagtagaagaactatctctggtttctcctgtctatatacattcttcagaatttcatgggttggaataaataaattaaattttatttaatttaataaatcccgcttaaattttagcaggatttatcagccagcctctgtttttcatttaggtgcctctcttctttagctcaacctgatctttctctgaagaggcaattctcatactgtcagtgtagtaaactgactttctatcagtgatttttaactccaaatccttcatgagaatatggcaaaatgctagtaaattttaaaatccccatatcaatgcatgaaataaatactgattcactttctacaagaatgcaaattgttactggctgggttcccaaattggaatggctataatagtgctaaattaaattaaatttggcctgaagcaaccttcatacattgaatccctaagaatgaactgcaacctaagagtttatttttgtaagaaatagttgagtctcagccaatcacagccactaagctccaaacaaacacaggctgccaactgatcagaccatgtccatatagggccaatgcctcatcacaagacgcaaattaggcaaacactcaactgtaaccaataaagctgtttctgtatgttacttccttttcctgtctataaaaactgcttgccacatggctggacgaagttccctgaacctcccctggttctgagtgctgtccaatttgtgaatcattctctgctcaaataaagtctactaaatttaatttgtctataaagtttttcttaaagatagcataccatcccccgtgatctgtggtacttcctttatagcctttacaatatcagttacaatgaaggtaatcagaaataccaacctgttcaatccttcatactggtaacctccaggatccatctgtcttaagtactgaccagacaagaatttggaaaagagagttagagggaaccaaaacttctacttcaacaatttccttgatcagaacaacaatctctcattacttcaagagagtctgtatttattgtataccaccaaagatgtctccagtcacattttcccattagcaaatttacccctaccctgctttaaagtgccttacagagtatcatctgtataccccacagcgattactggacaactagtgtccatatctggtgaccctaagaagtttgcatatcacctctacatcacttcatccaaaaaagccattgcaataagcctaaggcttttttttgttttatactgtaagggatattttaattatatggacttttgaattttaattcctagaaattacctttattattattttctgtctagaacttctatatctggatatttgcacttctatggatatttctcagctgttcgatcgtatttgtttccttctaggaatgtgctggtatcccaccttacaaatgatgaattctttcttcagctatattcattctcatatgcaatctattatgcttcttattcagctgttaacttctttgcacctagtgtttctatttgattatttttcattacatcttattcttgtttcctattggtaatatccttcccttgttgcatattttctctatttcaaattctgactcttccattttaatacttatgatatgttgtccaatttacattttttaatttaaggaagatatatttctgaaatgttcaatttaaataagttatatcttagtattttggcatttaataatattattaatttggcttatccctgaagagatagatacgttggctgttaatatgaacaggggaggggcagaagaaggaatctaggtcaatccttagaggtcaaaggtttatgaagggatgggctttcaggtgaagaactcaagttaccacaaaccagaattaaccactccaatttggtttcaccgcaccaagtaacttttcaagtcaacactctacattcaaacaccaaggaaaaggaagactgcctaaattgtcatccatcagccctggaagtttggaggaaaatgaatgaaagagagaaagccaaggctgttgagtcctcatccattagttttcctcaattctccaccctgtcagggattttgcattcccttgattttatccctacagaaggatgggccattggaagtattggccttcaaaggtatgggcaaccattgccaaatcctgcaacaaaaaagaaggcaaaggggaagccaagacagtatttcaactgctcttttctaatttctactttaacagctgagccaaaagccctttgctgtcagctgcagccatctacctgccttgccacataccagttcaaagtagctgtcttttttcctaaggatttctcacatttttatgagtctgcatcgagttttccttctccccccgagtttccctcgggttgatttgctggagagcagcagcagcttgtgctaatttgcagtcttggcataaattggaaactctcctccaagcaggtttatgaacaggaaacagaagacaacatcgctgtaatagaatcaaagtagactactgaatagtcttctgagatatataagatccaaattctggaagaaacctcaaacatctaattgtacatttgactaccctgctggaatatttaactgttaattcctttaacaatatggtctcaagtgaatggactagatagacaattttaaagtgtagaataaactgaagaaaagttttacagtttaaagtttaaattattttaaattttgacttaaaacttgattagaaattatcttaattttaataaagaatgaaaaacaaatttgagaaatcttcaaactgctttccacagtggctgaactaatttacatagccaccaacagtggataagcattaacttttctcaacacccttaccagcatcttttttttctctttttaactttttaataacagacattctgactggtgtgagacagtatctcattgcagttttgatttgtatttctctgatgattagtgatgatgagtatgttttcacgtctgttggccacttgtgtgtcttcttttgagaagtgtgtgtccatgtcctttgcctattttttttaatggaattatttgtttcttgcttgctgaattgagttccttatagattctggatattagacctttgttatatgcagagtttgtacatatttttccccatgctgtaggttgtctgtttatcaatagtttgtttcttttgctgtgtagaagctctttagtttaatcaggtcttacttgtcaatttttggtttagttgcaattgcttctggggacttagccaaaaattctttgccaagaaagcctcagaaaggtatttcagaggctttcttctagaagtttaagagtttgaggtcttacatttaaatcttaaatccatcttgagttaatatctgtatagagtgagctaccatttgacccagtaatcccattgttgtgtatatccccaaatgaaaagaagttattataccaaaaggcacatgaactcatatgttcatctctgtgccaatcacaatagcaaagacatggaatcaacctagatgcccatcaatggtggactgaatttttaaaatgtagtatatatacagtatgaactacaacatagccatagaaaagaatgaaatcctgccctttgcagcaacacgaatggagctggaggtcataatcataagtgaattatcacagaaacagaaacctaaatatggcatgttttcaattataagtgggagctaaacatggagcacagaaggacagaaacatgggaacaacagacactgcagattactagagaggggagggagagagggggacatgggttgataaaattatttgggtattatgctcactacctgggtgcaatatacccatgtgacaaacctaaacatatacccccatatctaaaataaaagttgaattttataaaaataaaaataataaaatatgttaaaaaagaaaaaatagatatcagtactggtaaaccttaaactacagataaattgcaaagttctaggtaaagtgtcaaaatccctacttttagctgggacatctatttgagaaaacctgtatccagctctttaaatataatttgcattgcggttgcttgaattcacaaatttgaagcaatcatcatataatgctcctggcattggtggtgaaaataagtcaaagcatatttaagcctgtatttttgaagcatgttaactgtcctaatgcccatctcctaatgtcctcataacagcaatattttatttttacattttggtttctcttatattcccaaatatagagcccacattaaatgaaagctaactaaacaactatttgggagttcctagaacctactcttttccagccgtctctctaagtggactacccttgttcctcaaattccaccacattaggtcttttaaagttaatcatgagtgctctacattaaaatgcaaaatatcctagaaagaaagatatttttacctactggtatataagtgtgtattattttatcagatccttggtatggtattgaccatacgatggtcaatgaattagtattgaataccaggatttaaagcaggcttcaaaagacactgaggaacgtagatcaaagagagctggtgaaaagttttaggataccaggtgggacatggaaactagcagcacctttaggccatttgccaaagtggggaaaggagaaaatattttaaagcaggtgggagtatgctgatgtaactaccttcttcacgctttcatttagagccactgtgcccaagagactgaaaatacttgcgaaattattacacatatcccaaagtcagggctataaattgtgatgcaacaaaagacctgactttcccaggctgaccacccagcttgcttacacctccctgcacagcaacatacacaagttccaatttgaggccctgctttagaaatttctcacctgtccaaaagaaattcacctgaatcttcctctctactccacctaaaactgatgaatcttccttacttctggttgtagaaagaatgaatgaattcatttctcagaaaagaaagttaacactgagatgatgggggaaatgttggcagatattcatatatggacaacttttcctcatctctaaaatcatactatgcctaaagccaatgttcaggttacacctattataattattttgcaatatttagatagatacctaagtcagagacgtcaaagcaagggctttccttcgcaattataacccctctaatcctatcccaaattcccagctatcttcaaaacaaagccagtggatttctgtgcataattaacacccagactagaccattcttaactggctcctcacctgtaacacaaaattaacgtcaggaaatacaactacacctatcattagctgcattccatattccaaaagagaaaaagatattgctttgaatatatcttcctcttactttttcaaatatttccttatttgaattcctttgggtaaatgtcatttcctgttaggaccccaaattcgaattcctttttgagattcaaaataacaaccagttgttggtttcacaatagcactgcaaaagactgaaagttcttataaatccctgaaggaacaaaaaaccatgagagtttttatctacctaacattttgagttttgatcctttggttttagtttgatatgctaatattttatgcaactaattaataataactaattttaataaactcagaacatctgtagaaggtacaatttaggcaactactaaatcatgcacctctttcctggattcattccgtagttttaaaacaaattagtgtccattaaatacaacatatttccattttaaagaaattatttaaattccacgtaatactttatgcatgcatgaatatttgaacatgtaaaacaaaaacaaaaatgttagaacttgtagttagcactctgttcaatgttctagttcaatttctatttttttcgtctatcctataattgtttatcttgattctattattaaatgagtatgctgggtttataagatgaaattaattccaatctagcaatttctaaattcacaattttataagtcttagctatgtgaaaataaatagaaacagacctttttgctgattttataactaaagaaacctgaattgaataattaggacataaaaatatgtgatagtaaagttttctgagaaatggccaccaaaaacaagattcattttcaagtaaacaatgcaaaaattcactaagctgtttgccaagtagtttttctctttctacctttatacttgcactagctctgctaaaagaagcctaatatatctatgattgaggccatgcctttattggaaatagtgaaaataggataatacattcaatattggttcacttaaggtaagcctaaactacaggagataaagaatgccattagccaaatagaaactgtcttaaagatacaacatctaagaagatgatgacaacagcataatatgaaactccagttagttagcaacctgctttggtgataagacttgagctcataggggtatgcgtcccaataaaataattcaaaacgtggaagaaaaaacagagtgtgacatcagaaaattgctgaaattatttctatttgaatactttttttctgacccagagaggtacaatttatcatggaatgaatggaacaatatgtgacaataagaggaaccaatgagaataaattaggctagattgctgtgatacagtgttttgcttacttgaattgcctacaagtttctttgctaaattcaagttgtttcctatactgcttaacgtgccaaatttgttttgattcaaaatgcagtaatgaaaagaaaaaattacattggcattactttatacggcaaagttatttttagatattaatatattccacaaacaaatttattgtactcattctagttgaccttaaaattctgttattctgctattttcctaaagaatataaagatccagtatgaatgttagtgtaaaaaaatcttacaaagctctacctggctttgatgacccgtcattacacagtaagatccctgctgctactggcgctgaattctcaatcatgatagagctgctccacaatcatggaaagatttgttaatttttgcatccacaccccttcactctagtttgaccacacgctaggttgcctctttaatgccaggttccaccacgtgacttgaattagccaatgaaatgtaaacagaagttacacgagcctcttccatgcaccaggtgcaaatcttgtctcattttcttctatctctttcctcccccgcactgccacatgtgaagctgctgattgcctgggttctggactgaagatcttatggagatgagcaccagctggtctcacgcatgtagtctgagcaagaaaccattgtttatctttttttaaattttctgttactgcagcataattaagccttagatcattaataaaatgtgtatttagaagactggaagaaatatattttatcaaatatatttatatcaaattgtaaacagtaacatatgctggatgatatggggtcaaggtaatcttttcattttttgtttttctgcacttaaggaaaaatatctatttaaatattggaatcaaaataatgctttctatgttctcacttatttgtaggagctaaaaattaaaacaattgaacccatgaagatagagagtaagtagaaggatggttaccagagactgggaagtgtagtgggggttgggggagaaagtggggatggtaaacaagtacaaaaataactagaaagaattattaaggactagtatttgatagcacaacaaggtgactatagtcaataataatttaattgtacattttaaaataactaaaagaatataattgtattggttgtaacaaaagataaatgcttgaggggatagacactgcatttatcctgatgtgattattctgcattacatgctggtatcaaagtatctcacgtaccccataaatatataaaacaatgtacccactaaaattaaaaattaaaaaaatactttataaatactataaaatcaaatgctttgaatatattcatatgctgttctaattccatccattgcaggcagttaaaaatttactgtgataaataatgtatcctaatctccctaaatgggcagatagaattacatactttttaccctttaaccctggaagaatagacgtgtctattggcaatttagaggacaaagaaagaagtgtgcagaaaccctgaagcccttactgtccaattctttatggcaccaagagatgttctcacagtctgcatcaagatggctggtggctggtaataagttttatgctagtaagtacttccgtgaaattagttatttgctggatccaaaacttcattagcttatgttaagggagaattatcttcaaagcaccctctcaactagcagggtatgccccatagacgtttgggccagaaagctcatggctgagtctatccaccccattcccttcccctacatttgcatttctgttccttaaactgcttcctgcttccattcatggaagtaagaccctcctcttccctctaaagatcacaccagcagaaacacctctcccctaagtggctttagttttccactcctaaacttattttatgttgtattgtatttgttcgtcttcattagtaaaagttagaaacttagaaacaagaaagcaaaaagtatttagtgattttataagaatatatgccatgtctcaaggagtgatataaacttaaatattttaaatgtttacattctgctaatttctctctttattggagcaaaataatcgtaacgctattctttaagaatacccataaattcacctcaagaaaaacggaagatttaagcaaagatttaaataatgttgtttactaaaatattatttgtaaaagttaacgataaagagaaaaattaacaaacattgattacactgttatttccaaagaagtaaatatgttgcagtaattaaaacttgtgatttttcaaagacgttttgagaaaataagaaatgcttatgatataatgttaaatggaaaataatttaaaagtatgaatatataacataaatattcccattttaattatttcaattactttaaagaaaaaatggaaagaagcaacaagcatctcaggatcacataattaggaattacatgatagtattgttgccccaaaatacataggttttgtgttttttttgtgtgctttcaaatttttcaacaaaataaggcttcactttcacaactgtaggaaaacaaattaaaggaatctctacatgtacataaattccagttttcagtaatccaaacgctattcaaccaacttcttagttgaattaataatacagcaacaatacagtatccattttaaaatccccatagtaaaaaaaaaaacaaaactatttctctaacattttgaggaataaagttggctactatgctctgctatgtagctgagaagacaaacaaacaaacaaaatcctaaagctctttcctggcagcactgcaaaatccgaacattaatgaggggaaagtggcatatatatgtttattcatagtgctcagattgtgtcctagagattaaagcacttgcccagagcaaaactggaagttattcaccaatagggaaacaactgtggcctcctgagtgctaactgaacctttttctttgtaaaggaaatcacattttaagtgtgtacatcatttcacttcttgcccaacatttagccataaggaatgcttaaaatgtgagactggactttacctttaaatctcattaactttagtaagggacaattttttaaagcttttctttgaatttaaaattaaacttaacagccaggtgcatacattattgtaagtgacaagttgttattaaaaacatgtgtattaggctcttaaatgacctgaacttactgtggtcataccaactttgacagaacattatccaaacctttcatgaagtatttgggatagcagcccttatacctgttgatgttataaattctaacaagctagatttaaaacagagtaaataaaagaataaagagtatatttacagaaacttcaattaataatagcttctttcaatagaactattcgtcctcagaaggcacaatcttgaattactaaacattttttattcttttttaaattttggtaaatttaatcacttcattttctaattttgttttctgttgcttctatttttatgtattcctgttttctgtatgcccaacagcaaaaattgacagcctgagccgtgaacttaggcccgcacagaatttcctataggatgcaagcatcaacatttataactgaataagtcgattatacttacatgtcatgtaacttatatgtaaaataaaaataataaaatatgttgcaaaagaaacaaaaatagatgtaaatactggtaaactttaaactacagataaattgcaaagttctttgtaaagtatctaaatccctacttctagctgggacatctatttgagaaaacctgtctccagctcctcaaatataatttgcattgtggctgcctgaattcacagctttgaagcaatcatcatataatgctcctgtcactggcagtgaaaataaagtgtatttaagcctatatttttgaagcatgtgaactgtcctaatgccaatctcctaatatcctcatgccaggaatattttatttttatgttttggtttcacttatagagcccacactaaatgaaagctaactaaacaactatttgggagttcctagaacctactctttcccaactgtctctctaactggactaccctggttcctcaaattgtaccatattaggtctttttaagttaatcattgctctgcattaaaacatcactgaattttattgtttttctactgttcataatatgcttttattatttttatctataattctgtctctgataatttcccctaattcattctgcgttgctttttcctcttcctgaaacagtctttcctcagatgtccacattactcattccccacgagtcaagtgttgactcaaatattcttccttcagtgtggccttcttgcaccatcctatttaaaattgcagctatcatcttcccctttattttgagccacagcactcaccatcatctaacatacttcctcgtttcctatttattttgaactttattcatctctgcctactctaattaaacttccctgggagcacggtgtttaggctatttttttttatactgtgacatacccatcatattgaagagggctctttttttttttttatactttaagttttagggtacatgtgcacattgtgcaggttagttacatatgtatacatgtgccatgctggtgcgctgcacccactaactcatcatctagcattaggtatatctcccaatgctatccctccctcctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttctaagtctttgctattgtgaataatgccgcaataaacatacgtgtgcatgtgtctttatagcagcatgatttatagtcatttgggtatatacccagtaatgggatggctgggtcaaatggtatttctagctctagatccctgaggaatcgccacactgacttccacaatggttgaactagtttacagtcccaccaacagtgtaaaagtgttcctctttctccacatcctctccagcacctgttgtttcctgactttttaatgattgccattctaactggtgtgagatggtatctcatagtggtttagatttgcatttctctgatggctagtgatgatgagcattttttcatgtgttttttggctgcataaatatcttcttttgacaagtgtctgttcatgtccttcgcccactttttgatggggttgtttgtttttttcttgtaaatttgtttgagttcattgtagattctggatattagccctttgtcagatggggaggttgcgaaaattttctcccattttgtaggttgcctgttcactctgacggtagtttcttttgctgtgcagaagctctttagtttaattagatcccatttgtcaattttgtcttttgttgccattgtttttggtgttttggacatgaagtccttgcccatgcctatgtcctgaatggtaatgcctaggctcaacacagtgtaagtgttttataaataatggcctaaataaatgaatgaattctccattttgtttatttgtgtcttctcccttgttattttcctcaactagtcagtccatgaatgtgttcattttattactctttcaataaaccaccacttaggatttgttattcactttttaaaattatttttatctaatttgttgatttcttttcttcacctctgtctgtttggtagggagggagatttgttcctccatttttccatgcaaatctaagtacatagattttccttttcccaacctttgtgttttcattcccatgctatcataagtatacagctttgtctcttaagaacctgtggcaataaatactcttagcctcattcttgactgtaattcagctggccattcatcgcataaaaaaaaatagaagtataaatcatgtaacagtttttttaatgccctagaaaactgtgatctgtgttttgattcattttattcattatttcttttttctttttctggtgaatgactattcaaatagtgatacccagtgagttaacagctgtaatcagacttgcatttactgctgcttttaaaaaattgatttaacggggttgaactcattttaccacatttgattatttaactgtagcttttcagtctataggtataaaaggtcaaatgctaaatttgagtacttaaagtgaggagtaattgaggttgttatatcaagaaaagatttaatggttggtgatgacacagtatttacatgactaatgttgatttttttactttaagttttattcactaatactctattgccacaggagagttctagggctgaatattattcagatgaagtgaaaacattgaacctaatcaattttaaacagttcatttgaatatctattataaaccgtgtgcattcactgccatagttgtaattaacttagctttatgctcagttttaagcttttttatttaatcaaaatatacccattttctgtttgcatgatgaagaatacaaaatctgtctgttgacagtggaattttgatattaaactgttattttaaaacttttaagtatagagtaaaaaaaaaaaatatgtcttacagaaaggcagccaataaagctgatttcagcataaacatgaaaaggcttatgtgttatttatgttagggatattcattactggatgctggtaaaaatctatagagttcattttcttaatgtgacactttatattaactgaatccttttcttaaagaaggtaggatttcagccaggtatagaaagaggattttaggttcaaataggagctttttgggtcatgattacagcattaaactgtctgtatttcctctgattttgaaccaaagaaaattatttaccttatgtaatgatatggttgggcatatgaagtataaaagtgaattagtacagaaaattaaaactaatgtgagcctgttatgaactaaacatttgtcctccacccttcaaattcatatgttgaaatcctaacctccaaggtgatggtagtgagagaaggagacgttggaggttattaagtcataggagtaaagtcctcatgaatagaattagtgccttgataaaagtaacccagagagctctgtcgctccctttctaccatgtgagaatacaagaatgtagaagtctgcaatgggaagggagctctcaccagaatccaaccatgctggcaccctgatctcagacgtccagcctccaaaactgccagaagtaattttttgtggtttgtaagccacccactctacggtactttgttataacagaccaaactgattaagacagagtccttgaattttgcaaattcatttcgtattcagatcatataatttcattgctagaaatgaatatagaatatactcaactaatccctcaattttaaagatataaaagaagaccaccaaatgaccagggcgaaattgcacagagaggagctagttttccagagatgaagggcatgaagtttcctgtctagactccatcatttaacattgaactaccctgaggaagccatttttctaagtttttacattagtgaaagaaaaacgtaggtaagataaagtgattatgaagataaaatgagtggcagacaccctgtaagtatttaaatgtaatgacattttatgtatgaaactcatttaatttttacaataatcctgggaagtaggtaatattaacttccctgttttaggttaacaaactaacgcatagagaagaaactagcccaaggtaatagagctggtaggaaagagagtcatgattcaaatcccagctgtctgatttcaaagcccaggctctttgccattatatactatgacctacaaattggagaagtgtcttagcaagagaaataccaagaagccaggtatgtgtattttaattgtgactcttggtctgtcctttggaccgcagccttttcaacttcaggcttataattttctcccctgcatttcattctttctactctcctagcaatgatgtctcatttagttattcttttaattttttaattgacaaattataattgtacatagtcatggggtacacagtgatgtttcagtacatataatgtagggtgatcaaatcagggtcattagcatatccatcatttcaaacattgatcattttcttgtgttgggaacattcaatattctccttccagctatttgcaactatgtaatatattattgttaactatagtcatcctacagtggtatagaacattgaaaattatttctccagctagctgtaatttcatatcctttaacaaatctctccctcccctctccccttcccatcctctagtattctctgttctactctttacttctatagatctctcaaatcctatcaacccaaacctgtgcctcagcattttccaccaccatcaccctttcaaaactacctccttttatgctgggaaaacggcaaaaaaaaatttcttgaacccatcaaggacccgaggtcacagctaatcaaataatctgaattccaaagacaaacaagacactacaaggaaatatgaatggttccttcaggaagcgtaaaatcgtgtcaagtaaacaaaggtatgttcaacctccactgaagagtgaagcactgcaacttaagcaaaaatatgtcatctgttacaaaaatatatagctgtcaggctacgaagctggaatgggttgggttcctatataataagcgaacctaagcccaactcaatgcaaacagtaagatggaatttatgcttaaccaatcagaagctgccaaactaatctcttactagggactttccacttttatcaatcaaatatattttcatttgcgttttataaaattttccattctaccctcctcagtggagggctaaagcatttgaggtttggtactgccaggctcgtgactagttgaatgctcaaataaaccccttaaaattccaatgtacataagtttatcttttaataaaatttgtacacataagattggtaacataagaaagctgaataacgacaagtattgacagagaagtatgagaggtagaaacctcaggtactgcttctgggcgtttaggcagaaatagctacaccagagatgagctggctgaacttaggaggataaagagtaaagtagaaatcatggttcccagaatatgcccaagaaatttcaacaggaccataaaaggacatgtgtaaatatcctcataaaattcttgtttactaagaagacaattgatagacgtctatcacagagagaattaagaagatacaatagctgtttactcaagttagatggaatgggtataatataaaacctcaaatttcagtaaatcttaaatgactaatgtgtgaaaaagtaagacagataataatatttaccaattcttgactttctctcttttatagtgctttaatttctgcttgaatctttacaaaaactgcttttttcttcatcctaataagtttttgtttggcggtttcaaggcatttgttcatgaactaatttccagagttaaatgtgttagcttatttatttttattcatttttgtttaattttgtttaataatgaaatttattcaatgacttataatttgcctctggttgttggttttgtcatagtttatatgttttaatacaaaatgttgtaatagaaatattgtgtaattgcaaattaatttcttttttgaccatgaaattattttgcaatatgtttcatacttccacagggtaatgaagaagtaatttttagtctgttgctattttccaggtcttttattgtagtcagacaacatatcaaattaaaaaaattcacttctttagatttattggcttgttgaatgtgtgattacttttaaaaatatatttcatgggcttttaaaagaggtgaattcttgtaagaaactgaaattggcaatataccattaagtcgaagaaatagtttaatattataattctcaatttctcattttcttttttgatccaatgaaaatcaaaggtattgcattaaagtttaatatccagttgcattcctattcctttcttcttatattctaataacttattatgagaaaataaagtatacttagtaatttattatgtttgtaatagtttatttcctcaatactatgatttttcatgagtaatattttgattaaaaattgactttttgttattataaaaaattgtttttgatctagtttattaatactggcctataactccttgtaacattctgctttttgtttggtgctcttattttcatatttctatttttaatttgttttatcaccttattttaggttatttacattaaccaaatcatcagtaatgaaatgcatctattttgcatttgaaaagaaaaataatttgcttaagtcaatatattaattaccctagaaccaaaaggagaagaaatagatacattgatttgaaactctcctgtctaaccaataaaacacagaaacttaaccaacaagcacatacaaaccctagattggatactgttttctgctgaatatcaataaataaagtgatagatggttgcatttcaaagctgattacatgaaacttataaagtctggatatctacaagtaacttttatctacaaattacccttcaaatcttattgtgcagatgtaaatctgatacctaaatttttatttctcatcatggatcagcacatacattctttgtttctctgttcaaagacaaagaatattttcagactctagctcctcattaaagttcccaaattactttatgacttagaatcctgcttttcacactatctgattaaccaaatcatatcttagaaactcatcttgctacatgtgctaattataagttcacagactggttctagtcattattttattaaccatctttggaaaaggagagagagagagagaatgtgtgtgtggtgattatactttctatgttaggaaaatgtaggtttatgatgttataattgtttacctctacagctctatagtcttagacttactttagccccttttcatcattaccataccttaaactagatctgcataaaattatctcttttctgtctctgaggctggttcttccatcttatttctaaatacatagcatgtattaaatttattgcacttcttgagatacttcttgataatgtttttctaaaagttgctacttacgcaatgttctataatttatataagctctactaccacatacaatcaaactattacttctaatattactacacaaacatatgcatttccttaaagattaccaatgcataacaaatatatcctagctctcagcctggagtatcttactgacttcttttcaaatgagacttgataaaacatgagcaatatttgcactcttttattgacaataaatctagatccatgaaattttgtatacaatccatagtcttctttcttctttgtttctttgtttcttcctttctttctttttagacagggtctcattcttccacccaggctggagtgcagtggtactatcatggatcaccgaaacctcgaccccttggactcaagtgatcctaccacctcagcctcctgagtagctgggactacaagtgattgccatcatcccctggctaatttttcaattatgtgtagagataaggtcttgctatgttgcccaagctggtcttaaacgcctgggctgaagcgatcctcttgcctcggcctcccaaactgctgggattacaggcctgagccacatcacccagcctaccacagtcttagcgtccactgttttggaatgaataggctcacaaagccagcagagtcagtgctaaattgttttaaaataatagtatgttctttatctctatgcagttccatacattggaaatgttattacctaaatcattgctcttgaattataccatggctacaagccttcagtttgagtaaactggggaggtgatacatagctttcaataaattatttcagctttttgtttgtctcaaaatatcattaccttcacttttgaaaaataatttttctggctatagaatggtgcactaacaggttttgttttcaatattgttctacttttttctaacaagaagactcttgtaattcaaatattagtttctctgtatgtgttttaactatatcccccattctctttctcctccacccttctcctctcctttcattattttattttgactttgatttttggcagttttttctcctctgtaactatgtatctcaccagcagtatatgaaaattccatttgctctgcattcttgacaatacttgatcttgcctaggtatttcattttagtcattcttgtggttacatatagatacctcacattgactttaatttgcatttccatgatgactaatgatattgcacactttctcatatgtttgttgcctacttggagatcatcttttgtaaagtgcctgttcaaatgttattcttctcttttagattgactgtagttttctttgcagaaatcatttttatatatcgtttgcaagttctttgtgagatatacgtactgcatatgcatcctccaaatttttagtttgcctttcctcttttaatgttatcttttggtgaacataatttaaatacaaaaattatcgtttttcttttatgagtaatatattctgtctagtttcagaaatatttgcataatgcataggcataaagatatccacctatgttttattataaaagttttattgtttgatctttcacattcagatcagaaattgatttgtgtaaaagatgcagggaaagtttgttttttgtctgcatatagatagacatctaattgactcagctttgtttatcaaaaagacaatctttcatcattgccacttataaaacaggagactgtatttatttatattggtttctggcctctttattctatttgtttattttttgccaacatcatgcatgttaatatctacagttcttaatgtcttcatgtctgacacagtgagtattctagctttgttcttcccgaaagccaccttagacacacttgacctcctgtatttcctcatgatttttgaatctatttgtcagtttccacaagatatgattacaagtgttttttatacttgtagttgcaacttttacacaagttgcactgaatgtataaatcactgtggaggaaactgacaactttataatagcaaagcttttactacacgaacattgtatattattccatttaagtaggtcttcttcagcctctcagcagcaatttacttgtagttctcaatatcaacctctcaaacatttttattctgtttatagatatttggtattttctgttcctcacatgatattatttgtatattttattttctatttgcttattgatggtatataaaatatagtgtgcatccagcatactttctaaaatcactcaatacttttaagtttggaaattctttaatagtttagcagtttgaatcttctacacacactattgtgttatctgttttgtaaactgattatatttcttgctttctaatatctatacctgattgcttaacaagttttcttatccatcactggctggaaaatcccatacattattgaatagaagaagtgataacagatgtcctaattttattcttggccttagggagaaatctattaatattttaccactaagtatggagttggctgtaggtttgtttttaactactctttagaaggattacttcatttatctttctaagaatttttattatgaatgattgtcaaattttccaaatatatttttctccatctgttgatatgcttatatacttttctccattttctgttgaaatttggagttacattgattgagttttaccttttaataaactttgaattcctaaaataaaaccaacttggtcttgatgaattcaactttatatatattgctgaattaatttttctaagattcctttagatttttgtatccataatcaagagattttgatctgcagtttccctttcttgtaacgacttaagtttcagtatcaggttatagtagcctcaaaaatgaatttggaaactttttttccttttctattctctagaagatgtgttgttccttatatgtttgatagaattctcttgcaatgccatatggttttcatttgagaaaatttataagtaacagcttaaatttatttttagaaaaacacaggcttatactggctttcttgcatgattttaaagttcagttttttcagaactttgcccgttttatctcagttgtcaaatgtatagattgatgttgttcaaaatcagttgattgtctttttgggggaaggaagggagttaaatttttcctttaaataattatagcttcacaagaagttgcaaaaaaatgtacatagaagtctcgttgactctcacccagtttctcccaatggtaaaattttgcatatctatagtacaatattaaaaccagaaattaacatggatacaatccacagagattatttgaatattaccagttttacatgcactcatttgttcaagagtgagagagagagagagtgtgcatgtgtgtgtgtgtgtgtacaactttgtcacatagattagcgtcaccatcaccacaatgggggttacaaaactgtttcatgatacaaagcttccttgtgctagctgtttatagccatgcctatctctctttccccaattctaaccatggtgaccactaatctgttctctatctttataattttatgtcaaaagttagataaattgaattatatgctgtgtaacctttttagattggctattttcattcaaagatacatctaagttattgagtgttatcaatattttgtctcttttattgctaagtaatactctattgtatggaagtatcacaatttgcataaccattcacctatgacatggtatctgaattgtttccagtttttgagctattatcaataaagctgctatgaacatttacaggcaggtttctatgtgaatatcattcggtttctctgagttatatgcctaagagtgtaattggcaggtcattaggataagtttatgtttattcttatagtacactaccaaactattttctagaattctgtaccattttatatgattaccagcaatttatgagtaatctagtttctccacatcctcaccagtatttggtgttatcactattttaaatttttgttattttagctattctaataggtatgtagtgatatctcattattttagtttccatttccctagtggctaataatgtggaatatcgcttcatgcacttatttggcatttttatatctttttggtgaactgcctgttcatgtcttttgtatattttctgattggattgttttgtttattactctcaaattttcagagttctttatatgttatagatacaagtcccttgtcagatatatggtttgtaaatattttctccaagtatgtagcttgtgttttcatactcttaccagggtcttttatagagaaaaagcttaaatttttatgatatccaatttatcagttttttcttttttaaatcatgcttttggtgtcaactctaaaagctgcctggccctaagtctcaaagtctctttactcctctcttctaaaaatgttttagttttacattttacatttaagtccatgattcattgtaagttaatgttatgaggtatatttcttaagtcaagactttttttttttttttgccatgttgacctattggaccagcatcaattgttgaaaaggctatcctttcattcaattgtttttgcacctttgttaaaaatcatttgggcctgggtatggtggctcatacctgtaatcctagcactctgggaggccaagaaaggaacgttgcttgagcccaggagttcgagtccagactgggcaagatggtgaaactttgtctctacaaaaaattttaaaacataaaaaatagctgggcacagcagcgcacacctgtagtcccagctactcaggaggctaaggcaggaggatcacttgagcccaggtattttttgttgttgttgttgttagatgagtcttgttctgctgcccaggctggagtgcagtggcacgatctcggatcactgcaacctccgcctccctggttcaagcaattctctgcctcagcctcctaagtggctgggatcacaggcgcccgccaccacacccagctaatttttttgtatttttagtagaggcagggtttcagcatcttggccaggctggtcttgaactcctgacctcatgatccacccgcctcggcctcccaaagtgctgggattacaggcgtgagccactgtgcccggccgagcccaggaatttaagatggtagtgagctgtgatcacaccactgcactccagcctaggcaataaagcaagatccatctatttgaaaacaaacaaacaaacaaaaaacccatcatattggcaatatttgtgagggacacttattatgtgttctttatgctcttccattgatctatgtgttgatccctctgccagtattacttgatgctgttttgattatttcagctctacggtattttttcaattccagcagaatgtttgctcccactcttttattcctttttaatattgtcttaggtatgtcacttgccttttcatataaattttaggcatcatgtattgtctttttaatgtctgtaggatctatgattatgttctcatttttatttctactatcagtaattcgtgtcttctcttttgttctttattcattttaaattttgtattatatttaatatttcaatacagacttatatgctatattaaattaataccttagtattaattatttttatttatttatgccaaagttcatccattttatttgtctttttggagaactaaactttgattctattgggttatatattctttttaaaattactgattttacctttagtactttttatttcctttctgctttctttgggtttactttgcatgccactgatagcctcagtttattgctacataagacatctcaagtctctaatcctaactgggcatactatccagttcctgagttacctgtggtggctgcacagttgtcttagttttctcccattatctcaagtaactcagtgcgaaactttcctcggccctaaaaaatacatcccagcttttaaaattatcattatttttaagttttcattttttggtgggagctgtgaccaggactattttcatagccaaaacagtctctactttttggcaagggtcaatacacattggttccaattttctttgtaggagctgaattcctggcgatctatgcttatattcggtcatgtagaactcagttggttttgcacttcagtgcacacttactgttttgcacttccatttagactagtccactgacatgatttgtcatggaatttagcctttatgtcttctttaaattttccagtttatcagtcattgctgtgtgatagaagagacagggtggaaggtctgtctcttctatacaaaccttcagtgtttctggaccaactacttcaaagggtatttttgcagtcacacaatcttagggggaaaaaatgaagagaaaaaaataactgtcagaaatattatgaagttattccatataagtggagtctgtgttcccaatataatatcagacttagaggcaatattttacgggacaaaaatcacaatctataggagctgggccctctacattgcaatatacattcagtgtggcagggattttgcaagaggaagataaaaattttgttagttctattatttcttaaatctttaattttgttgatctagatcttgctgcctggttcattccagaagcaaaaggaagagggcctctttaatatttaagtcataaaatagagctcattcatccagaagtagtgatgcagaatgtgcagtgggaatagctatcaggaaacgcaatgatattacatttatcccttttaaaagataattccgatctacttgacacaattaggggagaaatgaaagtaagtacaggcttagaaattctatcagtaagataaatgctttaaatgaagatcaattaagagccaggtagagtgctcaaaacaagtgtcgggaagtgggcaaattgatagtatcaaagctatgaaaatcactaggaaaagttaataggttggcaaagataagcaagccaatatttggaaaagctaaatagttgtgctaagaacagagtgactcactgaagtacagaattcttatttcttttaatatttttctcactgtttgtttctattaatactggttagagaggaggcagatatactcctgggaaaaggtaagaggatctctggagtaaatgataggaaggagggccacatataggtagattgaaaaatggtttgaactactatcttagacacataaaatactgaatgtgaagttctgcaaaacattagtgacagttgagaatatattaaaaatataattgcaaaaatgattgctaacatttttaagaattagaaatgacaattcactgttaaataaaattatttgctaatttttctctaacttatcaccaatatgaacaaatgaacctactgtatatgtgagtataaacaaaaaatgctctgcctgcttaaggtaagataggcattgttcatatgatatgtttttcagatacctaatcaacttgcagcaatttacaccatatgaaagggaagtgctttggtgaatttataaagccctctaactccaaaacatttgtattttttctttattgatgtaggcaaagagttgcgttgctcatagcgataatttcagggcatacagtgagcattatctgagcaaagtcactataattttttacataattatttatcactttttattcccatacccatatattatccaatgtacagtgtttttttgttttttgttttgtgttttttactttaagttccaggatacatgtgtagaacgtgcaggtttgttacataggtatatgtgtgccatggtggcttgctgcacctgtctacctgtcacatagattttaagccccacatgcattagctatttgtcctgatgctctccctcctcttgcaccccccacctccaacaggccctcatgtatgttgttcccctccctgtgtccatatgttctcaatgttcaacgactcccactaatgaatgagaacatgcagtgtttggtttgctgttcctgtgttagtttgctggggatgatggcttccagcttcatctatgaccctgcagacgacatgatctcactcctttttatggctgcatagtattccatggtgtacatgtaccacattttctttatccagtctatcagtgatggccttttgggttggttccatgtctttgctattgtgaatagtgctgcaataaacatacgtgtgcatgtgtctttataatagaatgatttatattcctttgggtatatacccagtaatgggattgctcagtcaaatggtatttctggttctagatccttaaggaatctccacactgtcttccacaatggttgaactaattttcattcccacaacagtgtaaaagcattcctacttctccacagcctctccagcatctgttgtttcttgactttttaataatcgccattcactggcgtgagatggtatccaattgtggttttgatttgcatttctctaatgaccagtgatgatgagcattttttcatatgtctgttgccgcatagatgtcttcttttgagaagtgtctgttcatatcatttgcccactttttgatggggttgttttttcttgtaaattctgcatattggacctttatcggataggtagattgcaaaaactttctctcattcagtaggttgcctcttcactctgatgttagtttcttttgctgtgcagaagctctttaattagattccatctgtcaattttagcttttgttgtaattgcttttggtgaattcatcaaaaaatatttgtccatggctatgtcttgaatagtattgcctaggttttcttctagggtttttataattttgggttttacaattaggtctttaatccatcttgagttaatttttgtataaggtgtaagaaaggggtccagtttccgttttctgcatatggctagccagttttcccagcaccattcattaaataggaaatcctttccccattgcttatttttgtcagatttgtcaaagatcagatggttgtagatgtatggtcttacttctgagctctctattctgttccattgctgttttggttactctagccttgtagtgtagtttgaagtcaggcagtgtgatgcctccagctttgttctttttgtttaggattgtcttgattatgcaggcccttttttggttccatatgaagtttaaagtagttttttttttttctaattctgtgaagaatgtccatgttagtttgatgggaatagccatgaatctataaattactttggacagtactgctattttcatgatactgattcttcctatccatgagcatggaatgtttttctatttgtttgtgtcctctcttacttccttgagaagtggtttgtagttcttcttgaagtggtcattcatgtcccttattagctctattcctaggtattttattctctttgtagaaattgtgaatggaagttaattcatgatttggctctttgcttctctattgttggtttataggaatgcttgtgatttttgcacattgattttgtatcctgagactttgctgaagttgcttattagcttaaggagttttggagctgagatgatgggttttctaaatatggtatcatgtcatctgcaaacagagatattttgacttcctctcttttcttttttaataccctttatttctttctcttgcttgccttgactagaaattccaatactatattgaataggagtggtgagagacggcatccttgtcttgtgccagttttcaaaaggaatgcttccagcttttggccattcagtatattagctgcaggtttgtcataaatagcgcttattattttgagatatgtttcatcaatacctagtttactgaaagtttttaacatgaaggaatgatgaattttatcaaaggccttttctgcatctatcgagataatcatgaggtttttgtcattggttatattaatgtgattgattttgtttattgatttgcatatgttgaaccagccttgcatcccagaaatgaggctgacttgatcatggtggataaacttttggatgtgctgctggatttgatttgccagtattttactgaggatttttgcatcagtgttcatcagggatattggcctgaggtttcctttttttgttgtgtctctgccaggttttggtatcaggatgatgctggcctcaaaaaacgagttagggaggaacctctccctttcaaatgtttggaatagtttgtgaaggaatggtaccagctcctctttgtaatgtccagtagaattcagctgtgaatccatctggttctgggctttttttggttggtaggctatttattgttgtcggtctattcagggattcgtcttcttcctggtttagtcttgggagggtgtatgtgtctaggaatttatccatttcttctagatgttctagtttatttgcatagaggtgtttatagtattctctgatggtagtttgtatttctgtgtggtcagcagtgatatcccttctgtcatttttttattgtgtctatttgattcttctcttttcttcttatttcttgtcttctgctagcttttggattggtttgctcctgtgtctctagttctttccattgtgacattagggtgtcagtttgagatctttctagctttctgatgtgggcctttagtgctataaatttccctcttaatactgctttagctgcattccagagattctggtacattgtctctttgttctcactggtttcaaagaacttcttgatttctgccttaatttcattatttacccaggagtcattcaggagcaggttgttcaattttcatgtagttgtgtggttttgagtgagtttcttgatcctgagttctaatttgattgcactgtggtctgagagactgcttgttaagatttcatttcttttgcatttgctgaggagtgttttactcccaactatgtggttgattttagaataagcaccacgcagaaccgagaagaatgtatattctgttgtttggaggtagagagttctatagatatctattaggtccacttgttccagagctaagttcaagtcttaaatatccttgttaattttctatctaattttgatctgtctaatattgacagtggggtgttaaagtctcacactattattgtgtgggagtctaagtctctttgtaggtttctaataacttcttttatgaatctaggtgctcctgtattggatgcatatatatttaggatagttagctcttcttgttgaattgatcccgttaccattatgtaatcccttctttgtcttgtttgatctttgttggtttaaagtctgtattatcagagactaagattgcaaaccttgcttttttctgttgtacatttgcttgataaattttcctccctctctttatcttgagcctatgtgtgtctttgcacatgagatgagtctcttcaatacagcacctttctgtttgttagttttccttctaacagacaggaccctcagctgcaggtctgttggagttctagaggtccactccagaccctgtttgcctgggtatcagcagtggtgtctgcagaaccgcagattttcgtgatccgcgaatgctgctgtctgatcgttcttctggaagttttgtctcagaggagtacctggccgtgtgaggtgtcagtctgcccctactgggggtgcctcccagttaggctgcttgggggtcaggggtcagggacccacttgaggaggcagtctgcccgttctcagatctccagttgcatgctgggagaaccactgctctcctcaaagctgtcagacagggacatttaagtctgcagaggttactgctgtctttttctttgtctgtgccctgcccccagaggtggagcctacagaggcaggcaggcctccttgagctgtggtgggctccagccagttcaagcttcctggctgctttgtttacctaagcgagcctgggcaatggcgggcgcccctcccccagcctcgctgccaccttgcagtttgatctcagactgctgcgctagcaatcagcgagattctgtgggcgtaggaccctctgagccaggtgcgggatataatctcctagtgcgccatttcctaagcccgtcggaaaagcgcagtattcggctgagagtggcctgattttccaggtgccgtctgtcacccctttccttgaccaggaaagggaactccctgaccccttgtgcttcccgagtgaggcaatgcctcgccctgcttcggctggcacatggtgcactgcacccactgtcctgcacccactgtctggcactccctagtgagtgaacccggtacctcagatggaaatgcagaaatcacccgtcttctgcgtcgctcatgctgggaactgtagacaggagctgttcctattcggccatcttggctcctcctggttcttgactctttatccaatttgccagtctgtgtcttttaattggggcatttaccccagcaatgtaaagtgttgaataaatatttttgtttgtatgcagtcttcaaaaatatgtatggttgttttgtggacacataagtcatacccgtatgaagatatagaacatttctatcaccctagaaagttaaatcatgcccatatcacgtcaatcccacccccgcccacaaatcaattactgttctgctttccattatttgcctgttgtagaactttatagaatcaaatcatgcattatatatttttttgcttcttgtttcttccagtcagtataatatctgtgatattcctctgtgttgtgtttgtattagtagttcctccttttaatctgtgaattctattccactttaagactggattttactttatcatcatttccattttatccagtttgcatattccttttcttgctgatgcacctgagctgtttccaggttttgaatatgatgaacacatctaccatgtaaattgttacacaaggctttttgcatcaacatgatttcatttcttttagataagtacctagaagtgggaattcctgggtcatagggtaggtgtatattcagtgttataaacaatcacaaaacctttaggttttgtgatattttgtgtctctaataagaaaggatgagaattacccttcctcaacatttttcccaacacacggcattatcagtccttttaattttagatacttaaaacagtgtgaaatggtatctcattgtttcaatttaacttcagaacctatgaaaagttttacattcagttttaatgtaggtgtctgctaattctaacaactatacaaattctgagtcaattgattagtctcctcatattggtcttgttttctggtttcatttttcatgcctagtcatcactgaatggatataagacatcatgaattttaccttgatagttactggatttcaaaaattcttataaatattcttgagggttttttctgaaattcattttaaattactgagaaactgtctgatactcttgggtgttgcttttacgatttttagtgggtctggagtggtgctcagtgtagggttaattattactcaccactgacacaagatactctgcatagactacccaatgccctatgaattatgagctattaggtctaactgttgtgaataggcattattcccacccctgtgtgagtaccgggcactgacccttttagttgtttcagaattttttttttttttttaccaggctgaggctcttttctctaatgtatgcactgataatattcagatgaatccttgaagttactctccacagatatttggggttctttctgtgggcaactccctttttgctagagtttggactttttcttagtgaccagagaatagcaatgaaccatcattttataactgaaacaaaaaccataacccccaagtctacctatccatgatctgtagttctcttccttttttgattgctatttcttccccagtgactcttatactgtttgtaggcctagacgttttgtttgtgcatttttttgtcttttgctattttaatcccaggttatgagagccagctgggtgtggtggctcacacctataatcccagccctttggaaggctaagatgaggagattgcctgagaccagcagtttgagactggcctgggcaatatagagagacctggtttctacaaaaataaaaagtaataattagtgggtatggtggcatgcatctgtagtcccaactacttcagaggctaaggtaggaggatcacttaagcccaggagtttgaggctacagtgagctatgattttgccacttaatttcaacctaggctacgaggtaagacctatctctaaaaaaagagagcttgtcaccttcctctctctcactttgggacacttacaagggtgaatataaggaaagggaggtgttaacacatactaattcatcatcatgtcataaatcaaaagtctggcaagctggtttcaatgacaaaaatacattcacacctactagtctacattgtcattggataaaatccttatcgctcataaaacactaatcaaccccagctacatatgtgaaatatagctttgatcctaattctttttcatttttttctaattttctgcttaacagaagttcaataactaaaggtgccactatttctaaacaaaatattcattatagtctaagatatgttcagacttttgagaattctgactgccatattgagagaaaatatccttttaatgtgctattagaaaagtttattttctacaatatacactaaataaaagtataaggaatttatattttatagatatgacgaagtattattttccttaccttaaagccatctcttaattgtaggattagttcaaattagaacatctatttaatggcagaaaacagtcttaaaactagggatcttgaaaatacttctccaaatctctatttcaaattcctatgaaaagttgttttatgtatcttccaaagtatatttgttttattttttctaagaagtaggatatattttaaagttttcataaccacctagatttatttagtaacttttctctaagaaattaaagtgggcttactcttgtagatttaactcaaaaaaaagttctaataaatagatgcaatgagatatattctattttatttttattttatgtattatttagagttttgaacttttcatccagcaacattctgcctggctgcctctttgactgtaaatcagatcccctcagatagagcattgctccaatgaggacttgagagtgctcataggtacattacttactgaattgcactccagcgtcctgacagaacaaagcactggcaagtgtaacataaatttccacaaagaaataacttcagcaataaactctatttagggataagaaagaggagaataacagggcaaactacataaacgtcatcacaacacagcacattagatgacatttttacagtgacatataaaaattaccttgtagaatcttgataggaacttacagccaaactttcttacaggaacataaagccttcttgatatcatgaaaatctgttgcagttcttctcaggaaagtggcttttcaggaacattgtaattctgttttaatatggatgtaagtgctttcaattaatattcactataccgaataagcaggtctaaacaatgtaatgaaattaattaataagtgatgaattaaaccactgattaaacttatttgaagaccaattttactaagtacatataacgttctgacttacatgattgaacatatagatttaataggataaaaataaaatgcaatttactatctctacgtatgaaaaataaatatataacacaaattttgttagctgaaacaaaggaaaaataattcttttataaaataatcctcctgaatgagaaacatatatacataaactgggaaaaattaaatatatatgaatacatcattaagctgtagagacagtgaagaaaccacagagggctaaaataacatgtaaacagaagctgagaagcaaatgaaatgtgtgaaattcagcttttattctgaaaatttctgccaaattttgggagactaaagtttcccgttcccctaggactgtatgggctagaaagaacagaagtttttaatgtgacatgggtagtttaataaaatatgcctgataaatctggtaccccaaagtgccctatgataagccaaagaatgaatgaaaaatgaacccattataaagaagggacagcaaaaatatttatccattttaaacttgtaactggatgaaagaaaagaaaatctcccatgatattttgtaaccatgaactgagtgtcacatggatttttgcttgaatttatgcttacccacatgttcaggagtaaaacttggagcagaaattttaatttaaagtatggtaaggtttgcagtgctccctgatgactgatagaagaaagtaaaatcatctctagggatgtgcaacatcaattcattaaacaaaaactttccaaatataaagttccaagggaaatgagcagttcagagtcaaaaatcataaaagaaaccacataagttacagatgaccctcaaagaatgtaaatatcagaattatcagacgattttaaatatctgaagaaaagaaaaaaactgggaacaagagcctatagaaaacaagtaagatttgggagagaacactgcatttttataaataaagaagacttcaaatttaacatttaaaacaaagattgaacaataaaaaatagcttagctaatgaactagtagacagcttattctcaaaagctatgtggtagtaatatgttttaaaaactagaattgacattttaaggacaaacttccaatttacagtctggtaggtagagagcttagaagttgtcactcattcctaccaacaagtaaaaagctgaaccaactggcgcggtggctcatgcctgtaatcccagcactttgggaggccgaggcgggcggatcacaagttcaggagattgataccatcctggctaacacggtgaaaccccatctctactaaaaatacaaaaaaattagccgggcgttgtggcgggcgcctgtagtcccagctactcgggaggctgaggaaggagaatggcgtgaacccgggaggtggagcttgcagtaagccgagatgttgccactgcactccagcctgggcgacagagcgagactccgtctttaaaaaaaaaaaaaaaaaaaaaaaaaaagctgaaccaactgaaaaatcaacgactcttcttagatctgtcagagaagtaatgtcacagggaaaatcactggcctccaaattggagagacagatgaatacagagaatcacaacttaccagagcaaagacccacaagctgaaacctccatggggaccagtgctgggtaagaaaacctgagctgtaattaataaattactagaggctcagtatagattattttgagagtcaaaaagtccagggaaacccagttaaaggagtacccctacacttttgtgagctttagctcctagagctaaaccaggttttgacagtgaaagaggagaagagaaatgaaaaagaaagaagagaatttaaaaattccttcatgctccttgcaaggggaagaaaaaagtaatcattttgaaatttaccaaagtattctgctattgataaggcctgcccctagaaaaaactgttttcccagagcctagactactgttttgtttgggggcctaactaaactgggggaaagggaatacccaactctagccttctctagctttccacatagaagaagaaaaatacccaactccagtccaatctagctattctgtcccacctggggccagggatggggggaatccatgggagaagtgagaagcacatgtgaggttaacagtccagaggcataagctcattaaaacactgagacctaatcaggcaactgtaggacactttccctcctctgacatcttatcacctcattcctaaaggcctatttatcctgttacccaatacatcatgtccagctatcaggaaaaaattacaaggcatactaaaagtcgcaaatatagtttgaagagctagaacaagcataagaaccaaactcatatggcagagatgatggaactatcagatgagaaatttcaaacaactatgattattgtgctaagggctctattggataaaggagataacacatcataacagatgaacaatgtcagcagaagttctaagaaagaataaaaaagaaatgctagagatcaaaaacacactaatagaaatgaagaatgcctttgataggattactattagactgaacacagctgaggaaagaatttctgaacttgagaatactcaacgaaaatttcaaacactaaatagcaaagagaaaaaaggctgaaaaaagaacccaaacagtatttaagaactgtggaagaactacaaaaagtgtaacatatgcaaactaagatgaaagagaagaaagcaagggagagaaaagaagaaatacttgaagcaataatggatgaaaattcccccaaattaaagtcagacaccaaagcacagatgcaagaagctcagagaacaccaaacaggataaatggaaaaataaaaaaaccctagccatattatacttaaactcagaatatcaaagacaaaagaccttgaaagaaaccagagaaaacaaaacatcttattaaataggagcaaaaataagaatcatatccaattacttctcagaaaccatgcaagcaaaaagagaataaagtaaaatatttaatgtgttaagagaaaaaaaatcccagcaacctagaattctttgtcctaagaaattacccttcaaaagtgaaagagaaataaacacttcttcagacaataaaatttgaggaaatttgtaaccaatttatttgtatacataaaataaatgacagcaataataaaataatgagggttattttattactataaagtactcacagtactaaagcagcattaaagagtggattttaatgaattgtaaatctatattgctaactctagggcaaccacttaaaaataggaaaaaaaatataactgttatgctaagaaaggagataaaatggtattaaataaaatgctcaattaaaagcatcaagggaagaaaaagtagaattcaaaactgtgaataaaggacaagggtaacaaatagaaaacattagcgaatacagtagatgttattccaagtatgtcaataatcactttaaacatcaacggtctaaatataccaattaaaagacagagattgtctgagtgaataaaaaaacaagacctaaccatatgctgtttacaagaagcacactttaaatataaagacacatatatattaaaagtaacggattgagaaagatatatcatgctaacatatcaaaagaaatgaggatccagacaatggaatcttattcggcactaaaatttgagtaaggtattgagcgatgaaaagactactcagggaggaaccataatgcacattacaaagggaaagaagccaatctgaaaagactgcgtactgtatgattccaactaaacgacagtctggaaaagttaaaacttatagagacagtgaaatgatcagtgtttgccagtggttggggaaggaagaagaataggtggagcacagaggattttcagggtggtgaaactactctctatagtactaatgctatatatatgtcattatcaacttatcaaaacccatagaatgtttaacaccaaaagtcatataaaccatggactttgataatgatgtcaatatagattcactgactgtaacaaaagtaccactctggggcaggattttcatgataggggaggttgtgtacaagtgggtgcaggggatatataggaaattcatgtatcttccactcagttttgctgtgaacctcaaactgatgtaaaaaataaagtctatttaaaaagttaaaggaaaaagttttacttccagacacaaaggtgtaactgaatcagaccagctattcccccatagtcaaaataactgattgtcatgttctccctccctctctgtccttctatattactttctgcacagggatagtgttagtgccttctgggatgggagaaaggtccttcgaaagctcagaagattcaaagaagtctgaggaatcaaactggaggagggataaattcacccagataacactatccttggggtatggtgccaggttctccagctagggccctgactttgacatctcacaactacatctgtgcattgaactgtgttgaaagttcacctgctctgactcttagacaagggtttggtcttcagctctttctgctaatctactgcatgagataagggcttctttgtaagctgccaaagcactctggctctcatgcttagttttcaatgacttgctaattgagcatggcttgcattgtcaaaccactcctcatgccaactatgctagtcaggttctccagcaatcagacattgagataacattagatttacagaagttgcactgacaagtaacgtcttagaaaaaaaccaaacaccgcatgttgtcactcacagatggaaactgaacaatgagaacacagggacacaggaaggggaacatcacacaccggggcctgttgtggggtgaagggagggggaatggatagcattaggagatatacctaatgttgaatgacgagttaatggatgcagcacaccaacatagcacatgtatacatatgtaacaaacctgcacgttgtgcacatgtaccctaaaacttaaagtataataaaaaaaatagataaaagaaaggaaaggagaaaggcttacggagaagaactcatcagacggtgatataagatctcgcaaaatattggccaaccccatgggaagctctggaacaaagatttgcttttagaagagcctcatattgggttaagccattggcaagaagaaagtaacctcaactcaaaacctgaggtagaccctaatggagctagcagctagaggctgacagctaaccacactccttgctatgggtagaaccatttctttacaaaggatctaagatattctttttcatctgacacaaacactatcaaataagtagacataatggacatttggacataatggacatatggacatctacaaatggaatgaatatctacagatggaattccatgtattctaaagatacatggaatatttactaagatagtccacctgctgaggcataaaagatgtcaaattcagaaggactgaaattatatagaataatattcctgaacaaaaatggagttaaactgtgaagtaacagtaaaaaaaatcttaaacttgtaaaactcagattatggtaattagcatatccatcatctaaaatattcattatttctttgggaacaaatttaaggcatggaggcattatcctaagcaaattaagacagaaacagaaaagcaaatatcgcatgttctcacttattgtaagtagaagctaaaaattgggtactcatgggcataaagatggcaacgataaatactggggactactagagggagacaaagtgcggggacaaaggttaaaaaaataattcttggccgggtacagtggctcatgcctgtaattccagcactttaggaggctgaagcgggcggatcacctgaggtcaggaattcgagaccagcctggccaacatggtgaaaccccgtctcttctaaaattacaaaaatttgccaggcatggtagcaagcacctgtaatcgcagctactcgggaggctgaggcgggataggataattgcttgaccccaggaggcggagattgcagtgagccgagatcacaccactgcactccagcctgtgcgacagagcgtgcctctgtctcaaaaaagaaaacaaaaacaaacaaacaaacaaaaacgccacctaattcttgggtactatgctcagcacctggacgacgcaatcaactgtgctccaaacctcagcatcacaccatatacttacataataaatacttccaagcaactgctgattctaaaataaaacttaaaatttatttttaagaataatatgataaaaataaaataaaacatgaatgtaaaaaggcagtttatcatttaagaggtaatctagcttaattttttatgaaagtgtctctctagcctgttattaagcacatacaggattgaggaatttattctctaaagtagcctgattcattttaagatgttctttaatggttggaaattattttatgttaaagttaaattttccctcccattatttccacttttcatcctagttctctcctccagaacctctcaaaatcaatccaaaccttactacacatgagtccttaaaaataatcaaaaacagttatcaaatttctgattctttccttctgcagatgaaacattctcagctccttcaggtaccttctcatgtgatttacaatgacccagaaatattctcattccttgcccttcaacattcttcaatttgattaaaagacctccaaaggtgagctttccagaagagaacacaatatcttaggtgaggtcttccccgtgtgaaatacagaagccacatcccactctcacaaaaataaaataaaataaatttaaaaggcatgaagggcaggcaggagttagcttggataatttctttggtagacatacgattgattacttctaattataatctccttcttgggactcatcaggccctaaaactggctaaatagttttatgcctcatggcctttgcacaagctgtcctggtgaaactaatatttgtactaaaaatacaaaaattagccggatgtggtggtgggcacctgtaatcctagcctcttgggaggctgaggcaggagaattgcttgaacccgggaggcggaggttgcagtgagccgagattgcgccactgcactccagcctgggtgacagagcaagactctgtctcagaaaaaaaaaaaaaaaagaaagaaagaaagaaagatcttaccatactcttcatattcaccatcccaaaaaggctgttccttatcactttttccagggcaaccttttcaccattattctctgaccgagtctaatgtttattttcttcagaaaagttaccaaagatgcaattattaatttgcttgttatcttgtctttgtctctcccactagaatataaagtaaaagtttggtaaacaaacaaacaaaaaattaaaaactgcatctgttcatttcattaatatcctgccagcctttcgcacagtgcatgcatagtgtacaattaacacccaaaaatacttggtaagttaataaattaaaaaatgaaatggtgaccaacaggtttttggttttgcgactggatacataagccaagactaacattacaaaaggacaagtatgttgtggggggaaaaagagaatcatgaaggagtctaagttttttggggtctgtctaatgtctagattagaaataaggatctggatctagaagccacacctaaaaaataaatttatatagcacggtcaccaatctatttgacatagttaaagttgtaggattagatgaggaaataatcagatgttataataaagaaataagaaactaagggacacagaatgagaaattaatgtctaaggaaattaaaagcaatccgagaggtagaagtggaactacagcccaataattccattgtttcaagaagacagaagtgacagataccgtcagatggcaatagaagagacctgaaaaatgtttatgggttttgaaatttagcagttattagtaacttttgagagagagcagtttaatggtattttcggagcagaagcccgagagtcatgcagtaaacaggtcagaaaataaaagggtaaataagagcactctgtcaagatgattgattgaattgcatataagaaaatcaaggtagcaagcagagaagtacccaaggacaaagaaggtgtttttttttttttagtttgtttttagatgcaatagatttgtacatatttatcacctaagggaaagagccactggaaaggaaagcattaaaaatataaagaaaatggggacatttgaagaatgacttatgtgtgatcacaggaagacagcggaatgagtattcatgagtataggcattagatattaggtaggaggcacctgtacctcctgcttgtggggaactctcattggtgcacagaagttaaaagaatgataaatgtttaaaggcatttatatcacaaagatacaaagacagagtagacaagtaaacttattcctcaaaagcacggaggcccccttggagttggagatcatttacttgtagtggcacaaagtggcaccaaaaaaatgcatgcctatgttatgttctccatcactgttccactcacttggtaaaagatagtacaaaaagataaaaggattgaccttgggctggaagtctgtaaggcagatggagaagaataatttgagggaggaggattaaaggatactgcctttataaagatggaaagaggcctagcagtgtaatttgacaggatatgtgaaaaataacaaattaaaggagagaccacaaagcaagtggattgcagagagggataaaggtccatctgagatttgtgaataaggagatgtctaatctatgtccaaatcaaatacatagttggatacttgagtctgacataaaggaagaaatacggactggggttataagtttggtattcatcagcatcaaatagtacttaaataggtgagaatgatatgatcacctagggagtaaacaaagatagaggagaaaggagaaccaaagactgagccctggggctctggagcaccaagacgttgtagagatgagagaagaaggtttagaaggagtacagcagacagaattcttaaattcctgtctcctggtgtacaaaccccaaataatcccctccccttgactgtaggtgggacttaataacataattagatcttactcccatgaataggttatatcttatgggaaagatgtaattaaggtccctaatcagtagatttaaattactaaaaaaggaacttattctgtatgggcatgacctaatccagcaaggtattttattattttattctgttttattttactgagaaagggtcttgctctatcactcaggctggagtacagtagcatgttcactgctcactgcagccttgacctcctgggctcaggtgatcctcccacctcagccccctgaggagctgggactatggatgcacgtcaacatgcctgcttaattttttataattttttcacagagacaagagtttcaccatgttacctaggctgctttcaaactcctggactcaagtgatccacccgcctcagcttcccaaagtgctgggattacaggtgagccactgtaccccactaaaatgtaaaatattctcttcctgggcttgaagaatccaacagccatgttttgagaggtttttgagagggccatgtagcaaggacctgaaaacagccttaggagtgggagtgaccccgatctaatagccagcaaaacaacagaggcctcagtcttaaagctgcaagaaatgagttctgacaataatatgaaagaactcaaagtgaattcttttccagacaaacctctagatgagaaaatacccccgccaacactttgattttacccttgtgagaccctgagccagatttttggccagcagaaactgtaagataacaaatgagtattattttaagccacaaaatttgcggcaacttatgacacagcaatgggaaaacaacactgagagtaatcatagaaaattacgagtgctgttctggaagccaaatgattaaagagggaagaataattaactgttgtcaaatgctactgacaaatgcagtacaatgagacctgcgtattaattgttgaatttactaaagagaaaaattgtggaattatagggtaattcaagaggagatttgcagaagtatagaggtgaagctcaaaggagacaaaaaagtggagggttacctaagttagtaaatgaataaaattaaaattttccaagcatgttcattcttctggagtgtggcatttctgaccaaatgtaaatttaatactttgggttgccttcttgtcttcagaagaataacctcatctttcagcgcatctaaatgatgaataattaaaaggatcctcttgcccttgcagcatttccaaaacaagatgaaaattgagaggcatctgaacaacaaaatttccacaaaaataatgttttcaatatagttcatactttgtgtgttttataaattctccccaacacacacgcatacatacacacacacacataactgtaaattctcctacttttacaactctaattattctgtacaggtagtacagaaaagcaacttgaagatgaagtgcagaaaactatcttcagattaaggagtaatgtattatttctataggctatattcaattaacagaacatttagcataagcaattttcaaacacatacacacacacacacaccccccaacacaaacataaggtaaaatacatttattgcaaagacatacaatcaactacaacagtgtagttaaaggaatgcgtctttctgtagttactaacccagctgaagcaaatgcattttttcctaaagtaacaatcatttattgttaaataactattgtttatgtttatcgaaaaacaatgcagtgtaaagctaatatctctgttcctatttcttagtttatttcttttgaagattggtaaggtgtagagatattgattttattctctaataatcattccttaaactgtatttctgaatgccattacaaccccaggaaaagagagcaagaacaagtttagtgctctgtttgcccatttgtgtagcacaagtggtaccaatttctaataatgtgcctacatttatggagcagccgtttgagttttcagccttgctggaatcgtgttttagttataaaaaggccataccgatgagttttagagtggatatgcgttcatgtgaatctaccctagaagaggaagcactgtgtatccacaggagtctagtgttgaatctaaaaagagaagcaaatggtatctcaattctgagaactgtttctcacatcaaattgcattcacttgaacatagtgaaagttgttttggtgcatctattcccgtgattcagtaaggcacatgctttatcttctcatcataaaaggtgtaaacactcttatatgagtttcctggttactgaaagaagacaccagtgaagaggtatttatgctaaagtgaatatcctcattaacttagtcactgatctactattgtaagaggaagtctatgctagttgtacaataaatacattatgatggaacttatataaaataaactcttgccttttattcattttttgaatgattgttacctcaccttgggagaacaaaatacactctttgtgttgctgttggctggtacagaaagtattggcatgagttaatctaccattgttgtgggtagaaaaaaatactctttttctctgcttgaatcctaagactagttacaagttttcacaacaaataagatgatataagaatagtacttggctttttatacagtaaattacaccagtgacatgtaaaaggtgtagagaaaaaaatattctctgacactgaagaaatatttatagatttataggcacttgtattagtcagagttctaccagatatagacagagatgagacagagatagagataaagatagatagagatgatagagataaacagagatagatggaaagaaggaggaagacagaaagggagagggagggagagagaaaaaaagagagagatttcaaggaattggcttccacaactgtacgggtggcaagtgctaaatctttagggcaggttgacaaattggacagtctcccgcaggaggtgacactgtaatctacactcagagtttcttcttcctcagagaagccttggttttgctcttaaggccattcaactgattggatgacgccaacccagattatcaaggacaatctcctttactaaaagtcaactgattacagatgttaaccacatttacaaaacactttagttagtgtttaattgaaaaactgggtactatagcttagccatgatgatgaataaatctgaccatcataacatccatgacttaaaaggcactgggctagcataaagaagtctagattgagtaagccctcctggggcttagaagctgatagagagaatcatgtttggaacatgacataacaaaatttgttataaaaacagagaggagtctggaaatcaggctgcatatgtaatacacattataaagatatcatatgcctagtacaaaaataacacaaacaggaaaagttctgaat

SEQ ID NO: 10 - DNA, 181331 bp, Homo sapiens
tctgtgacacctagattaaaaaacacactcacctgaaatactgaggtattaagtcacacattttagtctttttcaagaacacatatactgtctcaattccccagctcaatttacacatgtggaacacaattctaaataacatttgcacagaatgtgacttataccatggttgacctgggattcataaccagactcacctattggctgaagggaatattctgagctttgtcaagattaataaaagggctttagtgatggtcaatttatttattttcccaaattagataaactcactttttataccaacaactatttcacttatttacagtctccgaataatgatgaatttttacattctaaaatgttagtaggttaactaaatagtcctgatagatagaagtgggaggaagtaaagaaagagagggtaattaaatgttgtaaatatctcctctgtgccaaatactggggaagaagctcttatacatgttaatcattacaataccaccacaaggtaggaactataatttcagctttacagatgaaggaactgaggcttgggaagctacataatttgtcccaaaatatgcaacttgtaaatgttagagctggaattctaattgtatctgtttgattctaaatcccttgttcataccactatatcctcctgcctctcacttcctctatgtcacatactctccttgttggttaagttcagctcgttagtatagggtcagtggaaacagatttgtctctattcctacaaaacagtgagatatgggtaaaaagcctggtacaaataactctaagtcataacagactaacaaaaaatatatatatgaaattatcacaatgacaaattttcctttcagactacttgacaaacaatatatcctagaaaaaaagagaccacaacacttggaaactaattatccaaatgttgaacagctgactataaatcaaagaaattgcacataacaaaaagtaaaacatctgtaagaggtttttagtgctttccaaaagattccaagtgttgctcagatgtacagtgacccacttcctctcgtgaaaaagcatatcacctaaccaaggacatagcaaagaaagaaagaaaaatatcagattcaaatctatccaaagttgtggctttcaattctaggtaatcagtaggctgaatagtcttgatgatagttcaggccaggagctggaaaacttcctataaagggccaaatagcaaatatgttaggctttgtgagctgcatgttctatgtggaaactactaagctctggccctgtagcatgaaagcagacatagacaatgcataaacaaagagggtggctgtgttccaataaaactttatttacaaaatataggggggtgagccatatttggccacaggttatagtttgctgacctctggcttaggctatacttcttgcctagagtaggcatagaggagattcggttgagttaatgtcatttacaagacaataggctattgatgagaagggaaggagccaacatggggctggaaggaagattacggcattgtagtgatgctaaagttaacaggaaggtcagtctcttcagagaatctgaagggaactatataaatcttacatggactgaagaaagaagaagatgactcctttaatttaaggaattcattttccccattagcaaaatgaaaggctgaagttgaccaatgggttcaagaaaactttcttcagattaagtattgtggagtcccagtatataaaagacattaatccactatcagtctgattaaagctgtaatggggaagctttatcttacaagattgatcctgagtcaattaaaactcccaaatctctccccaggaaatctggacttcacagagtgtaggtcaacaaatataaaggctctttctaattgtgacattctgacgttctatgattatgtgatctttgttcctgcttttaagttatatctacatataccttaaatatatacataaaatattcctattttaagatgtcattatcttttgagggcatcttcagagcaaatatatgttaatcactagatttcccaagaagtaactcagctggttaaatttaacatagtgttactctctctgtgtacaaaaaaatgcccatatttgctcaattattcaagcaaattttctagaaatttaaaataacacaatccaataggcctggtctaggtgtccacgtgaactgattaaatttcagatttcacccgtttagaccttgtctttgtctgtttggctgccataataaaataccataaatggggtggcttaaataaaaaaaatttattttcttaacagttctggaggccgggagtccaaggtcaagatcccagtataatcagtgtctggtgagggctcttttcctggcttgttgatagccaccttttcactgtttcctcacatggcagtgggtatgggagagagagagagagaaaactctctgatatctcttcttgtaagggcactaattttgtcatgagggtgaagctttcatgaccttatccaaacctaataatctcccaaaggccccatcttcaaataccataatattaggggttagggcttcaacatgtgaatttgtaacctgtaagatcagttcatagcagatcttacaggttacaaagagaaggtctgaggggaaaaaagagataactttcaacaattggtgttgaggaaagagatattagtttttctcccaaggtgtttatagaaaccagaaaatagaatattatcttttgcttatctctatctagcttaccatatgttaaaacaattttgctatctttattatttttaactcattgaattacttccttctagtcagatattcaggataagttgtttttgggtaacattacttgaaaggccaaaataaaaattagatgttggaaatgtcactgctatacttggaatggacacattaataggaaacattatcttcaatttcaaaaaaaaattataaatattattttaattgacaaatcataattgtatatactcatgagatataatgtgatgttctgatatatgtatacagtgtagaatgattaagatggatatattaattagcttcatttaatctttaatttctttttgattgactaaatataggaagacctaatgaggtattttttcctccaaaattacagatttgaatcgtggctctcatggtctgcttcaagcaacaagtatcttgattgtgtaggtgttttgcagaagtttcccttatatactactggaaattgagttatttctctgagactggaaaagagactgactctaggttttatagaagggaaatactgcctaggtagtaactgactttgggtttccatcagaggtggaaattatcctgctaataagtttttatctttggtgaatgccttgctccagtttctagcacaacactgggtaccaaaaaaaagcaatcggtataggcttaccagtgttttattgtcaggataaagtctctgatctgagactcaggaccacgtgggaagataacacacagaaacattggatgggttgttatagcaattgttttgtgactagaataagtttgctcctccaaggatagttctggttgtttttcaaaaagaaagaggcagtggggggtggggagggaggagagaagagagagagagagagaggccattttgaccacattttgtcacagatagctatggcactttctacagcagttccttttatatttcattcccataacactaataataaagttttcttattcctcttttaaaacctcacaatgcataatgcatagtcactgcaattatttcaagagatagcatgtacttgcatttaccccattttatcacccacctgaggacactatatttcctattagtggtagtgaacttgatgctattatgtgtaatttcttccagatgagctgtagcacttaactttctgcttcaaagtattgagttgtgcttaaagcaagcctggcttctatacagagatttcccagagcagagaattcaagtctaattaaaacacatcacttccccatcaatattttctctgtacccaaatagtgtcttaagaggtagacaggtatcagatcaagtctggaaataatttttagattttgagtaggcattaataatgacatcaacttatagaaatataacaatagtatgagtgaactaaaaataattcatagaataatgattttttaagttgcaatttaggactttttgactctctgcttcattgcactttcataatcccctttaagttcttcctcttatgttgaaaacagatatgtgaatttaaaagatattttttggaatttagtgccaaccacaggcctaccatgtgcccatatattagacaagttatgtagtttatttctagtcctcacaactccaagaaaaaaagtattacagatatgcattcccttattcaaaacctttggaggcagatgtattccagaattcagaattgtttgaatttttaaagataataaggtgcatatacagcatgttctgtaaccaaatagggtctggtgtagcatttcggaggcaaataaaaaaatatttgcactgaaatataaaagttctcaaagtgagatttaaaaaaaaaaacagcagcaaaaatggcctcatatcagattttgtcaccaaaaacacttgctacacatttgcaaaaaataaaaaaagattttgcaggtttttctgattttgtatttgtgaattaaaaattgtagatgagagagattaaataacttgctcaaagttatgcagccatcttaaacacaagaaatatacatggaaatgtttgaacagccagaatacagttgggttggactcaaacttgggaccatttgtctcaaaagtctatgttctaatagatgaaaagaatgaggcatgccaaatgaccttggggaaggaaacacagaaaaaaatagggatcagacaagagaaggaatggtaggtaactataacatgagctccccaaagtaggcagagagataatgaaagcagccataagaggactatgagctgaatgggaagaagagaatatggtgctgaagctcaatgtactcacatggaaaagatgagaacaagtggattctgaacagactgcagtatggcataaacctgcccattgtaccaaaatgatttccaattgccatagctcctggctatttattaaaatatatttaaacaatgcctaccatgtaccaagcactggggataaagccacgaaaaagactggcttgtctctgcacttctggccccaataattattagctgtgtgaccttagcaaagttattcaaccactctatgcagcaatcagttcatttgtaaaataaaggtaataatatctacgtcacaaatattaaatggtgagaattaaattgtatagtgcatgtaaagagcttaacacagtgcctagcacaaaagatacatagtataccttttagtatactataatagtataggtatacctttggtaaagtataatagtcaatattattataggtattttattcttcaagacaattgacttctccaaccaaaggaaaacaatacacattctgagaatatgtgcagataacaaatcagagtacaaagtaccaaattctggacaaatgtaattgctgttcaatcagcaaccctggtgagtttgctctatttttggcttcagcactaacttgttgtgctaccctgaatgagtcattaataacatctgcttccccttctgtgaattgtcttctgctctttaactcaagggtattaaaggaggctttggggataaatgaaggagaaattattgctccagctaatatgctgctccaaagagaactcttttgaacttgttgattagaagataggagaagtacacacagaaagaaaaaaagcttttcttgcatgcttatacctgaatgaattccatctgtatggatgaccagtgtaagcagaaggattctgaacaatattgcttttctcaattctgccataaatactcattgaaaaatgctgtggtcatttgaatacaactgttattctctctcaagcccaaaatttaaacttgctaagagaactgatctattgcagttgcttttataatatagatttataatccaaatgacagtcatttgtttctggcaacagtcagctgctcaggggttatcaataatatgttttattgacaatcacattctcagaaaaccaccaattgtgctttgcctacctatatgatgtagtcatgcacaggaaaagagtcaagacctaggatatatgcaatgccttgggtgaacaattgggaaagtagctgaaaggagataattaattgaaggtacagtgtttacttatatatttgctgtaaattattagatgtagagaatcgatgtttaaacctcaagtagaaagcagccatcttaaacacaagaaatatacatggaaatgtttgaatcatataactgtggcaccctatgatctatgggatataattcctaaggttttagggcaataaccaaggagcacaaaacattctcatttgtttagaatggaaatggaaaactaaagtcatgcaacaatagcttagtgaatagatctaacatctcccctccaagtatagatactctaggtcagaattttctcatcttccaatcattctccagttttatttaaccacttgcagtttaaagaaaaccctgctgagaattctctttcagtctttgtcattttgttcactttgcatagaacactttcttcattcttccttctcttgatgtcctggttaactcatactttctgtctcagattatttgtcactctgtctgggaaagcttccatgtcctcctaagtgcctctctcttgtgctcacatagcacttcttcctctgcatggtaaaattgtctctacttgtctgtatcttccacttgacaaaaagaaaattgaagagagaagcttagtcatagttacagttgagttctgagagtctatctcagttctagtcacgtaacagacacttactacttatctgcaggatagtgactgaataaataaatgaggctacttggataaaataaatcaaagggctgttaattttctagtttattgtatcaatgtatatcaacaccacaataaaaacttagaatgggcaatattaagaatgaatgcttaaggagtttacagccatccagagagctggaagctctagaccattgtgagattctaactctagttcagagtttaagtatggctataacctcagtgatagaaaaacatgtcttggcagcttatgggtggttttgttgatgagaatgaatagaatgagaaatggaaatctcattaagcttgaaagtatttttagctggagaacattgacattagactgtcagaaaaccaaatggaagtaaattatgatgaacagtaaatatgttagcgaaaatggtcaagtgggatcatgactcaaagaagtgcctacaatttttacccaatcacagcctggttgcccagcaaccactctatgggagttgcatgcatgatgacatattagatcctaatctcagaagtagattgacaagccaaatcattaagtcttgcagtccggcctgggttagttctatcaccttattaaattctgaataaaactcaacctctgcctacacaaaaggtaaggtctgtcaaaagagtacacaattgccatgggtaccctgaaaatccttggatatctttagaatagaataatttaatatgtatacaaattggattgcctgtgtgccatcccagaccctttccgttgtaccagatggtgtgtcagtaatagaaggtaaaacctaggcttgtttcaggagaaagagaaagaagatgtatgttttccatgcaatttgagtttcatcttccttctgacttctcacttttactacctaatccaaaatacaaagaaaacagcaaactgtaaagccaatatttctattaatattttctattaagcaataggagaaaagaacaccttaacagaaaatagacaaaaggacatcaacaaatctagatacaaaatgagaaaacaaatgaataagtgaatgcataaaatcaagttaacacttgttaaagattaacatatgccagacattcttatatgtacttgggttaatacactgtttactcatatgacttagttttatgagatagatactattaatatcatcttcaattttcaggtaaaaaaaaaaaactaaagcacagaacatttaagtaattttctacaagttaaatatctagtaagggccaaaatctggattctaaccaaactgcatgactccaaagacctcattctcaactaagcaatactgtctttcaagaagaaacgaaggagccaataagcatatcaaaagtgcttctatcactagtaatcaaagaattacaaatcaaaccaaacaaatggcaacctattattcaccaattcacctattatttcaaacaataataaaattcagtgtagcatttaatgtaggaaattgctattttactcccaattttttgtttaatggttatcaccaaggaatgacaaaaaaatcggaagtgtaatggttattctccatattaatcagctgtatgtacactttgagtgaataatagagtttttgtattttttttcttggatcctatgtactatgcattaggtggctttggaaaacatactctttgacctactctaagaagtatttctaaagaaataatgagaatctcaggcaatcataaacattaaaaaatattcactaaaacatcatttagcactgtaaaaaattgaaagtaatcccaaaattgggagatggttatgtaactattaaagaatatctaaagaattaataatgaaataaaaaaacactgtaacaagaagaaattagcataatgtgaagctgtgtgtattgaatgaccccaatataatatatccccacatatacaaatattttctacagatagagataaagagaggaggaaagggagaaaaagaagtttcctatgaaatatattaaccatgattactttgttttggatgataaaattatttgtttttattcttaaattttatatataaaattttgtatatattatttataatgcaaaataatttaaaaaattaaaatttgtgctaccctgtaattattctctttgaacctgacttagatgatcagccagaaagctaatctagagatgaattatcctcaattgttaatgctatccagtggctcaatatgtttactactctcatttaatactttagttaaaataaatatcttcaacttcttaaagcagaggagagaatgttttaaaaatccttaaaattaaaataaatccttaaagcaacatagtgctttatggtttacaaaatcctttcccaggaaatacaaaactcatttgaccccaaaacaacttttgaggaggcaagttataatattaaaagttaagaaaatgagcagacttcactgttagatgtctgaggccacattcatcttctttatatccagcactgaactaagcaaatgagaagtttgcctagccaggaacacacttttcattaagctatcagaataatcatgtggtcattctgtgagggatacaacagagagggagaatttccacctttctgatgtagaaaagcagcatagagcacataagctttcacacagactactcttgggattatatgcatagccacctgatcactccatgacctttgcaagttacttaagtcttctaagccttagtcttctcgtctgtaaaacaagaataataacgctcacatctatattgctataataaagattaaataagatgagatatgtaatatgcacttggtgccacatgaaatcatgcatagcagttattgctcagtctgcctcctacttccatcccactcaccacctcattgatgcctgggcacagccttaatttaagcctgccctttttccttctgtattcaagagggcactgagttaagcaccattctgcgaagaagtaaaataaagaacaattggtataaatctttaaaatgcccattttctctagatatcttataactctagacatttgctgaaaagtgttcaaattaatataacccattaaatctcttttgatggtaaaaataagaagctatttaaataatgtatcattcagtcgtatgctcagcttagagactgttaactgaataaaatgtaattttgactgtatgcgaccaaggcctttttaaagctttcatttttattattttctttttaaacatagaacatctggcttgaagatatgcaacaggaaaatgcacatatattttatcttgtcattcagagggctttatcctaagtctgaaagcttttggctagagtgcaaaaacactagagacccatgttgaatagcaagagaaactgaaaggatttcaactcatctttggttccagtagctggcaggaggtacctttctgaattgatttttcaaatgcatataagtcattaagcttgcagatttttaacctttccagtagagtattaataaaccttctgaaaaaatgagacttttgaaaaatcttaagtcatttagattctcaccctaaaagaggagagtctagagacattgacagcaatcttaatggaataagggttcccaaataaactttggatataaggccaattcttaactacttgtatgaataaagaggagagacccaggaaaggcctcatttgagcaactccctaccgcaaaactcttgccagcaagttccaaaattgggctcttttggttacctcatcccttcccacatccccacatctgcttgccttgtatgtagtaggaatgtttaaatgagatatttatgtcaaataactacaaggagaggccaaggggtgattaatagctcaaaagaaccaatcatttaatggccaaatgccactaaatcagagtacctgtggtcagcatggctggttaaagccctctggtgccttgtcctggttcattcaaactgaaatgattctaaatcataagattaaatgtgataaagttcagcaatattctcattttatccttcatgatcatgtttttcttttcatttgagagatctaatattaaatgataaacatctactttttctcatttattttgtggttgtccttgctggtgccctgagcataagtttggtctacatgttggattatcaagtactgaaaaaaataattatttttcaaagacttcaattgtactaactgtgttctagggaaacaaatttttatgatttataaacaatttgttgtgtttttttctcttatttgttcttcacatctcagagcattgaataatagtgctgtgaacttacattaaatattttatataaaagcatataaaatatacaatattatcttactccattttgtgctgatagaacacctgagactgggtaacctataacaaacaagttatcggctcacagttttggagactgggaagtctaatatcaatgtactggcatctggtgagggccttcttgctgcatcatcacatggcagaagatgggagggtgacagcaagaaaaaaacagcctcacccttttataatggcaccaatccaacctttaaggcaggagtcctcgtggcctaatcacctcttaaaaattctacctcttactactgtcacaatggcagttacatttcaacataggttttgaaatggacaaatattcaaaccatagtaaatattatacaaaatgttgatttcttttccttttggtgttattgattgtatttcttgcataatgagaaggagacttttgaaaagttgcatgattgcccaaaatcagtcagcagaagagacagaatcagatcccagatgacctttctaaagccctgaaagtgttttttccactataccacccagtcttccagaaccatgtgcctcaactttgtggtgactgagttaaacaagtaactgcactggttgcaaataatacaaccagtctctgaggtgtatttatgctgcagatagctataaaagagctttattccattaacttaactaccaaaattagttatatttactcataaatataaatataaatgtgtgattattaaatgaagtattgctaatttcccagccagaagaatcactttttagtgttggaaaatactctcttcttgcttttgtctgaactctcagccactttctggctgagaaatcttttgctattcaattagtctaaagatttgaggtgagagaagataaaaaggaaatcagaattttttgctggctgcttctttctacaccttatatcttccctgacataatgcttaaataggaaaagaacacagtagggggacaatgacaagagtatgcaggaggaaaaagaataaaatgtatatcttaaacattatccagccataaatatgtatagatagatagatagatagatagatagatagatgatagatagttataaaaatcagcaaaaaataatacaacagcaagaatatgagttgaaaattttcacaagaaaaaataaaaatataaaatatgtctcatttatattttcaaaataatcaatttcactagtaattacataaatataaattaaacaatttttggacttgtacttgcaaagattaaaaagtgtgacaatatcttgcattgaagagagtacgaggacactcctgttagcagactcctcaaggaaactgaaaagtctgtttgaaaagccttcaaaattttcctatattttgaccccaaattttcacttttataaatgtacctattgaaaaataatcatagaaattcacaaagatgttttttggagatgcttattataaaaacttgaatgttcagcaatagggaattggtttaaataggggctgcagcatgtaatgattttatttttgcagttttagaagtaatgctgatgagttaaaatagaggtagataaaatagtattagattctacccttgaatatttatatacctacaaaaaatctgacatgccatgtaatttgaatggtggttattcctggaagttcattttggagattgttttattttgttctttaatttttaaatttttctttctttttagtaatttctgagtatatgttactttcataattagatatgtattacgtattatagttatttccatttttgatagaaaaatatggaaggaaagagaagatgaaaggaggcagaggaaagtattcctggtaaaattggagtgacatcacctaagccaaagtttttgtcagcaaagagtgttgatgggaggaaatgatcatctgcataaataagaagctcttcaaagggactttgtccttcagctcccctaaagttcttctctatgcctaaagtctattggccaggggctaacatataataaatacattattcccacctcttaccaattttcctggtctttcttcttcagggcttcccacagggtcccaatcccagttccctttatgaacttaaattcataattcacaaaattgcatattgcttctccccatgattcttgttccaggttcatagctttcttacctgccaaaatacatatatttgacctctgctaaatagcaattgataccaatgacctaatacattaactatcactcaataaatattttttgagcaaacatttcattataagggaccatgctaggtgctttgaggagaaaaataaacaaatagcaagcctgatttttatacccaggtttgggagactgtaaataaaatagggacaactaaataatgctagagatttaaaaagctaacaacaacaatggaacctaatgtctgttgcattatgtgttttgggaatcagtgcaatgtatgtttaaagaattagtggtgtcagataagctgagtatttggatccataagacctgagtttgagattcagatcttccactttctctatcaaagtcttttcattcctctgggtctgtttcttcatcaatacaatggattctataatattaatggctttttcataggattgaaacagattaaaaatttacaaaatattgcatccatgaatgtatagttatgattaatgtccttcaatatgctccctcacattattattccccatgtgataggccacttggtcttctccctgccctgggaagagtactgggataaaagccagacataaacaacaattgagtcacaaaagcagccacacagctagacagaatatcagataccatcactgtcccctgaaccttgcaagataatgagtcagttctctgaattgtaaaccaaaaataaaattctaagcctctccaagcatctgacgagattcctccttttggcaaaggcattccaaaactaacctgaaaaactagttcaggacacgatggtaaggaggatgtcagacatgcctcattataccctcctccttttggaattaccgatagaagagattctttaagtctgataagacatatttacaatctattctttctggagcctgctacgtggaggcttcacctgcatgataaaatctttgtcttcataaacccttatcttaacccagacatttctaagtctttagaaaagcaagtaagaaagaaaagttgctaatgttcagctaatatctatttaataggcagtaaaatgcagtagtgtcattttccatgagtcaaaaatattcattaaaactgatgatttataatcattctgcggtaatattagttagaatatttgaccaacaaaaatgacaatgtttaaaaaatgatgttatggtactcctagaaaaaaaattcccagtttgaagacttatataaaggatatagatttgatcataaaactaataatctggcttatattgcaaaactactttacattcaagtattaccaaaatggaaaatgacttaggtcactaaaagaaaatccctttgatcataagacctgccatgaccgcgctaaattcaagcacttgagactagttgattgggctttagaaatcttatctggtaaaataaatataagcctgggatatacagcatattaagtcagatttagtcattcatatcttagattaatttgtcagatcttttcttaaatatagaaaaattttggatgactgatgttcactgtaattctgttaggaagactgagaataaagatgggtgcaaaaacatcctccagtctttactgagtggctttgggatagaaatacttcactaatcagtccagctggtattctaaggatttctcagatcttttctatggctatgccagctccaaacctcttgttccatctgtgggaaggggagttacaggagaagtctgaggattacatgccttttcaatccactaagccaggtcaggtgctgagagcatcccatttgctttctctaggttcaataccctgaaatgcttgactttgtgtgtcttcttccaatcccacagagtcaaataggctgtcagttagagacttgcactgggtatctggttacatttgtggagccaacaggagaggtaaaatgaggctcacagggcacttgaggtgaccatgagccagttgggagtgcattcagaggcaaggggtcctatatatcttgtaggtaggcttcctgattgtctgaggagcaaagtagttaggtccagggcttttcttccctgctgccagactctcctcagcactcagccctgacaatcacctcagtattctgagtggggtgagaaagaagtgaacttcttggtcagcatctcaccctgctaaggtagctgggcacctactcactacactctcacattctttcagaaataaataaccaactaagggggttctctcccccagccatggcagttagctgtgctgccttgaagtgggggtgctttgccctcttcgtgtatctatcctcaaacttttggctccaactgttctgtgcaggagacatgcgaggggagaagaaaaggcacacacacaatacctttatgggtaaaaaagctttatcccatgtaaatggcaatgcagatataataagcaaatgatataataaggaaattatataataagcaaattgcaatgggaaggggagaagggaaaagatatatatatatatttacattcaccaggctatggaggattcatcatcagactggggagcaacagcctgggctccagagttggacactgcactcaccagactatggaggattcaccaccacaatgggaagcaacagcctggggtccagagtcggccactggcccatgctcagacaagtagaggtctcattaagtttcagtacagtctggcaacctagctctttttgtaacgagttgtttggcatgaggcccagtcatgagggcccttcatgactgggctcaaggaacacaaaaagttcaacttgtttttgcgattgcctgttgtttttcaacaactaacatatagaaatagattgaaatagagacttgtctgaaacaatgctggatcaatgtctcaaggggctcatacaactcattctgggacttggtgaccattgtttgtgtccatgttcaattgagttcaaatgtaatatttagcttttcctccacaccaacaccatgctggaacttctccactagactcttagactcccacaggacactctctttcatggatagcagtcaaaatcaatccttctataggtgagggggatgaccatagaaagcgcctattctgctatgttactgtcctcatctcttttttctaattggcatatttagaccacttgattttaatgtaaaacttgatattttaaatctgacatcttattttttgttttctgtttatctctgttttatatttcttttttcatgcttttcatagattgaaaatttttatattcccatttgatttatttaatgtatatttaggtgaatatccttttgtagcttttttagtagttactctaggtattaatttatatatacaaaacttaccacagtctatgatgtcaatattttatcagtttgagtaaagtattaaaaattatcccctttaccttttatactctttactccttaccctctttaatatttataaaataattgtcttatatatttcctctacctacattgagaacgacattaaaatataatgggatgttacagtcaaagtactaaaagaaaaataaaaagaactaccaaacaagactactttatccagcaaagttgtccttcagaaatgagaggagataaagactttctcagacaaacaaaagattagggagttcaccaccactagaatggccatacaaaaatgtgtccagaatttattccttccagtgggttcttggtctcactgacttcaagaatgaagctgtggacccttgcggtgagtgttacagttcttaaagatggtgtgtccagagtttgttccttcagatgttcacatgagtccagagtttcttccttccggtgggtgtgtggtctcgctgacttcaagagtgaagccgcagaccttcgcagtaagtgttacatctcttaaaggtggcgcttctggagttgtttgttcctccctgtgggttcgcggtctgacttcaggaatgaagccacagaccttcacagtgagtgttacagctcataaaagtagtgcggacccaaagagtgagcagcagcaagatttattgtgaagagtgaaataacaaagcttccacagtgtggaaggggacccaagcaggttgccgctgctggctcaggtggccagtttttagtcccttagttggccccgcccacatcctgctgattggtccattttacagaatgctgataggtccatttttacagagtgttgattggtgcttttacaatcctttagctagacaaaaaagttctccaagtccccgtctgaccaagaagaccagcggtcttcacctctcaaaaatgctaaaggaaaaattttaagcttaattgaaaggatgctaatcggtaacatgaaaacatataaaagtataaaactcagcgagaaatgaaaacattaaaaataactataactacaataatttgttaatcatacacacagtaaaaagatgtaaattgtacaacagaaacctaaaatgtggggacagcaaaagtatagagttatatatgtgaataaagttattatcttaaatcaaactgttaaaactacgttttataaaactcaaggtaaccacaaagaaaaaaatctgcaatagattactcaaaaggtagagagaaaggaatcaaagcaaaacactatagaaaatcatcaaatcacaaaggaagacagcaagaaaggaagaaggaatctataaaacagcaagaaaacaattaatagaatggcaatagtaagtctgtatttatcaataattactttaaatgtaaatggatcaaattatccaatcaaaaaatatggagtggctaaatggatacaaacataagaccaaactacatgctgcctgtgagagactcacttcacctgtaaggacacacatagcctgaaaggaaatggatgataaaagctattccatgcaactagaaacttaaaagagaacaagggtaactatacttaaacaaatagactttaactcaaaaactaagaagagacaaaaaagtcattatgtaatgataaactggtcaattcatcaagaggataaaacaacagtcaatatactatgcccctaacattaaagcccctaaatacataaagtaaatattaacatatctgaagggagaaagagacagaaatacaacaattgtagagtacttcgataccccactttcaacaatgtagcttatccagagaggaattctaaaaggacacattggtctcgaactgtactttagactaaatgaacctgacagacatataaaaaacagtctattcacagcagcagaatacacattcaagtacacatgaaacattctccaggatagattatatgttaggcaacaaaacaaatcttgaagattgttaatcttgatatttaagaagattgaaatcatactaaacatcttttctgactatgatggtacaaaactagaaatcaacaaataagaaaaaaaactgaaacattcacaaatatgtggaaattaaacaccacacacctcaaaaaataaatgcagcaaagaagaaactacaggaataatttaaaaaaaaattgagccaaaacaaatggaaacacaacatactaaaacttataagatgcagtaaaaacagttctaagatggaagtttatagtaataaagacctacataaggaaatattatataaaaagatcacaaataaataatgctacacctcaaggagctagaataagatcaaactaagtccaaagttattagaaggaaggaaaaagtaaaaatcagagcagagataaataaaatagtctacggactattgctatggtgatagcaccccaactatcactgttcgtattctctgcaaagttttggttgtaaaatcaagcctccatcttgttttacatcctgagggtatgacttgtaactctggtggcaaggctttgtttagcaatcctatcttagggaataactttctttatggtttgatgtctgcatgttttcctacccctgtctcttaaagggctctacccagcaactgggttttcttgtgcctgtctgtgtatgtgttgtgtgtaatgtctggaaaagagctctagttaatttggcctaaagaaagacaactgcttgcatctaatattttttaaagggaggataaaagctgtggtacttttcagaaataaaagcagccttcaatcttgttggtaaaatgcatgtgtcattaaaatgtaaatagatgaactaaactatgcaggtctgatgcaagatttgctaaatgttttgaggttgcaaactgctttttgggtttttgagaactatctgacttgtgggcttcacaattgcaagacctggggacatatggaactaaccatacccttaattaagaagggaaaccttggctgcacttagcacacaatttaaacaacttaccaggtttcacattaaagttaaaaattgctaagagttaccattataacatgtaattgaaactactggaaatagatttacatgcaaggtatgtaagaacagtaaaatgtgttttttagtaaaaggttataagaaggcatggaaatataaatttgtgcctagtgttaaaggattgttttgagttagataggaaaagccaaagtttcaaacaagtggtggaagaactgtggaaattaatcttgcagaagaggttctctatgcaaacatattaacaaaattcaaaagggttataaaagaattttgcttctttaagacttctgagtcatcattttggcaaaataaatgacttatggtaatctggaattctgtttcataatatcgagtgctttaaacatatttaacaggcttcccaaatgaaaccccagtttcaaaattgtctttcctgacccctgacatcggatacttcagagggcccctggaatgtccagaaaagagaggtaaacaggattattggacgggtttagatacatgggattgacaaaatgatgttcattcttctttaggttacatttttggtgaataaggctaatatatgttccaaaatttatgagaattctaatgtctaagtatatgctatcaatcataattaaggttgttatgttaagttgttgtaaaccacagagatggccaaacttctttgtcaattgtgttgctagctgtaactaccctggacattttgctattcacagacaattgttgtcttgttttaatccttttcaaaagatggttcgtaataagctatagaaatttaacagatcctctaaaatacaggcttctgataactttggaaattgtaacattggaataaaggaaaacatacaggactcgtgaacagctgaaatgttcatgaatattaagcaaaacaagagtcaactaaatggactaaactcagaaactgaatggagcaaatctttctgacttttgcttgaaatattgctgatccttgttatgtttttcagagtcaaagaaacttattttaaactatttatggcctttaattattaagatacactcctagatcaaaatttggagcatgtttgtttctctctgcctgcttcccttagaatttggaaagtatctgtgagtattcttaacttacagcaatatagttgtttgcatcagtgcaataagaatccatctttcttttgcaacagaacgcaattggaaaaactggtcatttcaccaaggctttgactggaagggtatgcttccctttaaggagtcaatctcgacttgcagagccaataaaagcccagtggggagactggcctcataactttgtctatgcagtccctgtacagggttcctgatgtgtggtcagtaatgattgtcactttctaacaggtccaggagctccaagtttatcttgggaccttatgaggagaggatgaccccactcacaggtatttgaggatactaacccatggctgggctcagttttaaaataccttatctgagactccttgtggaacaaagttccatcaaagccaatccaaaaggcctatgtagaaatgattattcttgctgcactttatgtaaataatcaggccaagtgtaaaaccaaagtctatttttcaaacaacccagtcccattatgatttgttttttttaaacaaacatgaggactggagagagtaaaattatattccaaactttctcatacatttgtcattaaattctaaactaactaattgtttttaagttttctcctacattttagactaatcctgcttgttcctgtgaaccaaccagcaatctctggctgcagctcagaaagaacaaaaggggatgggtaatgtagaaatcctgatcaatattctagttctgtgcaattatcctgcaaatcttgccaggtgatggaatacatagggaataaataggatcccatcactcagaggtttccttttggggaagtaagaccaagggagctaaccaaagccagacaccatgcacccaaatcctagcaagcataactatagctaccagttatctgggggtgtcataagacatcctttctcaccctcggaggaggacttagttccacagtttcatcatagcatttggcttatgataaggagtccacgcaactttccccgagacacatttttgtcccagactcaattacaggctttgggttaaagccctagaaagaaaattggatataaaggatccagaggcagacaacaacagaggttaaaaggcacagcacaggggagcatggctgattcctgttgattaagccaaccccaaacttcctgtttcatggataaaggccacattaatatccatggtgtaaatgaggtctagggcactccaaggctactgacagtagcagtgatagaggcataggtgagagcagataattcctattctctaggccttccctgcttcatgtgtgcaagctgctttggcactcatggcgggacctgcctaggtcacagggacttggagatgcaaggatggaagaggaaaagaggacactcttccttttctccctcatgtaccccaggtatctgctaggaagaaaagggagccagggatgcctgctcccctctttctagatgggtagctattaatcttcagtatgtaccccttttgaatacatcctgaaccccggggactcccttaaaaaaatgcctttttgagcttacccttcctattgttttgttttgatacatgttttctaataacccggtttgtctgttcttagaccatcaaactccaaatggtcatgcaaccagagcctctgacgatggccccttctgctgggaacccttaaataggcctctgaggaagctctgactgccatttccccaaaagctctgactgccgtttccctgtcagcaggaagcagttaagtttagtcttcatctttatccttattctcatggcagttagatatacttttttagagcggggaatgagacagccaggtgggagggggtccctggaaaaattctaactgcaccggggtggggactcaggaagttcacgcattttgcagctgggaggagcgtggcccctcctcttcctgcatggaacctgggattcaaacaggggctctggccttgcggaagatccctgtttctctccttcttttcccttttcacccaataaaaccctgccttaatcacacttcaaaccatttgctagcctaaattttcatggccatgggacagacaaggactcagtctttagctgaactaaggaaatgtcctgaaacagtaatatgaatgtatacatgtgataaatgacataaagccatagtgtacatattgtgccaatgtcaaattcctaattttgattttgtgctataattatgtaaggtataaccattggggaaaactggtaaggggtacgtggatcccctctgccctacctttgaaactccctgtgaatctattctttttttttttttttaattatactttacgttctagggtacatgtgcacaacatgcaggtttgttacatatgtatgcatgtgccatgttggtgtgctgcaccattaactcatcatttacattaggtatatcccctaatgctttccctcccccctccccccaccccacaacatgccccaatatgtgatgttccccttcctatgtccaagtgttcccattgttcaattcccacctatgagtgagaacatgcagtgtttggttttttgttcttgtgatagtttgctgagaataaaaaggtaaaaaagaatttaggtcaaagttacttgttcacagtctgtggaggagattcacttgattccttgatcagcatcagtagccttgaacaacaggacagagtcaatcttatgaagagtggcctgaaaagtttcatcatattgaaccttctcctgcagaattcctctaatgaactattaaactacaagaggatacatagcaaaaggcagatttcaaatatattttataagtttgttgtgaagataaagacaaaataataaatgtaaagcctttaaaaactattaagccaagtttagcaagcttttttttgtaaaggagaagagagtacatattttaagatttgtgggccatatggtctcttttgtaaatactcaactctgtcatagtccaaaagtagccatagagaatatggaaaagaaagagcatggctgtgttgcaattgaactacagtcatgcaccgcattacaaagttttactcaacaacagaccacatatacgacagtgtttgcataagatcataatagatctgaaaaattcctgttgcctaatgagtcgcagccatcttaacattgtagcacaattctttactcatatgtttgttttaatattggtgtaaatgtgaaaggaaaataaacctgggagcccccaaattactaagccaaagggtgtcaggcaaacctgtctctcattttattttaaaataactacaaagattttttttttttaagctacatacctccctcacaatttgcccaccatgaaattccttgtgagcctcaaggtcttcaccctaaaacagttctgttgaatttcaccctggcaatgtaaactgatagcttatcttctcaggggcaggacaaaggacagacagaactcagagtcatctctgctcacctgcattattggattgcttcctctgccctattgtttatgtaaaaatgcagattcactgagtcagactaagacacaagtgactattcctctactctcctcttacatgtaaattttatattcagtgaaaggctgattaaagacccaaaaagacctaaaagaatgcaaacttttgtctcttatttacctatgtcctggaagccccaatttctagttgtcccgcctttccagaccaaaccaatgtacatcttacacatattgattgaggtctcatgtctctctaaaatgtataaagtcaagctgtgccctgaccaccttgggcacatgttctcaggctctcctgagggctgtgtcacgggccattggtcactcatccttgactcagagtaaatctctttaaatattttacagagtttgactcttttcatcaacataaacaaacccattgtgctgccagttgtaaaaagtataggacacacaattatgtacagtacataatacttgatgataacaaatggctatgtaaatggtttatgaatttattatactatatttttattgttattatagagtttacttcttctagttacagggaaaaaaaaagttaactgtaaaactgctgcaagtcgatccttcaaaaggtatcataggagatggtagctctatgtgcgttatgcgtggaagaccttctggtgggataagatgtggacatgaaaaactatgatactgatgatcctgaacatgtgtagccctaggctaatgtgtgtgtttgtgtctcatatttaacaaaaaggttaaaaagttcaaaaaataaatatatatatatatatattttttgagacagagtctcactctgtcgcccaggctggggtgcagtagcacgaactgggctcactgcagccttcacttcccaggttccagtgattctcctgcctcaccctcccaggtagctgggattacaggcgtgtgccaccacacctggctaatttttgtattttaagttgagataaggtttcaccatgttgaccaggctggtcttgaactcctggcctcaggtgatcctcctgcttgagcctcccaaaatgctgggattacaggtgtgaagcactgtgcccagccaataaaatatttttaaaatagaaaaaagcttagagaatatgaatataaagaaaatattttgtgcagttgcatgtgtttgtgttttaacctgtattagtacaaaagagtcaaaaagtttcaaaaaactaaaaagtttacaaagtaaaaaagctactgtaagctgaggttagcttattattgaagaaatttctttttataaacatagagtagcctaagtacacagtgtttataaagtgtacaatagagtacagtcatgccgtaggccttcacattcactcgccactcactcactgactcaccgagagcaacttcctctcctacaggctccattcatggtaagtactctatacagatgtaccattttttaatatcttttataccatatttttactctaccttttccatgtttagatacacacatacttaactttttgttgcaattgtctgcagtattcagaagagtaacatgctgaacaggtttgtagcctaggagcaataggctgtaccacataacccaggtgtgtagcaggctgtaccctctataggtttgcgtaagtacacttaatgatgttcacacaatgacaaaaccgcctaatgatgcatttctcgattgtattcccatcattaagcaacatatgactgtacttgcaaaaacagatacaggccgcatctggtctataaactatagtttgttgactcctgccataaagccccttatctcatatagataatacagaagagaaacaggatttcagagagctggcttccagttctgtcactgaccctaatggctatgttgttttagacaatctccttatctcactgcctacttgaactataaaaagaaaaaggtaaacactaagatctcttccaaagtctaaaatccttaattattgattaccctagataattctcataaaacctcctttcttaggttgtagaacctggaaacaatttcatcatcgcaaaccattaaagcttatatttagcacatggatcattgtcatgggatattggccaatgaatatgaataaaatttctttattagaaagaagaagtttatgctaaaaggaaaaactagttggaaaaactttaatggtacagcgaatttatttttggcatttcatattttatcaagctcccatattatgttgaatgtatcaaatgtactcaaatcctttctaattttttaaatatttcattcaaataagtattttattaatgtggcatcattatttcaaagtttttaccctacttaatataaaatattatttggaagaaggagttaaagtatttaatgaaaataaacatataaatagttagaaaatcaaattagctgtcaactattccattagagacagtggtggttgttataatgcttaaggacagaaaagctaataaaatacattaattataaatgtgtttgaatttttaacacacatttaataaaatttataaaaattaaacttttggaaatttttcttaaatacaaacaaaagaaaaatataaaataatgagcattccatcacagaaatagatcaagaaatacctgatgaatgttaaacgtattcttttataaatgtgtacattacataaggatttggatttaccaaagataattccagttttacaagtttataaagtcaaactaaattctacttcttactatgttaactgaaacactttaaaaatgttctatctatctgtagtagtgtcaacaatgaaaatgaagttaaaaataaaaaaaaagttctttgtaggcaggatatagcagagaagagtcaacaggtgctgagacatggatgagaaaaatttaaaacaatagactttttaataaaatgtgaagacatttttacagatttccacagatgaggaacattgcaaacccaaagttctaactcacctacatcatacagttgattattggcagagctgaagctaaagcttgtgagtcttagttcctattcttgggttatttctactctaccactttcagcctatgtggtgaaaagtaacatgaaaacagtaaaatggcaaagcctaaatgtgctatcagctggaaatcaaggctttctttgagacaaccacagaactagtctaagcatgctgcctgaaagagatgaaacgaaagaaagtgtgggaaaatgggaaatgcaaataacactaggcaaagagaatatctggaataattacttgaaacaacaacaaaaactgtgtaagatgagaggactgttttatatactctcttgagagcaaaagaaatataagaggtcttgttcattcatgcagtcattcagcaaacattcttaggacctactacatgatatttgcaggtctgggttctgtgaaaccaacagtaaaccagaaagactttcttactaagcaacagaaaaataacaagagctattttagagaagacagagtatttaggggagaaaggtgcatagtcaaggactggtaaaataagacttgctgaaggaagtggtatttatcttagtcaaaggtttgagttagagttagccattcaaagaaggaggaaaagggaattccaggtgaataagtctttatttgttaccatctctgttgactttactgcagaccctgcaggattagtagatttcatgacaccactagccacctctttataaattctctaggcaggcttagcctctattcaaatctaaatgtgcagccccacagtcctctcctctatctacatcctcacatttggtaactttatccagatcactggctatatctcaccactgagctataaaccagtgtgtccaaccacatgtttctactctctacctgttggttattagacatttcaaacatagagtggcttggctggggtagctctccacatttcttccatttttctccatagagtgtgtaagctctcttggaacacactaatattagcaagaagagccaaggttagtgaagacagaaagggacaggtatttaagccaaacaacaaaagattagcaataattgactatgcattgaaggagaaaaacaatattccgagccaatgaagatcttctctatttttagcttatgttttctaacaatgattatcactataaagcataagtggtatttatttgattctttcttttgtgtgtgtgtgtgtgtgtgtgtgtagcctaaattcttacaaaaaatagactatatccatactcagtaatgaagtaatcttgaaaaagaaacacttatcatcctgtatcactaagagaatgttagtgatgctagtgaaggctccaggtatagccattagttttatttatttatttatttatttatttatttatttatttaattattatactttaagttctagggtacatgtgcacaatatgcacgtttgttacatatgtatacatgtgccatgttggtgtgctgcacctgttatctcgtcatttacattaggtatatctcctaatgctatcccccctccccctatgccatgacaggccccagtgtgtgatagtccccacactgtgtccgatattccccacactgtgtccaagtgttctcattgttcaattcccacctatgagtgagaacatgcagtgattggttttctgtccttgtgatagtttgctcagaatgatggtttctaggacaggaactcatcctttttatggctgcatagtattccatggtgtatatgtgccacattttcttaatccagtctatcattgatggacatttgggttggttccaaatctttgctattgtgaatagtgccgcaataaacatatgtgtgcatgtgtctttaaagcagcatgatttataatcctttgggtataggctcagtaatgggatggctgggtcaaatggtatttctagttctagatccttgaggaatcaccacattctcttccacaatggttgaatcagtttacagtcccacccacagtgtaaaagtattcctatttctccacatcctctccagcacctgttgtttcctgacattttaatgatcgccattctaactggtgtgagatggtatctcattgtggttatgatttgcatttctctgatgaccagtgatgatgagcattttctcatgtgtctgttggctgcataaatgtcttcttttgagaagtgtctgttcatatcctttgcccattttttgatggggtagtttgattttttcttgtaaatttgtttaagttctttgtatattctggatatcagccctttgtcagatgggtagattgtaaaaattttctcccattttgtaggttgcctgttcactctgatggtagtttcttttgctgagcagaagctctttagtttaattaaatcccatttgtcacttttggcttttgttgccattgcttttggtgttttagtcatgaagtccttgcccatgcctatgtcctgaatggtattgcctaggttttcttctagggttttggtggttttgggtctaacatttaagtctttaatccatcttgaattaatttttgtataagatgtaaggaagggatccggtttcagctttctacatatggctagccagttttcccagcaccatttattaaatagggaatccttttcccattgcttgtttttgtcaggtttgtcaaagatcagatggttgtagatgtgtggtattatatccaagggctctattctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcctttttggttccatatgaactttaaagtagttttttccaattctgtgaagaaagtcattggtagcttgatggggatggcattgaatctataaattaccttgggcagtatggccattttcacaatattgactcttcctatccttgagcatggagtgttcttccatttgtttgtgtcctcttttatttcgttgagcagtagtttgtagttctccttgaagatgtccttcacattccttgtaagttggattggtaggtattttattctctttgaagcaattgtgaattggaattcactcatgatttggctctctgtttgtctgttattggtgtataggaatgcttgtgatttttgcacattgattttgtatcctgagactttgctgaagttgcatatcagcttaaggagattttgggctgagacgatggggttttctagatatacaatcatgtcatgtgcaaacacgacaaattgacttcctcttttcctaattgaatacactttctttctttctcttgcctgattgccccggctggaacttccaacactatgttgaataggagtggtgagagagggcatctttgtcttgtgccggttttcaaagtgaacacttccagtttttgcccattcagtatgatattggctgtgggtttgtcataaatagctcttattattttgtgatacgtccctcaatacctagtttattgagagtttttagcatgaagggctgttgaattttgtcgaaggccttttctgcatctattgagatactcatgtggtttttgtcatttgttctgtttatgtgatggattacgtttattgatttgcatatgttgaaccagccttgcatcccagggatgaagccaacttgatcatggtggataagctttatgatgtgcagctggattcagtttgccagtattttattgaggatttttgcatcgatgttcatcagggatattggtctaaaattctcttttttgtgtgtgtctctgccaggctttggtattaggatgaagttggcctcataaaatgaatcagggaggattccctctttttctattggttggaatagtttcagaaggaatggtactagctcctctgtgtacctctggtagaatttggctgtgaatccatctggtcctgggctttttttggttggtaggctattaattattgcctcaattggacttagttttgaatggttcttccactccgttatctgaatacacatagccaataaaatctcacagcaatttgaatgaatcattatgaaagcaaaagacaacaaaatggtttgctattttctttgaattcctaggtatatgaccttgtacttcagtcaaaataatctatttttttaacctaaccacatccttcactgatggcattttgttgcatatacaaaatacaataataaaaagagtgagtagttcaactgtaagactgatttataatgacagtttttcagatacaggggaaatgaagaattgagcagattctgtgaagtgaaaattcccaattatgttattcccttgtattaattaaacaggtgctaggtagttttcagagtagcacctctgagacttgtgttatgcagaattacttacagttgttaaatgttatgctcttctcagtgaaagcactaatacaaatcctgattgagcatctattaggtagaaagtacagctcctcttggactcccttgaggagataactgactaatcctcaggcaactcttctatttccccaaatctttgttcattaagaaaaaagtccactttggagtccttccaatgtttatcaaatatgcttctgacaaacttactttctttaaaaatcttagcccatttcaccactactgtcttattatatcatttccttcaagaaataccttcactgggtcccacatacataacagaaatagtccatatttttagcctaatatttacggtcttccaaacattgaacaatctcaaccatgcccatggcttaaactattctgtttgtgaccaaaacctgcagcttttgacaaaacttcatatctgagctccagaatctaagaacctgatcaagctctttctttctttctttcttttaggtggaatctcattctgttaccgaggctgcagtgcagtggcatgatctcggctcactgcaagctccacctcccgagttcacgccattctcctgcttcagcccctcgagtagctgggactacaggcgcccgccaccacacccggctaattttttttgtatttttagtagagatggggtttcaccatgttagccgggatggtctcgatctcctgacctcgtgatctgcctgcctcggcctcccaaagtgctgggattacaggcgtgagccaccacgcccggccgctcttttcttaaatatctggtggaggcctcaaaatcaaaatgtctaaaacagaactcatcatcaataaagccattcgtccatttatattctctgcttctttgaacggttatccagtacctccaaccagaagtcaatagcttaccctggagtcttttttatcattacctttcgtattcagttcgtcagcaagtatgtctaaaatccttccattcttcctgcttctctgttaccaactgtgctgcacagtgtatgccctaccacatctcatctggataatttataatagcttcactaatagttgcttttcttccagccatgtctccttcccagtgagatggttcatacaatcatggaattttatctttctaattcatacattcgatcacatcactatcattttcaaagtttctttatggctcaccatcactctagaacataatctaaacttctttgcatggctgacaagacattttttgatctggcttcttgcctcctctcctgccagccttaacctctctcccatacttccctaaacattttattttccagttctcataaaatgcctttactcactcatatctccatgcctgtgcacaattacgttcttctttgcatagtaccctttcttgtctatccatcaaactctcatttataattcaaatctatactcagatagtacgtactgtataaacttcccctgactcctgagatcttagaatctcctttccctttatacattaaatatatttaaaatataataattatatttttataatgatatatgtcgtttatgcagtatgtctgtctcctactaggctatgcattccttgaatcctgcttgtacaactttgtatcatcacttaggaacacagtcagactcagaacttttaagaaattgacttgagtgaatgaatttttcagaatttttaagaaattgacttgagtgaatgaatggatatataaaaataagagtgagtttgactgaaaaaagataaggaattattgttatttcaacagcttaccagcactaacgctcattattccagtaggctaagttgccttggaaaactaatgtttgaatccttccttcctgttaagagtttttaaagtcagttttatggcatttcttgtagacagaggcaggggtaacacaggaagaacagaggtacaaaaggaaaatgagtttttctttgatcaccacgaaaagtcccttacatttcaatcatgcttgtatctctgccaagggtcaaggtgaatgtctgttattattgatgaattattttaggtcatttatcagtcacacatactggctggatttcataaacagcaaaagaaaagtttgaattaggtgaggaaaatgactaagcaaatgtatatcctcctgtgaaggtaagaaccaactccgagtttgcaatgcatcaattccaaaattggaatgctcctttttctgttttacttagagactttcccactgcaggccccaattgaactctggaagacacaacagtacagaagatctgagaatagatgccaaacacactgagccttctaaactcacacgaacaagaccaaaaataaaaatatgaaataaaatagaaaaaaagaggaagtaactaataccctttatgtcaccaagctagcaggtccatactacataaactcaatgtatttattcagctttctaaaacttacaatttttaagatgtcacatgtcgaatctgatactgtagtggtagaagagacctagacactatgtagtgtggtgcttatcagatcataatctctcaagaatctttggattctgatgtgatgcctcagggactaaacttgggagagcaaggaccagcttccctaccatacttcaattcaagcagcaatctttttatctgtttcatttgtttgtttagtaatgaagtcccatgcaagattttatttggtgttgataaaataattctttataaaagttaaaaatactgtcatctattctaaattccttgatttatagatgaggaatccaaggctcagaatggctgcataataactcaagttggtgtccaatgagtagaatctgcccaggtcttctaatgctcattacaatggcaatggtatacctgggcttgagttttagagcccaagtacctggattcaaattaccactgtcacctgactttgggcaatttatttatcctttttgggcatcagtcttcatctgaaaaatggggttcatattggtacatacctcatagagttgttttaaggagtaaaggggttaatataaagaaagtgtctaacacatagtaagcactcaaaaatatcaccggaactgtaatataactattattctattttaccaaactgaaaaacttcagggttaggcagtgtgttcgtttctatacaatgttgttgtattgttgctacagcaaattactaccaacttagtggcttaaaataacacaaatttattatcttaaagttactgcagtcagaagtccaaaatgggtctcactgggctaaaagctagatgcccgctgagctgatttccttctggaggctctaggggagaatctcttcccttgacttttccagcccccttcattccttggctgtggcccctttgcccatctttaaaaccagcagtgtaccactattcagagtctgactctgactctcacgctcctgcctcctctcaatgctttcacttacaaacaccctttgtgattgcattggtctcacccagataattcaggataatctccccatgtcaaaatccttaacttaataaatctgcaaagaccctgttgccatgtaaggtaatatatttatatagatatatttggagaatcattattctgtctatcataagtgggtaatgtaaatatgcaaaacagctttgtataagaagagggagtggtgtatactgcataaaccttacctaaaggcaattgtgtgtgtgtatacacatacacacagaatatatgtgtttcatagatatgtgtgtgtgtgtgtgtgtgtgtgtgtgtatactgttgccttatatatatatatctctgtatataatactaggctagtcaaactaatatatcctagacctgatttgactgaggaatctggtttgggatccttgccctatgtcattccattatgtggttagaccaggtctatataatctaaagcaaagaggaaaggtggtgattgcctgagtctctgctatgtaagcatcctagataattccagatattttttcagagtgaaacaaagtgataaatatcctcccaaattcatgcagtctgcttcctacttgctttaaatacctggatgtgggaaatgacccagtttttatctacctttattgactatttcaaattaaactctttagcagtcaataacaacaggagtcacatcaacagctgcttcatcctacactctgattttatgtctctcttttagccattacacctggttgacttggaaatcctccagggacaacatctgttatcgctgtctcccttgaaattctggcccatggttgtttaactgcaaatgtggaagaaaatccaaactgtacttgtttctgttgtctcatggctttgtcaccatatgtcaaatcaaattacacttcacagttgacagttgaaagaaatgaagaaatagtcagtgcaaagataccttttttgaccattagagaacaaaaatataaaacctgttgacttatctcctttacaagaggacctcaaaaagttcatgaaaaaattgaattaaaagataagaattttaaatacaaactttatttctcaacataatctccaacaagttcaagacacttttgtgagcaatgatgtcacccatttagtctatgcctaaaggactgagagtgttcagaatttaagcatgccaattcagtcgtttttacgttattaatggaagaaaaaatgggtgccatttaaaggattttttagtattaggaaacaaaaaggagtcagaaggagcaaaatcagaactgtaaggtggatgcctaatgatttcacatcaaaactcttgcaaaattgcccttgtttgttgaaaggaatcagcaggaacattgttgtggtggtgaaggatgctgtaataaagctttcccaggcatttttctgctatagctatggcttcctcaaacactcttaaaataagtaaacgttattgttctttagcccttgatatggtttgggctgtgtccctacccaaatattatcttgaactgtagttcccataatctccatttgtgtcatgggagagacccagtgggaggtaatggaatcatgggggtggctatctccatgctgtttttgtgataatgagtgagttcttacaagatatgatggttttataagggttttccccctcacttcactgtacttctccttgctgccaccatgtgataaaggacatgtttgcttccctttccaccatgattatatgtttcctgaggcttccctagccctgcggaactgtgagtcaattaaacctgtttcctgtataaattacccagtcttgggtatgttcttatagcagtgtgagaacagactaatacagccctttaaaaagtcaacaagcaaaatactttgaacatccccaaaaaactgttgccataaccattgctcttaattggtctgtttgtgtttgattcgaccacgcccacctcttggaggccattgctttgattgtgcttggtatttagaattgtactggtcaagacatgttttatttcttgttacaattctttgaagatatgcttcagtatcttgatcccacttacttaaaatttccattgaaagctctgttcttttctgaagctgatctaggcacaacagttttgacatccattgagtgaaaagtttgcttaactttaattttttagccagactgcgtaagctgaatcaattgaaatacctctgatgttggctattgcttatgctattaattatcagtccttttcaattagggcacaaacaagattaattttttctttgcaaatcaatagggttggtctgtccctgcaggcttcatcttcgacattgtctcatcccatcttaaaatgaattatctatttgtaaaccgttggtttctttggggaattgttcctataaactttttgtaagcatcaatgatttccccattcttccactcaagcttcactataagtttgatgtttgttttgcttcaatttcagcagaattcatgttgccctgataagggctctttatgaactgatatcttatccttcataatacctcaaactagctactatttacacatgttataacaagttagtatgagtttattttgatgcaaaaattttgaaatccatgcataattttttcatagtattcattttctgtaagctttttgaagaccccttatacttggtatgattgttatcattgccaatgtggaaatcagcttttttaaatggttatcagaaacctcgtctgagctcacaattcagttcctaaaatgtagattagtctccataaacagaagtgagtgagaagcatgcaaggcaaggcaaccaagtatccttgaggtgctgacactgaaggaagggtgaggaagaaataacaagcagggagaagagaaatgaaaaacagaaaatgaagttgtcatgtgtccatatgtatggtatggtgggtattcatagtggtcaaaagtcttacataaaagaaggaaaagatttgtcctaggccatgtctgcctactaaatattaataggtaaagacctactaacagttaaaggtaaaagaatctgaaacctgtggaagtcattaccttactgactgtgagtttatgagccattgtttatccagtagataaaaggaagcaacttttgccacatgccatatttttagaaaagaagcaaactcttaagtcttactccactgaatcagttcttttgtcactaaagatatattgacatggccaccaaaagcagtggaaagatactggtataaatgagggtgcaatggttgttttattaactctcagatagcatatacatttgctattgctgttattacaaattaccacaaacttagtgacttaaaacaatataaaaatctatagtttcagaggtcagaagtctgaaagtagttttagggagctaaaaatcaaagtgttggcaatcctgcattccatctggaggcactaggggagatctgtttccttgtcttttccattttttatggcctactagcattccttggcttgtggctccttcttctgtcttcaaagcatatcatttcaacctctgccttggttgtcacccttcctctttctgacttagaccatcttgaccccaggggtctaaggacccctgagattacattggaccaacctagataatccaggacaatctctttatatcaaaagccttcacataatcacatctgcaaagttctttgtgccaggtgaggtgatatgttaacaggtactagggattaggacatgaatatctttagggggctattattctgctattatttagggggctattattcatagatccacttgtcaataaagaccttatctagaatttacaaactcaagtgcccacagaagatagacaagtaatagaagtgaatgagaaaaaccaaggagtggtggaaactgaggtaaattagagagtgaatagcattctaaagcattcacaattttaataacatatgtagttaccatgtggacaaaaaaaaattgtctctggttcatgcctacctatttgcaacctttattttaaaccaaatatttgctccgaatgagcctcttctgccattataaagtgagacactttctgttaaaatgtctacatgcactctgcagccaattacacacttacatatatagaaaaggttaaaatacaagaatgcagtaaaaaataaccagaatgtgatttagaggcatgtgttaactgaaagacccaccaagaactaattggaaggaaaaggccaggaaggaaattgaccattacaggaaatacaggataaatttctttaaagatggtgatcctgctcccagcaggctcagaaagacttctctgatttagaggcaaataagagccagctaagtagtctgcaaggattaatgacccatacatttttgtaaacagcaactgtgacagtctagcacaagttccaaagacacaggcaaggggattagcaaagtcatgtttctgatggactttctcttgggtttctgttaatccatgaggtttgatatgtgttgtaagagaaaggagctgaacataacattttaaagatctattgagtatttggccacaataaggactaaatcattaccattttaaaagtcccaggttagcagacatactctgaggcctgcatcacaatcagaacatatatcagatcttataaacatttagatcaaagattaagattataaagaaaaatttccaggaaattcagtgtccatgtccacatacacagtattttttttttttttacgtgtagtggggaggaatgaaaagatacatagtcaatgaaggaagacaactgtggcagctcatgcaccaggagagctgaagaatcaattaaaattcatgtgagaaaggtgacatattattttattcaaaaccaaaacaaacaaacatgaactttcgcttatgcaagagaaagctctacgcttatatctaggagaaaggagttgaaacaaagaaagctaaatttattttcacacaaacaaaaggtctttttctctctttgtatgtctctctctctctctctgtcttctatttttcttttctttctctctcctgttccctgtgtgtgtgtgtgtgtgtgtgtgtgtgtgtttgtgtggagagagagcaagaaagaaagatagagacaacaagagagagacagaattagagagagatagagaaactgttttattgaatgatctgtgctcagtaaaggtgaaaatataaattagcattttgttgttgttctatgccactgccttccgataagtattgtcaatcattttcttgcctctggatgaaatctcagaagcataaaatagcattatccatcactgtcatatataagtgaatgctatcttttgatacaaaatgcccagtttaggccagactaatatcgaagccttattctcctatataagtcaaaccttcttcccggtcatcttgcatcttgggcctgatttagacttggagatatgcagtagagatgaggtgcttaatcagcttctgagctttgctcttatttccctttctttctactctctaggctatctctgttttttccagaaatagagaggatgatgggagaagagagatgaggcagaaagtttttacttaactggtatggttgtccctgacattggtggccaccaaaagtgctcttccttctctcttcctctctctttctctgtctgtctctttatccctccttctctttctctttcacgagggccctctctggggtcttcagaaaccttcattactatggatctctcccctgctattcacttgtcatgaaacacgtcacctctgccatttctagatgattattcatgatgtttccctaagtcccagcatctagtggtccatctcacacatacttcctctcatgggatcaccaggccctctcaggctatcctttagggcagactctttcaagatggcctaatttcagctcctacattagtttacatctgatccatatctagaagagcaggccattttgaattcagccctgtaccttttctttcttgctacaaatggttccctttaggttctttactatataaattgtaggtgtaaatcaggttcctaagtatcagtgaggacagcccaagcttaccagtgagtttctggaagcatccctcagcacatgtgaagtaagagttaaagacctctctcctctgttcttttatactctcctgtggtcacacacaatcttaatatattttgtttcagatgatctagcagctatgatagtcagtgttgaattccctcctggaacttctagatagagcgaaaagccatagttgatatcctgttacatagataggtagtttgacagatgatagagaaataaaaagatatagagacatagatgtccaggtgtggtgagctgtctgagaaataataaattggagcccaataattcaaggaagagatgagaaggtagagtagtagattccaacaagaaaacaacagattggtactaagaagagagctgattaataatggtgtggaggcaagaaacttagaatagtgatgactggtgtttaatttttagttacttttggatctgggcagaaacgcccttcattatcccccaaatcttcaggacaatctgtcaccaattctataaccacactagcattgacttaatgcagtactgctttggataataaaaaaaaaggcattttcatttttacataggagaaggaacaagaaagagttggagcaggcagtgcccaatgaggtaatggtgagaggttctcaatgactcattgaaagtaagaagttacaggcagctttaagtcagtgttagcccctcttcttgaatacctgcaaaaatatcaagagtcttggacttctggttatttcagttggaagcctgaattagttctcataaatttcaaacaaggtggtgcctccagaaggctggagaacttggaggtgttcaggatacatatgactaatatagtatcccttgtttcttaagccttctaatgtaaatctgtggttagagtatctgatcaaacttcaaaatcttccatagttattgaaaaatggaaataagacaacacagaaacattctaaagatttaaatccctagaataatccaagtacgaactatacattattatcacaagtcgcatatttcattaaaagtgggagagttttgaggctttgattgagcaattttctttccctgctgtttgagcctctgtgattttagtgttttattccttgaccccttcacttcgttgctgcaagtttccttacccaaagcacatgctctcaatctcattttttcgatgaggaagggattattactagacaaaagcagagggcaggacaataatttgttttcccagtactccagaagtctctcacataagtcctgctttaagctaacgggcagtgtgcagagccaagttgaatcctgttatgatgccagagcaggctgtgctgggctgagctgcaggctttgctccctgtaggccaagctcttataccttctgtggtgttattatatatatatatatatatatatatatatatatatatatatatatgtacacacacacacacatacatatatatacacacatatatacatatatatgtgtgtgtgtgtatatgtgtgtgtgtgtgtatatatatatatatacacacatatatatatatataggttttcatccacagttcctgagtcatagctaccatagcccttgttacagtcttttgttattaggttgggtgtgttaggcctcaggggcaggactcaggaaaccgaatctctttgaccttctcctgtcctcctttcacctgcccaaaggccggactctaatattgctccacctttctcattgtaggtcataaggccctcatttcagagaggctcttgccccataccctgggagaaagaatgctgatgtcaagaattttccataaaaacccaagaggattgggttccgagagcttcaggatagctgaacatgtgcaggttcctggagggtgacatgcccagggagggcatggaagctccatgtcccttcccccattcctctttccccatacctcaccctacacagctctccatctgtatcatttgttttgttttgttttttgagacacagtctcaccttatcacccaggctggagtgcagtggtgtgatcttggctcactacaacctctgcctcctgggcacaagcattctcgcctcagcctccccagtagctgggattacaggcacccaccactgcacccagctacttttttgtatttttggtagagatggggtttcaccatgttggccaggtgaatctatgatctgcctgccttggcctcccgaagtgctgggattacagacgtgagtgaccgcacccggccatcatctgtatcatttgtaatatcctttataataaattggaaaacataagcatatgtttctctgagctctgtaagccacgccagaaaattaatcaaacccaaagacaggggcatgggaaccccaacttaggccagttggtcagaagttccagagccctggatggacttaagactggttggggaggcagtcttggggattgagccctcaacctatgggatctgacactatctccaggtagatgtatcagaattgaattggaagacacagagttggtgtccactgtagaattaattgcttgctttgtggtaaagagaaaccctcacacatctgttcacagaggtcttctctgtgttgatagttattgtggtagtggtgtgaaagcaaaaggaaatcacagtttgagagttttttcccaaacaccttatgttccagagccttgcaggttgactcattaaagtcatgctcaggctcacccaagtctgatttgtaaaccagagaattaatttgctaatttacagtgattcagattcagctgccatttgttttgagcacgttacatgtcaaacactgagcttgaggctttctcaccaatgatctcatttaagcctctcagcagcagtcagtagatgtccccagaggaaagcctattcagaaaaatgaataaggtttataaagtttcttagaaataccaagccaaggcaaagagaactggatgatctgtggagattatcttgaagtaggaggatgctcttgaatctttgctctctacatatatctgcttacgggtcagttcctagcaaggaaacccagcctcttcctcactgtctttgctgaacccccactaatcaaagtcttctcacatttttcagtatttcatgctgccattttgtgccttcctatggcatcttattccctcacttacaactagactgcttctctagaaggaatctagacacagcttgcttttcttactacagtagaatgtcctccatctcctaaatagatgcaaaactctttcttgaatctgacttatatcactttctacaataggagacctgactatttgtttctggggaaaatacctggagcttttctgcacctatgctgacaacaaactgtgtcctttctgtagctccaggcatggcatgaaggtgtgggagggagcagtggcatagagagattcaaacttttatagctataatcacataagaaaaaactggctcatgtgtataagtttggtattttaatttatttatttatttaagtgtttatgcagtgccatgcattgagtatacagaaatgaataaggcacattgctctcaaagaattcattgtccggtagagaatacaaacatgtaaggaaataatttcaatacagtgagctaacggttaattgaaatatggacatggtgccatcagagaattgaggttgaggaaattgtgtctacatggtcagggaaagtctcacagctaagatgacctttaagaagttttaaattaaggacagaagttcactggacaggaaaaaggggggcggtgggaggaggcatgtggaggaatgttaaggaaaagcattccaagcagaagggacagaagcataaaacagcataggaattttaaaaaggtatgagatattggcatgcctatagcaatttatatgagtggaaatgaagctgagagttaggcagggtcttatcaaaattgactcctattattaagattagaaatttgaattacattcagtaaacagtaggtattgaacttaagcaatgtaatgtcatttgtgtttttaaaagatgacttttatagtattacaatttggagaagttattttgccttgtaactgataactaaaattaatatataaatggtaatatttgttttaaggaggtttttaattttatcccaatgtgtttaaaatgttattttgataatattatagttattttgtaatatattttcttcccttattatagtcttccctgacatacccacaacttaatatatagtataaacctctgttgtagtgggaagagggctgaacctagaaacagaaaatggttctgagaccctacccttcttctttctggctttgtgtccttgggcaagtcacttaacttctctgaaactcaagttccttatcagtgaaagggggatattgatactcaaattctggtttgttttgaggattaaattaaagaaaatgtgagctatctcttggacctaaaaggacttcataaaagtatagaaatatatatgtactctctatatacaattttatatatgtataagttatatatttttatataaattatatatatatattattgtataaaacatatatatttatttttctttccccagggctctccttcaggaatttcgattcttgatatccatgatgaagtcagatgatatttaagaaaccctactgatcctgacctggccaacttagatgtctgcctttcttttctgcatgaaaccattaagactcagagagtgataattagtgatgaagctgtaactaaagtctggactcctagaacagtgtactttcattaattcagaaatggtctagaatggcttcataaacagcaagctgaaaccacattcaaaattacaacttacatgagtggtattaatatgtatggaatagatcttgatgccttgatccaaaggtactgacttgctatttgaataaaaggggaaatctgatggttagagagggtaacatatatcccaactccttttccccttgatggaagaagttaggtctcttccttactacaaactatgctgtaaactcttaactatttctggtgccatcaagtgattaaagattgatttgcttgaagtgaaagcatcctaattgaataataatccagttaagataaacaataaataaccaatattgtctttgtggtggaattttcactagcaagactctagataatatggcaaatacgtttttaaaatgcagcttttcaaaaaagtaaacaaaaccccacttttgtgtttttaaattaatttttaattaattttgtgtttttaaattaagattcaaaaactagattgaatagagtaagtgaatttaagtaagatcattcaggtggaaaaggggaaatttctttgctagtctataataaaaattcagagtaagaagtttgattttggagaaaacggtgggatagattctcaaatcaatctcctgaggaaggaatagcaaaaatacaaagagaatgtatctttaaaaaactccttgggagaggcttcaggatggttgactagatgcttattagatctggtacttgcctcttccatgaagagaaactaaaatagcaaatacataatcacacttcaaatagatcatcaaagagtgaacactagaatttaataaaaaaatgacaggaagcactgaagcaaggaaggagagaaaggaaagacagcctgtttggctgtgattggttaggagtctggagaagctccctaatgaagatgaagggcaagtgaggggcccccagaactccaaattcccaccacaggctcttataatccaagttacagtagagcccctgaacctttatggaccctgggactaacataaagagctagagagcacgtgaaggcactgctccagagagagagctcacacggggtcccacacaccccaactcctaagcagctgtgctccagtgccattttgagagccaagtccccaccagactgcatcctgcctggaggcccaatagcggctgcatctttgcatttctggagctccattgatatccttgtctgctgcaactggggcctatgcaagagccactggcagtagtcctgccctcctagcagagggcagtcatgcattttcatgcaccctgaggacaaattctgctgcccacaatcaccactgctgtgtgctgctttggggctaaagctcaagcaaagtgcatgccccgcaccgccccccccacaaaggcacctgcctatggttgctccccagtgtcagggctgcagtgcagccactgctgcctccaactgggcactccaacaggggcctggggatcacccaatctctgcctacaacagccagtgcctgtttgcatcactgggatgcctgagaacagatccacctggccaagctccactccccactcagtacccagatataccatccagggtcttgagaattgcccagtccagcttaccacctttggtacctgaacacttctcccaaggtctgtggtcaagtccactgaacctgccactaccaccacagctggcacccaatgcatgcatcagcaaggagtctggagattggcccaccaagctgattgcagccatcaacatcatcagcatggatcagttgagtcccaaagagttgtctcaccattgctacagccatcaaccatgcaatgcctaatgcctattgcctactgcctaggggctcaagaacctgtccacctacccagtccactgacaatccctggaacctgagaaaactgcctagaagttcaagaactgtctttcctgaaccaactaacatcagtgccagcatgcaccaccctggagtttaaggacagacacattcagcttactgctgccacaactagtacctgaagactgccccatctggtattccagtcccgagtaaaactttaccacaacctctactaacaactgcaccctaagccactgagaaaatcacaaacactattgatgctgttacaactaaagaaatcatacagagactacatactgcacacacccagaatcaaatcaaaagtgacctacccagccattaccataaatacatcatcaggaaaaatttgtctcacataaaagcaaattcaaaaattggaagaagcaacaattacatcatgtgcatagatatcgacatacagacacaagaaacatgaaaaaataagaatatattacacactcaaagaaacacaataattctccagcagcaggttgcaatcaaaaacaaatttacaaaaccccagaaaaacaattcaaaatattgatactaaagaagctcaatgaaatacaagagaatactgaaaaacaatacaaataaatcagaaaaacaattcaggatatgaataagaaattccaaagagatagatatcattaaaaaagaaccaaatagaaattctgaagctaaataatttattaaaagaaatacaaaatacattcaaaagcttcaacaataaactagatcaagcagaagaaagaatcccagaacttaagtccttttcaaacaacccagtcagacaaactgaaaaaaaaaaagttaaaaagattgattaaaccctttatgtcatatggaacaccataaattgaccaaatatttaaaatttttatattcttgagggcaaagaggaaataaaatctttcccagacaagcaaaaggtgagagaattcattacagctagaccagtcctacaagaaatatttaagggaattctattcctggaagaaaaaaaaaagctattatgtttcctgatattttcatattatattatcatgaaaacacacacaaaaataaaaaccaccagtagcacaaacacacaaacaaggaagagaaagaagctcaaattttatccttatagaatactaccaaaccacaataataaacaatgagagagaaagaaagatacaaaagatatataaaacaaccagaaatcaattaattgaatgacaagactaagccttcacatatcaataaacttgaatgcaaacagattgaacttttcacttaaaagatataaactgaatggatttttcaaaatgatctaactatatgctgcctacaaggaattcgtctcacctgtaaaggcacatatagacaaaagtaaagagatggaaaaagatattccacagaaacagaaactaaaagcaggcaggggtagctatacttttataagataaaacagactttcaatcgagaacaataaaaagagaaaaagaagggcattatataatgataaaaagattagttcagcaaaaggatacaataattctaaacatatctgcactcaacaatggagcacccaaatatataaggcaaatatgattacatttgaagaaagagaatacaataatagggacttcaacaccccactctcagcgttaaacagaatatatagataaaaaattaacaaagaaatgttggatttaaactacccattagaccaaatgggcctaacagaaaattagagaacatgtcatccaacagctacagaatacagagctagaaaagcaagaacagaccaaaccccaaattagtagaaggaaagaaataataaagagcagagcagaaataaaatagagaccaagaagacaattcaagggatcagtgaaaataaaacttggtccttttgaacttataaacaaaactgatgagtcacttgctagactaacaaagaaaaatgagaaaggacccaaataagtaacatgagaaatgaaaaaagagacattacaaccgataccacagacatacaaaagctcatccaaggctattatgaacaactatacactaacaaagtagaaaacttagaaaaaatgaataaattcctggacacatacaacctaccaagattgaatcaggaagaaatagaaatcctgaacagaccaataacgagtagcaagattgaatacgtgataaatactgtcacaacaaagaaaagcccaggaccagatggcttcactgctgaattctaccaaactttcaaagaagaatgaacagcaattcttctcaaaatattcaaaacagtcgaagagaagaaattctttctaatttgttctataaagccggcatttctctgataacaaaatccaacaaggatgcaattttaaaaaagaaaactacaggacaacatccctgataaacagatgaaaagcctcaacaaaatactagcaaaaaatccaacagaacttcaaaaaataatgcaccatgattaagtgggatttattccagggatgcaaagatggttcaatacatgcaaattagtaaacaagatacatcacatcaacaaaatgaaagactaaaatcatataattatctcaatagatgcaaaaaaatcatttaataaaatttaacattccttcaaaaaactaggcatagaagaaacatatcttaatataataaaggccataaatgacaaacccacagctaacatcatattgaatgggaaaattctgaaaccttttccgcttagaactggaatagacaaagatacctactttcaccactcctattcaacatagtactggaagtcctagcaagagcaataaggcaagagaaagaaataaaaggcatctaaattggaaaggagaacctaagtatttaatacattttggatatttgtacctgcccaaatttcatattgaaatgtaatccccagtgttgaaggtggggcctggtgggaggtgtctggatatgaggttggaaccttcatgaatggtctgctgataagtgagctctcactctgagttcacacaagatattttcatttaagagtgtgtcacctccccctgcccattctctcttgtttcctactgcttttgctattcaatgtgcctattcctccttcaccttctggcatgattgaaagctccctgggccttcaccagaagctgagtagatgccagcaccatactgcctctcaagtccacagaactctgagccaattaaacatctttacaaattacccagtctcagatttttctttatagcaatgcaagaacagcctaatacagtgtccatcatcaaatgaataaagaaaatgtagaatatatatatgtgtatgtgtgtatacatatatcatatatatggtcaaactggactactattaggtcataaaaacaaatgaacttaaatcatttttggcatcgtggacagaactcaaggtcattatgttaagtgaaataagctagatagacaaatttcccatgttttcagtcacatgtgggagctaaaaagttgacctcataaaggtagagagtacaataatagatactagaggctgcaaagggtctgtaagttggggggatgatgaagggagactggtcaatgaatacaagcatacagttagacagaaggaataaattctagtgttcataacagagtagaggtattatagttatcaacaatgtattatatatttcaaagtagctaaaagagagaacttgaaatgctctcaatccatagaaaagataaatactcaaggtgatcaataccccaaatacccttgcttgatcattacacattctatgcatgtaacaaatcttaactctaagtggagctctgaaactgcttttgttttatggcatttaccaaaccttttattttaagttcaggggtatcatgtgcaagtctgttatataggtaaactcgtgtcgtgagggtttgtgcagattatttcatcactcaggtgttaagcctagagccctttaggttttttcctgatcttcttcctcctctcaccctccactctcagttaagatttcatgtttatccttagaatttaaactggtaatatcttactgtcttttcaattcttgtgtgctcttgaacaatttttattttttaaatttattttatttttattctttttatggaaaatttttattgatacatcatattttatatattatacattatgggtacaagtgatattttcttacgtgcaaatttctgactttttggtttgatcttctaaaattgaaaaactgaaatcctgaatgaaaggaaactgagactttattttgttaactttcattttaagttcaggggtaccatgtgcagttttgtacgtagacttgtgtcatgagaacttgtacagattatttcatcactcaggtgtttatcctggcacccattaattatttttcctgatcctctccctcctcccaccccccacccacaagtaggccccagtgtctcctgttcccctctatgtgtccatgtgttctcatcatttagctcccacttataagtgagaacatgtagtatttgttttctattcctgcattagtttgctaaggataatggcctctagctccatccatgtttctgcaaagggcatgatcttgttcattttatggctgcatagtattccatggtgtatatggaccatattttctttattgaatctaccattaatgggcatttaggttgattccaggtctttgctactgtaaatagtgctgcagtaaacatatgcatgcatgtgtctttatgaaagaacaatttatattcctttaggtatatacccaattatggtattgctgggctgaattgtatttctgtttttagctcttttaggaatagccacactgctttccacaatggttgaactaattgacattcccaccaaaagtgtttaagcatttcttcttctctgaaacctcaccagcatctgttattttttcacttttctataatagccattctgactggtgtgagatggtatcttgttgtagttttgatttgcatttctgtaataattagtgatactgcatattttttcatttgcttgttggctgtgtgtatgtcttcttttgaaaagtgtctgttcatgtcctttgcccactttttagtggggctgtcttttttctggtaaatttaagttccttatagatgctggatattagaccattgtcagatacatattttgcaagaattttctttcattctgtaggtcatctatttactctgttgacagtttcttttgcaatgcagaagctctttaatttcattagatcccatttgtcaacttttacttttgttgcaattgcttttggtgttctgtcatgaaatctttgcccattcctatgtccagaatggtaattgcctacgttgggaatgacagaatcttaataacaaatggaagatgttaaaaagccatagataaaagaaagattactttcaaagaggcagtagttagactgtgaggtaacttctcaacagcaataatagaagtcagaagacagtcagtccaatgatacattaagttggctggaaggaaatagacaacaacctaaaattccaaacccaggagaaaatatatttcaagactgacaacaaaatgaacattttttcaggcaaacaaaacaagaactcccccctcaccaaaaggaaacatacaatatgcacatcaagtagaaggaaagcgatccgggatggaagatctaacatgcaaggaggaatgaggaacaaatatcaggtggtaattatgcaaacttgtcattacccttgttctctgtttttcattgtggctgttaagaaatttctattcctttgaagtcaactgtccttattctctggataattttaagacttctctttgccattgttgttctgcagtttagttataatactcttgagtgttgatttctatttatttattttatttgctacacatctggcttcttgaatttgtagattaatgtgtttcaacagttttggaaaagtttctgcaattatcttcttaaaaatgtcctctgaaaatattgtcaacacattattgtgtgatgcatgatcagaaaaagtacatgtatgcagaatatattaagaactattaagtatgtaatacaacaatccaataaaaaatgaacacatgatttgagtagacacttcacaaatgaagatatatgaatactcaatgtgtatatgaaaagtcatcattagtcatcaggaaaattaaaattaaaacacaattaaatacaactacacactcatcaaaatgactaaaattaagaaactaaccacatacagtactagtgagtatacagagtaactagaaccctcatactcagttggaaagaatataaaatattaggaacacatcggaaaacagcttggcagttttttttaattaaataaaaccttccatatggtacagacactccacttcttggcatttacccaaaataaatgaaagcatatgtccataaatacttgtgcggatattcttagaagctttatttgtaacagtgaaaaactggaaacaatccaaatgtctgtccataggtgaataaagaaacaaattggggcatatcaatgcaacaggatattactcagtaataaaaatgatgaactacttatccaaacagcgatattgatgaatctcagaatcatgacacagaatgaaataagccagattgaaaaaaaaaaaaaacctacatactgtatgattccatttttataaagttgtagaaaaaacaaatgaatcaatagtgacagaaatcagataagtggttgattgcaaatagaggaagagggaggactagattacaagaggcatgagaaaacttttggggttttggcaatgtttgatatcttgattgtagtgatagctttatgggtatgtacatgtgtcaaaattcgttattgtatgtcaattatactcaaagacctttttaatagcaaaaaacagaaccagtcgcagaagataaataaagttggggaaaggtaaattatggaattatttggttttactaaattacccatcctcagaaagttaaatgatcaatgaaaacctttcaggcattttggaagcaattattttctgagagtttgacacagtccagatattctgcataccagacaagagatttctcatgaacaatcatttttcaaaacactaggatgtcttaagattctattacttatattcaatctattgacataaaattagaatatctcttctacctcattttgcataaaattgccagtcctttttttgaagcaaagaaaattattgaagcaaagaaaattgtccattatcctagatatccaccatcaattattttttaaatttagttgtctttaaataccgatttataaaaataaatgtgatgtttgtcaattcagtagatcaataaattggaaggctgattatatattcaagcacagttaacatattatttgttttctctttttaataggaagaatgttttaattcaaaaaaagcatcatgtgaaataggtgtagtgcttcttttgagctggtacattttggtaagctataatttggtaattataattcaatgtcttaaacattaaattcaattgttacaatttattaaataatgttcattttcatataaccaatattttaaaataggtttagcttttgtttacatgtgtgatattgtaatacagcaatgatatggtacactgtaaatgttaaaaataaatcatattgcgatgttgtcagatatatatgcacagattacatagttcatgtctctttataatggcagaaaaattataaataaccacactataaatttgaatgcaaaaaggaaattccaatgactttttctctctattattgccttttggaaattcaattaaatgtgttagaatttcttactttgtcatccatgctttgtaaactcgtctccatactttaatctttttgtctgtgttgcatttccagtaatttcccctcatctatcttcaagtttacacattttatttcaggttgtgcctaagttactgttaagtctactctttgagtttttaattctgtttaatgtaattttaatttatagaatatctagttggttgtttgaaatcaatttggttactttttattttttccttttccctctagatgttttcaagacgttcttttatttgtttagaaatataagtgttttgtaatagatgtttagtaattttaatattggaatttggccttgcctgaaaaatctagacaagggcaggtctcaatttttctccctcccctgctcaattgcaaggcaagccttttaggactcagagttgggtgaaagtcagccttacatccaggtcactcttgttctgtgtatattgagctatttggggatcccagcttaatgcagggagagtgttctattagacttcatatctgggttctagaattttatttttgtttccttaacctcttgtggctgtttacatcaaaattcaggttggcaaattacctccaggcaagagcaattctgatggtcagtttacttttctgggttttcactcttccttcagtttttaaccagataattctttgctattttaccagctttttgataattttaacaatatatatttttaaatgtcttcagcaacttatcttttcggtgtaaaaaaaaattatttttggtatggtggtggggaggaaatggcaggctaagctaaacacctggcctgtcactagaggaaattgaaccttgcaatttgtttgaacaatttttaaatgtaacagacacacacacacacacacacacaaacaatttatattgattggcttattttgggtattgatggagtcacttgtgtgatttatctgatacatcaatgaagacagttataaatagaagaataacaattttcaatcagttatttgttgtcaaacatggaacatttgaccatttacaatctgagagtaaaactgcacaagagaaacatccaaggaaattaattctctttttaaggtcatctataaatccagtccccatagcaacacaagtacttatctagattccttcctttacactatatattttgcctagtcatttcttttgcaattaaattaattgcttcattgttaatccaactttcactctctgtcctttcaaaacattttaaaaacaagctgatgaatggaaaagtaaaacattgttgcagagctagttatttataagcaaataaaatcaattgtgtctgaaatgtcaataatgtataaataagcatgtttctaaatttaattgttaacttttataagatgaatggtagcaacaacaatgtgatctgttatttattcttcctgagtcaaactaaatattttacataaatcagccccttctggataatatttacattatactacaaatattgacaatgactagaatttaatattttaaaaatactcatccaaacatacaaatgcagggatgggtggttataactggatcagtagttgtgtcactccaaatcacaaatctcttgttttccctcttgctaatctctactatcctccctctttaacccatggctatgaaaaataacaaaaggagtagttcaaatcttcagatagttctttctggtttccttgtagctatatattttaatttgcctcagacttctccaaatcagtctaaggaaacacaaagtgatataagtactacatagattagatttagatatagaggtataatcttttccccctacagaactccaaacatgctattctccatttaggaatgtaaagcaacccacaatcgtctgaagaaagatacagaactcaagaattcatatagtcaaaagctggacagatctggattcaaatctgattaactgtgagaccttgggcagctgttgaaattctgcatatcagtcagaggttggttagaaaaacagaatatgcttgagatttcaaactgaaagggatgtaatacagagattggaaagttaccaaacctttgggatgagtgataaagcaaggatcagggaagtcattgctagtgttcaaaaaatcagtatgaataagaatcacaggaaactgccacttcagaatataatgacacaaggaagtcattcatcaaatcttacctcagttatctctgcagtccacgtgttcatgccactgactcgggaataatagtggcttctcctcttgcaagcaagcttgttggcagaatatataaagtggcaactttctggtagaaataaattctaaggatataataccctgggttttcaccctctaaaatacaagaaaagagaaatgggaggaatgttgttagatttccaacaaaaaatctagcatattctagataacccagtgtcttcaaataaaaaaatactgtcaagactaaatcaagattgtggactgagcatttgctccaatattccttctgcatcaaatcccttaaagtgagagaaaaggtatatatgcaaacatgcatacatatctattcagatatagatgatatagataaatatatagatgatatagatactgataaagcataacaggacaggaacacagaaattatgaagtctttaaaagataaaaagctgacaaaatcaaattgataacaactatgacaaagtcatatcaaacaagttcaagaccatatcactgcaaagactgaaaacagattctaaattggattgaagtgaaaaagcagaaaagtggcccagaaaatcattagggtaaattaattaaagaactgaagtcaaaaaaatgagaccagacctcatcacccttgtgatatacaatagacagcaagtttttgatgggtttttatccatctgtatttgcaatgctatattatttttttcattatcactttttaaatactttttgtataatttaataaattttgatattatattttgcattatctgagtttcttgtttcagcatcagttaatagaattttttaaatgtgatttaaaaatgtgtggcattgcttttgatagtgattacatagttaaacaaaaacatcttttacctgtcataaagctttagttaaaagctactggggggcagcgtttcacaattcaagcaaaagggatgtgtatgtgtatgtgtatatacatatatagaaatatttttatatattataaattatatataaacatgtatatattctgatacatttatgtacaattttaaaataattcaaattatagtccaaaaataaagtcagaataagcttttttttcttctttttttgagacagagtctcgctctgtcacccaggctggagggcagttgagtgatcttggctcactgctacctccacctcccaggttcaagcaattcttctgcctcagcctcccaagtacctgggataacaagtgcccaccaccacatctggctaattgttctatttttagtagaaatggggtttcgccatgttggccaggctggtcttgaacacctaacctcaagtggtccacccaccttggcctcccaaagtgctgagattacacacttgagccactgcacctggctagaataagctcttaaagaaaattaaagattatataagaatgacacatatacactttagtttgattagctcttaatactatttcaagactatctactgtgatgctggtgtacaattttcttgaatttagatacaaaggggagacataaaaaggggcacagccctaaaggcattagcaaaagatacaagggctctgcttcctggaattgtgttgtataaagtcagaacctcctggaagcaggtgccaagacaggattaatgatgaaatggtgtttattaggagaaatgcttgtgagaaaaaaatggaaaggagccaggaagggctggaaagggcatcaaaccacgatgcaagcttggctttaagtgaaggagagagagggaaggaagtcgggtagaagtgtcctaaattatcatgcatctaagaaacgtttgtcaaagccattggggaatactcagctaaaattcagccgagaggaggcttgtgaaccctcaggaatggaactatattagtattgctgcctggctcagtggttggctgagacgcacatatgggaagcaagggcaaatgcatgatggactcagatgcagaagttgatctctagtcgcttaggttccccgaatttggaggttcgccttatgcattctcatgtccatcacataaagaaagggacagtctgcaacagcaggattgctttctaaagaacgttttctttggggagtactctgaaacctttcttcaaatgatgacgtactctgaagttcaggagataattctgaagtagactttgattttatgcgggagaatgtactctattcccatcatcacagcttgtcccttggcttacataaatattttgctcacgattcaaggaagttgtctaaagcaacttaaatgctaggccaaaataacctgtttgtctctcattaaaaagtttttgttttagaagttttatgggttgaattgtatctcataaaatgatatattacagtcctaatactcagtacctccaaatgtgatattatttgtaaacaaagtctttatggaggttatcaagttaacatgaagtcattagagtgaggactaatccaatatggctgagatccttatcaaaaggagaaattcagtcacagggacagacaggtacagagagaagatgatgtcaagagacaacgggagaatgccacatgaaggtggaggattggagtaatgcatctacaagccaaggtatgccaatgattgctggaaaactaccacaagctaggagagaggtgtttcacagtgggaaggcctatgcaaacctataccaaagaccgagaaagctgagaggctgaagagaaaggctgacacagctactttctcagaaagaaacatttattcatttgttatatatatacatatatattgttttaaatattttcttattttaaacttttaggctcagggctacatgtgcaggtttattatataggcaaattacatgtcatgtcatgggggtttggtgtgcatgctatttcatcacacaggtcataagcataggtagtttttagatcctcactctcctcccactctccaccctcaagtaggccctggcatctgttgttcccttctttgtgttcatgtgcattcaatgtttagctgccacttataggtgagaacatgtagtatttggttttctctttcgtttagctcatttaggatagtggcctccagctctatccacgttctgacaaaggtatgatcttgctcttttatatggctgcatatattccatggtgtatatgtaacacattttctttatccagtctatcattgaaggacatttaggttgattccatgtctttgctactgtgaatagtactgtgatgaacatgcatgtgcatgtgtctttatggtacaataatttatattcctttggttatatacccagtaatgggattgctaggtcaaacggtagttctgtttttagctctttgagaaattgccacactgctacattcccaccagcagtgtataagcattcccttttctctgcaacctcaccaataagtgttattttttgactctttagtaataaccattctgactgatgtgagatggatcttattatggttttgatgtgcatttctctaatgattagagatggtgagcattttttcatatgcttgttggctttgcgtatgtcttcttttgaaaagtgtctgttcatgtcctttgtccattttttaatgggattgtttggtttttgcttgttaatctgttgaagtttcagatgttagacctttgtcagatgcataattagcaaatatttttcccattctgtaggttgtctatttactctgttgatagtttcttttgctatgcagaagctctttagtttaattagatcacatttgtcaattttggggtttgatgcaaatgattttggcaactttatcatgaaatctttgccagggcctatgtccagaatgatgtttcctaggttatcttccagggttttataattttaggttttacatataagtttttactccatcttgagttgatttttgtatactgtttaaggaaagggtccaatttcaatcttctgcatatggctagccagttctcccagctccatttatatactagggagtcctttctccattgcttataattgttggcttcattgaagattagatagttgtagccatacggcctacatgatccatttttgttccatgatctatgtgtctgtttttgtaccagtaccatactgttatggttactgtaaccttgaagtatagtttgaagtgaggtaatgtgatacctcatgttttgtgatttgggttcttttttggtgccatgtaaattttaaaatagttttttcctaattctgcgaagaacgtcgttggtagtttgataggaatagcattgaatctgtaatttgctttggtcagtatggccattttaacaatattgattcttcttatccatgaccatgaaatacttttccatttgtttgtgtcatctctgatttcttgcagcagtattctgtaattcttattgtagagatcttttaccttactggttagctattcctaggtatttttattctttttgtggttattgtgagccagagtgcattctggatttggctctcagcttggatattgttggtgtattgaaatgctactgatttttatacactgattttgtatcttgaaactttgctgaagttgtttatcagatttgggtaaagactatggggttttctaagtatataagcatatagtctgcaaatagagtttgatttcctctcttcctattcagataccttttatttctttctcttgcctggttgctctggctaggacttccagcactatgttgaataggagtagtaacagagggcatccttgtcttgttctgtagaaagaaatattcagtggggtcttacaaacagaagtcatgcctgtgtcttgggtagtatgagacaagatggtggatcagggtttataaatcataagggaggggtaattcagaaggaatacgtaggacagtagaaatctgataacatcaaaattgtttgacttaagggcaagatttacagtaaatacatgctcttacacaagggaatatagataaactggaaatctcagaggcaattctggaataggggttaattagaagccaacatggcagattggcacccaagatgagtttagggttgccctggcctgcacaagaagtgtagggcagattctccttcacagccccagaaggaaccaaccttgtcgacaactcgattttggacttctagcccacagaatcatgaaacaataattttttttgttattataagccacccagtttgtggcactttgctatggcagtcccagaaaattaatacaggaggggctactctcaatgaataaaggaagcaataaaataccttacataatttcatagaatgttagcgctgaaagcagcctcagagcaataacgtcaaaagcttgattcatatctcactagcatgctaaaagaatcacccacgttggccacacaatgaataaatattctagttcttactctagaataatgggcacatccatatacttactagtaacaaattaagtttagtgaacattgatttgcaaattggatatttgtaaactaaaattagagcactattaggatttactgagtcttcttttgaacaattaatctgctacctgcttgataagtctgtacgtgcaggttttgaaattcctgaaatttttagggggagttactactgttaacatgtaataaatcatagtgagttaggatggatatggttttcaattgttgctctccttgcattaatgaatagattaggagaatagttgttacaagttttattttaaaaaaatattgatcactggttctttaatggttagatgttctctctaaatctttttgtaatcactaggttctttttccatggaagactgggagcaaatgggataggtaggtcacaggaccttgtgtcccatctaagcaggttactatttttaaaatttggtaaacaatcccagagtctcacttccacctcttttctaactctttcatttctattagtgaggaaactaaagacccttgtctgtttttgacatgtgaatgaatggttgacttcatcttactatcaaaatatttttttttgttttaataaataattgttgactgatttcaaaacagcagagatttttaaatataaaatattatttgacccaccaagcaataaagtggatactgctattgtctcacttatacagataagaaacctgaagttcagagacatcaaacaagtcacctgaaatcacattgttagaggtaaccaagttaagattttaccattgacaagttttcaaagttcatgtgcttattcgctatgccagtgtgcctcaaatcaggcatccatggacctccaaggtcaattgtctttttctcaagggtctgcaagtctaggttttttttccccctcattttggtaaatgcacagcctgaggtttagctggatgagcacctcgcagttgattactgacaggtgattccagtattcatatttgcattagttttacaaccaagtacacaccaagtgaaggccaaatgaggttggctcttgctgatggatgacaggtttccaacagtttgaacagagaaaaagctgggaggcctgaatcatcccatgacaaatattagtagagtcatgccaattgtaaataatctgcacagtagctatgtctcatgaaagttatcttcaactctaaaaatctataatcctgttggattaccatgccatttagggtcaggcaggaaatggatggcataagaaaggagaagaggacagagaatttaacagacttttacaaaagtgtaagcaaggataaaaaaaaatccaagtgagatggagtagtgcaagtaatggtgagtaatggtgagaagcatggaggggttggagagagagttattgctacaatctggggagagagatagctatgacctttagtagagggacataaccaggctttggggacaataaagagagggagccagaagaaatactaccccgtcctcactcttattcctgtggagcaccaatctcttgctggtgatttccaccttttgaacctaaccagaagccagaggacaaactgcctttgatgtggttcacacaggttagcttccctggggcacacatattgggttagagaatgctgaagagtagacctggtggagcaaatgaagatatccagcctgtttctataaaccaatgatgtattgtcttatcctaataataacattgatgttttattttctggaaagcataaatatttattaatctttattattgaatgagaataagatcctaggcacatctttcttcccacagttgcaagaagataaaatggctctatcaagtttttttatttaaacaaaagagtctgaaattttatgtctcccttaaattaacaaataatattctcattcatttgcatttcagttttttgattggaacatcaggaggctgagttaaaattagagtaggcacttgtacgtaaaagtgtatcttccttgttaactgtttcaaaataaaaggctgaaaattgctattagatgacaaatgatttcacaatgacctcaataaaaagtccttaactctgttttaaaaattaaattgctcaaatggaatggagtgaggaaagccatactttaaaagtaattattgaggaaaagacctagtagtttcaatgaacacaaaacttgctatgagacaaaatatgacacaactgattaaaaaattcaatgcaatcctaggccaaagaaaggttaaggaacttcagatcaagggaatcaataattctatgaggctttgcacattcagtgacacctagaatgttgaaacccagatagagggatattggcaaaatgataaccaggtgataacggatttcaaaactaagttatgaaaacaatttagagacactagaggtataaagcctagagaagatttaagaaaggtttgatatagcaaaaatcttaagctttatggcagaggaattagactggctccatgtggctgcagatggccagattaggagggttggctataactggcaggtaaaaagacttggactcaacacgggaaagaatttatgggaaactagagatgtccatgggtagaaagctgtgtctcttgaaggagaaggctgaagaggagagtgaaccttaacagtattgaaagatatgtaaaatgaagtcatggttggattgaatgatttctaaggctctgtgctctgtgatttgatgacaagagaagatattgaagctgatgccagattggagtaactagcatggaggaagaataaattaatgagtttttgattttaaaaaataaataaaaaagaattgagaacactaaccaggaatatatctaatggtgcaaaaaagagaaataaatagggaaagggtggaaaagtccacaaagatagtagaagagaaactgtattctgaagaacagggaaagtataggaagtataggaaggaaaatatatattgtactactgagggggttatttgtctgaaaaagtactcaaaacaattatttataatgttcactttatcacttacatgttatagtttctgacagcagacaaacgccatagagaaggtgatgttttttctatatttttatgccaccatacttgaaacagcatccagaagtaaaaagaaagcagaaaaaaaaaatgcttttttttgtctcagaaacactggatgactatacatataaactgtcaaagacctaattaaggacattagaaagcatatttttaagcagaacatttcaggttttcagcatctttatatctccaaatgtgtaacagctgttatgttataaaacctattcaataactgaaacatcactcttcctcagtaatttttggtgtcactttaaattgtaatgaattcagaaattattgaccaatagtcaattattttgttatatatatgatgaacaatatgaatttaatatcaaataaaaattaaaatttgcaagaaaaataaacaatgtagaattagattaaaattagaccccatattggaaattgtaaagcatatttaaaaataatgagcattaaagttggttctttcatcttccaggatatgatctgagaggttggcatttcttccttggtccttgagataaaaggattctcaaccagaaaactaaaggataagcaagaaaagagatctttgggcatctgtgacaagattctttacccatctttggaaacttataaagaaaatattagaacaaagaagaatgaggaaggcacaaaacagttccagaacttctaagcaaccaaaagtaactgaaaagtcaactgaaaatagtagtagctattttttctcatattgtaagaatccagttagctcagaccaaaggaaactccttttaaatttagagcccacagttgaaacctgtgaggtcaaccaactgaaagtaaatacatgattaaataagaatttccacagttggaattgtgtgcaaagatgaatttgacatagtacctttcaaaagggcctttaagacagaaaagcaacacaaactctccttacagggttgatgacagttagacagaaactgtatgaaactcagcacaatgagaaaagttcattaaaggaaaatcgagaaaatgattagtgttgactgtgagccttgaataatgggcagaattatatccagtggaaatagtagaaagagatagaagaggttttttaaaaaataaaggcacacagcttgaaacgccttgtacgcagaccagcctcttcctcagcaccccagggagcctcctgatacccctagccatgcttttggatctaatatccctaaatggatattccagtaacattgattgagcttgatttaacttgtttccaaagaaaacatgagaaatttccttaggccagctgactaaacaagaaaatgtttcttctactgaatatttaaggccacaggaaggtagaagagtactaaggtctgagttgccaatatgctattgatacatgtttcaaggatcaaggcatagaaagaagggccacaactctgctgggaatgtagcctgagcaaataattaaatagatcaaaattattctaagtgggaaaattcggagtgacaaaataaagaggttcactgaaacaaaggaaactatgtcactgaaacaatgaaaaaaaaaaaaagacaaatatatcatccgcctccttccacacaaacgtctcaggctccagccaattgtactgaaatacactcatttagtcaaacaggatatgcaaaccattagcaatcaatcaaagaggttggctgtgacaagtctctggcccacaaagccagacttcaaattggaaatttttgttccctcaaatacaatgagttcccaaaaccagacgcctgtgggaggtgacttaggagtactttttacagcttaaaccttagctctagcccaaaggctaatacagatgtggttgtagttcattccttattaaagtcttcaaatatactatcttatttagggagaataagctactgatccagttccaggagaacatgaaatttaaggtggttttcacccagaattaaccattattgtacaaagcaaatcacctacatcaccaggacccttctgtagattttactaggttgttgggacatgactatccactggttatgtgagtggcctgaaaccatggctaattattgagtgcacacagtattccaggtgctgtgctaaggactttatatgtactatgtcatttaatattctccagccactgatgtaatcttgatgatattctatagatgagaaaactgagacttaagagtggctaagcaacctgggaattcacatagttgctaaattggagcttacatggagcttacatcctagtaggggaattcagacaactaatatgcaagtaaatgtgaaatatgttagatagtaataaatgctaaggagaaatgaagcagagaaagagggatggaaggaggactgtctctattttttatagggtagtcactattaagataatgcattagtaggtatgacgacaagccttgcagatatctggggaaatatcattgtagacaaaagcaaaggaaaatgcagaggctctgaggggggaatatggctgatgtgttgagacagagcaaagaagctcatgtagctggagcagagtaagcaagaaagaaaggctaagagaggagtttagagctgaaacaaggcctagatgatgcaagaccttgtaaattacaggagaaaatttgtgttttactgtgaataactagtgagaacattgaaggctcttgagcaaagaaatagtatgatctgactcaggctgttatgttagtaatagattacaatgaagacacaggaggaacagagaggaggctgttgtaatctaggggagaaatgatgatggctgctatgatctgaatgcttgtgtccccctaatattcatttattgaaaccaaacctaacccccaatgtgatgatactaggaggtggggcctttgggagataactaggctgtgagagtggagccctcatgaacaggggatttgtcccttgtaaaagaggaacaagggaggttgttttccctttccaccaccggaggactcagagaagaagacgccatctaccaagcagggagcaggccctcctcaccagacactgaatctgaaaacacttgaatcctggacttcccagccttcagaactgtgagaaatttctgttgtttataagccatgcagtttttggtaatgtattgtagcagcttgaacagactaaaacagtggcatagactaaggtaggagcagcagggatggtgacagtgggtcaattctagatacgttatgaaggtagaaaggaaaaggtgtgatggttgctcagaagtcaagtgtgatgaaaactaggctggaggctgactttaaggtttctgactgaacaataggaaggatttattggcatgcaaagttcaggacaggaggaggtaggaggcagttggaaattaggagtttgattttgggcatgataaatttgtgcagtctctctaagttgattaggcaaatggatataaggttttagcatttaggtaagcatatgaattaaagatatacattttggaatcatatgtgcatagataaataatatataaagtcatatgtctggatgagatcacttttggagtgaatgcaaattaagtaaatagatctgagaactcaattcattggcctaagattggcaataatatgtttatcactaggcccatctcatcagatatatgactaccacttcccataatgtacttgaaacttctctacccacctggaaaactcacagactagctctcaactatgctttgcctatgagaatcctcacctaacatttaaaaatgttgagacacatgcacacacacacacaacatccttctgttgagaactgttagagattatctcactgattctgtattttggcaaggtcagggcaatgaggaagaatcactgaaggatactgaaaaggagcagtgaattcagagaactaagagagtatgtgccaggagccaacaggtaaaagtgttcaaaaatgagagaatgaaccattgtatcaaatattcccgatgcactgataagaaaaagataaagaaaatctgattggaatgcatccaggagagaatgggaagagaagaacaaaagataaaagagtcaaaatgactgctccagtttatactcccactagcagcctttaagtgatttcttacgattcatagcaaaagaaaaaaccctccctctaaggcatccctgcatatggtgccactgaaaaatgtctacatatccttgacttctgacttatacacacccattctgcctagagcacagcttcaacttgaaataatgtcctgttttcttcctattcttcagccattaattacatgcacccaattactccctagcagtaatcaaatccctctaagtcatttatcttacaagagttaccccctttgtgtatgctgattaattttatgtttaacaatgtgaagctgcttcactctgagattatctagattgaaacattacctactgcatttttcagtcttgcttagttagacacagttatatcaatccaatcatactcatttgttgaaaatgagggtatattattttctctattttcacagtgaatcacaattcttgatgaacatattcctggcaaggcacaattctaaagcctatttgaatgcctaatagcattttaatctgttagatggttgattctttcagtagcaatgaaaacctttcgtaatgtcaagaggaatacattgattttaaaaaatcgttttagccctcatttccctcaaaactttatgcctgttggggatatgttttcctattcccataggaattaataactaggaccagatctcaattgtttaatcatgactttgttttgcaaaagaggaaactgaggtccgaattttgtgtgtatcaagacatgtacaatggtgggtaattctgtgactccggaggcaaactgcatgcattagaactctgcctccattctccttagctgtatcacttggatcaagtacttctcatccattgaatgggcacagaaatgatgcttagcttatagagttgctgtgaaattgagtgaaatgatgcaaagcttttcatatggtgattggaacataataagcatgcaataaatatagtctcttcttacatactacacagaaaagcagaatctgctgggcgcaatggctcatgcctgtaatcccagcactttgggaggccgaggcgggcggatcacgaggtcaggagatcgagaccatcctggctaacatggtgaaaccccgtctctactaaaaatacaaaaaattagccgagcatggtgggggtcacctgtagtcccagctacttgggaggctgaggcaggagaatggcgtgaacctgggaggagtagcttgcagtgagccgagatcgcaccactgcactccagcctgggcgacagaacgagactctgtctcaaaaaaaaaaaaaaaaaaaaagaaaagcagaatctatttaccagactttgctcctctttcctctgagccaggacatcttttaaacctgacacaatagcaaagcttgtgccatgttggtcaaatcatattagaaggggaaactagaaatgagaatgtgcatgaactctgtgcttaatctagtaataatttcattttaaccagagaaacgtttctttcatcccaggtcatttactcattcagcgtcactagtgggaccttcacaaggcaaatgcgccagtgagttgcactctaacaaggtacacagctgctaggaagggagcagccaaacctgccatcactgactgcagtgttcctactggacataggcggcattgggaacatactggcaatgtggcagggtaaagggttgggtgaagggtgagagcttgaagactcagacttttctaatgaggccagcagcctcacctctggccactttacagcacaccttcctcctgggaattcttccctagagcaatccacagacttgctttcgcaaagcttgaactgttcttttttttttttgacagagtctcactctgtcgccaggctggagtgcagcagtgcaatctcggctcactgcaacctccgcctcccgggttcaagcaattctcctgcctcagcctcccgagtagctgggattacaggcgtatgccaccatgcccagctaatttttgtattattagtagagacagggtttcaccatgttggccagggtggtctcgatctcttgaccttgtgatccacccacctcggcctcccaaagtactgggattacaggcatgagccaccatgcccggccttagctatttttaattcacaaaagcacttcctttggggtggtatgccagccagatctgcaagactatactgtaaatacttgttttagcctagttttatttcatttatttttagctgcttcatctttcactttttatatggaaaggaggaagtgccggaacaagggaaatggtttagagcagagttcttgacataaatatagaatacaaaatgtcttttatttctccagttatctctgcatgggtcatttctatctgagaacacagatgttccagacttaactttaatggaatcctaaactgagaaaaaaagaaacaaagcagaaaagcagaaagcagaaaacagaaagcagaaagccatccatttccaaaacatgttcccttgaaagggctgtggagcactgcctcagcacagatacacctctgagaaatcctacagatgaaactcattttgacattttctaagcaatttttaattgacttaatttttttagaacagtttcagatttacaaagtgagaagacaatacagagaatccccaaatactcccagtttcccccattattgacatcttatattagtactggcaaactcgctcctcaaccagtcaggctcctctaagtcctcttctcaactaggctttgaccttgaacttaaatgtctgtccttgtttggcctgtattgtccagttttagcaggaatcctgttaagtcagtttagaaagaatcctccacttttgatgtctgatcattcctaatatctggccaaatttcttatcccccacctttagcaaatgatcaccctggtatgctttcatcaagaacctgtaagatcagtttagcgagaatatctccttactgctgatgtctcctcttagtaagccaccctgctcctgggctacgaatccccacttgtccatgtcgtatggcatggagtaagccagttttatactgagggctctttctcctattgcaagggttagcactttaactattgtccaactctactttaatataacagtgtggtgtatttattataattaatgaacaaatgttggtaccttattattaactaaaatcatttacaactttattcagattttattcatttttacctaatgcccccttcctattccaggatcccattcaggatactacattagacttagttgtcatcctcattagtttactcttggctgtgacaattttccccactttgtttttaattgcattgacagttttgagaaatactagtcaggtatcttgcagaatgtctccctaccctcccactccctcattgaaattgcctgatatttctcttattattcaaataggattaccagttttggggaggaagatcacaaagtgacatttttatcacagtaaatcaatggcacatgctatcaacatgaataactattgatgttaacttgatcacctggctgaggtagtgtttgctttgtttctccactatagttactcatgtgttctccctttccatactgtactctttgagaggaaatcactatgtacagtcagcagttaaagagtgcaaattatgcaccatctccttaaaagcagagaatctatataatttatttgaaattcttctgcatgggagatgtttctattttcctctaatttattttattctatcatttacttatcttagtatggactcatggattcttacttgatactttaagttataatccaatatttatttattttcttgctcacagtttttcatctttggcctttggaaactttcagttgtcatctatatcatttgacatacatctatcagtgtggatttttgttttgttttgtttttggggaatttctttactttgtggcactactagatactctgcgctcatcttatataatttctgccccagtcttagaatcaaccctttctctagggagctctttttttacttggagaatgatattagaaaccaaaatctgagacatatggaactaaacagagagcaccaaaataaatgcacacatatgtggtcaactcatctttaacaagggcatcaataatatacagttgtgaaaggatagtttctccagcaaacagtgttgggaaaactggatatccatatgcagaaggatgaaattggacccttatcttaaaccataaaaatacaaactcaaaacagaccaaagatctaaataaatccataattcaaactgtaaaattttggggaaaaaaataggaaaaatgctttatgacattagtcttggcaatgatctcttggatatgataccaaaagcacaaacaacaaaggtaaaaataaacaaatgggattattttaaacaaaaaagcttctgcacagaagaattaatcaacagaatgaaaaagcaacctacataatgggagaaaatatttgcaaactatatacctaaaaaggatttaacaaccaaaatacataaggaactcctacaactgaatatcaaaaaataaaataaaataattcatcaattaaaaaataggcagaggataaaaccaaaaatatactgattaaaaaacaggccaaggacttcaatagccttttctctaaagacaaacaagtggtcactaaatatacaaaaagatgctcaacatcactaatcaagaaaagacaaattaagaccagaatgagacatcacctcacttctgctaggatggctattacaaaaaaaaaaaaaaaaaaaagtgttggtgagaatgtaaagcaaaggaaatcttttcacactcttcgtagcaatgtaaagtggtacactgttatggaaaacagtatgaaggttcttgaaaaaactgaaaatagaaccgccatatgatctagcttatgagtatatatccaaaagaattgaagttagtatgtcaaagagatacctgcattcccatatttactgcagcattattcacaatagccaagatatgaaaacaacctaaatgtccattgacagatgaataaagaatggacagattagatagatagatagatagatacatagatatatagatagatagatacatagatacatagatagatacatagatggatatgatagatgatagatagatagatagatagatagatagatagatagatagatagatagatagataaatgatagatagatagagcaacactatttagccttaaaaaataagggaatcctatcatatgcgacaacatggatgaacctggaggacattatgcaaagtgaaataagcagttacagagggacaaatgtgcataattccacttatgggaggtacctaaaatagtcaaactcgtagaaacggaaaatagaatagtagttgccagggactgggggcagggagaaattgagagttactgtttaatgggtgaaaagatctggtgcacaacattgtacgtagagttaacaataccatattgtgcactaggtgtactcattggtactggagtgtcagttcttctaggaccactcagctgacaaagcaagtaaatatatgtgtgtattctaatttgcgtctgtgcctatctctatatgcaataagttgcatctacattaactaaacatcacttcatactagatgtctcccactccaaactagtaacacatggctcattctagctttcttcccttgcttgtctaaactcccactctaacagtgagaaaacagactgccaccattcaccatttgtattagtttcctattgctgctataacaagttaccacaaacttggtggtttaaaacagcaaaaacttttggtctcacagatctggaggtcagaagtccaaaatctgtttcactgggccaaaatcaaaacatctgcctggacacactcactcaggaggctctaagggagaacctgctccttgccttttccagctttgggtggtggccactattacttggcttttggttacatcactccaattctgcttccgtggtcacactgccttttcttcatctgtatgtaatctgtctctccttctctcttataagtatacccacaattattacgttggtcttccctggataatccaggataatctcctcatcgcaatatccttaacttgatcacacctgcaaacagactttttccaaataaggtcacacttacagtattaagtattaaggtctgatatctttgggggccattgttcagcctactgtaccattcatttatttaattattaattttcactgtacatgtgtcagtgacaaacaaagccagaaactaattaagtttttaagacagatttatttaagacagatttattcagtcataactactgcaataaggaagagagtccagcatgaattgaactcaacttcgatttgtgcagaggtgattggccattttaaagggaataaccgagggaatagggagggaaaaaaagcagggctcccacagaatccatggaacagaaattttttaaaagcaggaatgaggggttggtcaatgtgattacgccatgtgggtttgctaactggcccttattaaagttaggcttctgccttctcactgagattggtcttatctttaagtactggatgaaacagtaaattgttttgacagccttgatctttcccagacaagaactaaatggggccaaagtcattatcctagggacacaaacttgacctattagaaactatgctagtgtttgtttacatctcttagtaggggagaagaaggaggtggattaagtaatttgagctgaaagtctgcagattttataggcctagttgagaagagagctctgaggagcttgagtaaaatgtgattaaggagagagtctttgtcatgtatataatagcactggaaatgttaacctgtaccctcgtgggaaacaactttactaactagagctacattgcatatgcttattttttacttggttttacagattctatcatttccaaaattagttaggtgtatcttttccctttcaccaccttcagtaaggttgtttcatatatttgttatagttaatttcccttgttacagtctgcattttcatctaagattctcagtctcctaaatgatttttgcttagttgaatacattaagtttcactctttgggctataaggttctattggttttgagtgatgtatactgtgatacatttatcattacattataacacagcacagtttcatcacagtaaaaaatgccttgtgcttcaccataactctccaccacttccctgacctcctggcaaccatctctagattccattactatttttagagttttttcttttccagaaactcatataattagaataatatagtaaatataatatgtagccttttcagactcactacttgacttagatacaggaatttaagtgctttccatatctaatgtggtttggctgtgtctccacccaaatctcaccttgaattataataatccatacacatcaagggcagggtcaagtggagataattgaatcatggaggtggttttcctcatactgttctggtggtagtgaataagtcttacaagatatgatggttttataaatgggagttctcctgcacaagctctcttgcctgctgccatgtaagatgtgactttgctcctcattcatcttcagccatgattgtgaggcctccccagccatgtggaactctgagtcaactaaacctctttcctttataagttaaccagtcttgggtatgtctttattgggagcatgagaacagactaatacaatgccttttcttagcttagtagctgatttattttttcactgaataaaatttcactgtatggatctactcccattttttaatagagtcatctattgaagcacatcttggttgcttccaattttggtgaccatgaataaagcaactataaatatgtgtaggtttttgtgcatatatacattttcaagccaggaatgtaagtgctggatggtgtggtaggtttatgtttagctttgtaagaaaatgccaaaatgtcttccaaagtggctgtgccattttctattctcatcaatgaaaataagagttcctgttcctctgcaccctccccagcaactattactctcgggttttttcattttcgtttgttcagattgtattttagccattctaataggtgggtagtggtatatatgattgttgttttaatttgagatttcagtaatgaatcttttcacttgccatctgtatattttctttagtcaggcgtctgttggatcttttggcaatttttttaattggataatttgttttcttatttttgagttttaagagttctttgtatattttggatacaaattctttatcagatatgcattttaaaatattttcttctaatctgtagcctgtgctttattctcataacagtgtccttcacagagaagaagttcttcattttaatgaagtttgacttactaattttatcctttatggattacacttctggtgttgtatctaaaaactcatggccaaacccaagattacctagatttttgcctatgttatcttctagaagttttatagtttctcaattaatatttgggctggtgatcattttgagttactttttggaaaggagtaaggcccgtgtctagattctactttttgcatgtagatgtccagttgttccagtaccattttttaaaagactttcctttattgaattgcctttgctcttttattgaaaaccagtttactatattttgtgaatcaatttctgggcttcctactctgtttatttacccatgcgattcttttaccaataccacactgtcttgattactatagcttgaatgtaagtcttgaaactgggtagtgtgagtcctcaaatttcatttttcttcttcagtattgtgttggctattctagatcatgtgactttccacacaaatttttgaatcagtgtgtcaatgtctacaaagtagcttgctgaaattttcattaaaattttattaaatctatatatcaagttggaaataattgatatcttaatgatagaatcttccaatccataaaaacagaataactcaccattaatttaaatctttatttctttcatcagtcataattttctgcatgtttttttagatttatagctaagtatttcttttttgttgttgctttcataaatggtattttaaatttgtaaatccagttgtttatcactgttatataggaaagcaactaacttttccatattgaaaaaagctcaacatcactgataattagagaaatgcaaatcaaaaccacaatgagatgccatctaacaacagtcagaatggctttgtttgtttgttttgagagagagtctcactgtgttgcccacactggaatgcagtggtgcaatcttggctcacagcaacctccgcctcccaggttcaagcgattctcctgcctcagactcccaagtagctgggactacaggtgcccgccaccacatctggctgattttttttttgtatttttagtagagatggggtttcactatgttggccaggctgctccagaatggctattattaaaacataacaaaataagagataatggcaaggttgtggagaaaaaggaaaaactatacactgttggtgggagtgtaaattagttacatcattgtggaatacagtgtggtgattcttcaaagacctaaagacagaaatatcatttgaacgagcaatcccattactgggtatatacccaaaggagtataaatcattctattataaagccacatgcaggcatatgttcattgcagcactattcacaattgaaagacatggaatcaacctaaatgaccattgatgatagacttaataaagaaaatgtggtatgcatacactgtggaataccatgcagccataaaaaagaatgcaatgatgtcctttgcagggacatagatagagctggaggccattatccttaacaaactaacacaggaacagaaaatgaaatgctgtatgttttcacttataagtgggagctaactgttgagaacacaaggacacatacaagggaacaacacacactagtgccttttggagtgtgaagggtgaaaggagggagaggatcaggaaacataaccaatgggtactaggcttaataactgggtgatgaaataatctgtacaaaaatcacacttaactcaagtttacctatataacaaacctgcatttgtacccctgaacttaaaagttaaaaaaataaccttttgcatattaaccttgtaacctgtggccttgctaatctcacttaatttttccggcttttgtttgtttccttgggctttctacgcaggcaatcatgtcttctgtaataaaagagaattttattttttccttcccaatatgtatatttttctttctttttgttgtcttattattctagttagcacttccagcgcaatttaaataagaatggtgggaggaaacatcctgtcttgttcccacttgtagggggaaagcatccaatttctcaccactaagtatgatgttagctgtaggactttggtagatcatcttctctttttaaattttgttttccaaatttatttgatcatgagaccctttgtttaaagtacatttattcatactttaatgaataatagtgttccataaaacaggaaaaactttattatagtaatacttgttcaggagtaacagatcaaatatgtcctcaaagaaaaatgatattaatcctagggaaacatgaggaaaaacactggaatgatgtgaccacctggttgccaaaacaatttgagctggtacataaatatcaggtgtttaatacccatggtttctaacctttatgttcacttcgttcattcattcataaaattttttgttgttgttgtcaggattaatgtgagctacagggttacaaagataataaggcataattattgcggtggaggaatgcacagtctagtggagaaatggaaattgattagtacctaagcagtcgactcccttgtatgaaaaaatataagcacctgaaaatgtcttcccagggaggacttttcaggataagcatctctatgagtctaatgcaagaatcacttagcttttactggggctttttttggtcaaaaaaattttagacatagaaaaaacatttttaaaaaataaatcacccatcatctaccacttaagaaataaaagatgatgaacgtttttgaagcccatgtgtacaccctacaaatgtattcaaattcctctccctcactgcaggtaactattatttgagttaggtattaatcttttccatgaatgtctctatactatactacatgaccatgtattcctaaataatatatagtattttggcacaatttttagattgtatataaatgataccataatggataaagccttctacaacttgttttcttcactctatatttgcaacatccatattgaaaatagttctaacttattgtccccactgaataaagttctgctgtattaatatagcacaataaatgaaaataaatccattctcccctggatgacatttaggctgtttccacttcactgatatttcaaaaaacacgtcatgaacattattacacatgcctcctgggcatatgtgccagcgtttcactcaggtatatgcctagaagcagaactgctgcctggaaggggacatgtaaatttatctttactaatttttgtcaaattgctctccagagtggttgcttggtttttatttctattagcattggacaagttctcatttcttcatgtttttgccaacactttgccaactcaatagctgcaaagtgctacatgttgtggtccttgttattagagaagttgagcatattttcatgtatgtgtaagccacgtagttttcctcttctgtgaacgtccagttcataatcattgccagtttctcctttggggttatttatccaactatcctagatgctaattaatactttgataaatagactgcagatacgtttcccagtctatacttaactttttgctttgcttatttgtatgttttgatacagataagcatttaatattatttcatcaaatgcattactcttttcctctgtggtttattcttgtcttggttaaaaaatcctttttggcacatagttcataaagatgtaaaataattactatttaaatataaccttatatttaaatataatctcatatttaaagctgttaaatgatgttttcaaatttaggttttatttcacctgaaatggatttttttgggtatggcttattttgagctataattatattttattctagggactaacttattttctccaggcactttattaagatgcctattttatcctaactgattttccaaaaagaactatgtcatattgtcatatatcaatttttcatgtatgtgtatatttattttggctttaaaagatgcaaaaaaattatttattaagtgacaattttatagctgtccttttgtggctttgcaatttttaaaaatccaaataacattatcattctccttttattcttatcaagaaaaatatgaacaaatgggtgagtgccaacatgaattgccccagaaattccccaaggccaggaaacttactttacttctttactaatctctatatttttgtaaggaaatgttctatgtttcaagaatttcttcacatacccagacagaaaatatcagtatgcgtgtatcagtctcagttcactcagggaaacagagtcactgtgacacagaataagggggttagtatagtgattatgacttacccagatttgagtgttgctaagggagtgaaggtcttagaaggaactgaagctctggcacaggtgaaaagccagagcttatggaaaagcatatgaaattccatgcatttggctaccaaagtgagaatgcagtgtgtggggttataaagaggtcagcaaagctgccatgtctgtcaaagccactgagtctgacctcgaccccatctgactgccatgacctactgagaataatgatgcctgctttacttctgcctcccaaatctcatatctctctctccaattgaaggagatatggggaagcatagtctctagcatcaaacaagaagagtgcttggtgctggtgacaatccagaaaaatgggcacaagtcacctttgcagagtggtcattagtataaaacatttcattcttctacaaatacaaccaactcaacatatattttttgccagaaagtttaccacaaataagaccttttgatttaccttatttcacaaaatgtgctcagtctcaagatatcattaacaataccaataaagaatgtaaagtatacagaaataaccccaataataaatgcataaaacgtttcagagaaaatgttctaactatattaaaggacataaaagaaaatttgaataaattgggcattatgccatgtttatgcatgggatagttaatatgggatagaggtcaattctctcccaaattaatctgtcagttcaacacaatagtaatagaaagtacagctggaggcatttaaaaactcattctaaagtttatatagaagaaaagccaaagtatagctaagtcaggccaggtgcggtggttcttgcctataataccaggactttgggaggctgaggtgggcagatagcttgagctcaggattttgagaccagcctgggcaagatggtgaaaccccatctctactaaaaagtacaaaaattagccagacgtggtggtgcacatctgtagtcccagctactcaggagtctgaggtgggaggatcacttgagcctgggaggcagaggttgcagtgagcagagatcacaccactgcactccagcctgggcgacagagcaagactatgtctcaaaaaaaaaaaaaaaagtatagttaagtcaactttgaaaaagtagactaagacaaggaactaaccctactagaaattaacatatattactaaactatagcaattctaaaaagagatatgataccaatacagaaacagaaaatggatttagactaataggttaataaaatgcaatagaagaaatagaaataatccctgcacatatgaaaactttgatatatgataaagatagtcccacaaagcaatgatgaaggaatggattgttcagtcgacaatgttatgaaaaagtagatatgaagaaaaatagagctggacttttacattttaacagcacaccaagtgagaaataaatgaattaaaaaccaaacgtaaatatcaaaccaccaaaaaacagaagaacatgtaaaataacatatttttgatcaaatttgtaggtaaacattctaaaataattattcaaaaggctataagttttaaaaatggatttgactacattaaaaccaaagatttcctaaagtacataataaaataatgggtagattggaagacttggagaagatattcgcaacctttaaaactaataagaaaataatatttaattataaaaatagatctcttgacaataaagaaaaagtaaacacaatagaaaactataagaagctcacctgactaacaaggccagaaaaagatgctcaaaacacaattagtagaaaaaatgctagttaagtcaacaatgaaaaaatcaatgtgtatttattggaatggcaaaaatcaggaagatgtgtaatatctaatgttgggaagccatggacttgaacactggtgcactgcaaatgggaacaataattaactgatcctgctgggccagaaagaagtatgccagtgttcagaaaaattaagtatatgtatgacttatacttaagtataagtatacttaagtataagtataagtatgacttatacttaagtatatgtataagtgggactcggtgatcccactgctgaatatccatctcccaggaaagttctctcagagattcataagggcatacactcaagcatgttcattgtgacattgtttatggtgatggaaataaagggtatgttcaatatttatttttagggtgaaagatttgtaaaatggaattgtatgccatggagtactatgcagctctaacaagcaacaaagtagatgcatatacaataatgttgacagatcttaaaaacattgtaagaagtgagcagagtgtgatttatagtgcaaaattatgtaaattaagaaaaaatcaataccatatattttacaagaatatatatttaagaatacataaatataaatacatatatgtaagaatataaagcaaacacattagatagaaaaaataaaaagtcataaaactttgcatgaatccattatgataatgtgatatgtactgaagactattatgagttccattatctgccccaatatcaatagttaaaaaaaaagaaaaaaaaattttttttttttgagacagagtttcacactgtcacccaggctggagtgcaatgggcaatctcagctcactgcaacctctgcctcctgggttcaagcgattttcctgcctcagcctccccactagctgggattacaggcacctgccaccacaccaagctaatttctgtatttttagtagagatggggttttgccatgttggtcaggctggtcttgaactcctgacttcaggtgatccacccaatttgggtgctgggattacaggtgtgagcccctgtgcccagccaaaaaaaaaaaaaaaatttaaagtgcgtacatataccttaatcctgtgggttctctgggacatactacacaatgacaaataccttctggtgcaaggttagagaccagaacacatgattggatctaatctaataatatttctctcatgttggatttgatttattatttacaacagaccaagattttagagaattaatttccccatattcaagtttataggctgctttaatccagttatagttctttgtagcataacagaggcaaagatggatttgctaatccagcataattgaacagtactgcttagcagagttcaataaaggctgtctcctgtgagatacacaacactattcatccccctatggatgagattatctaataaaacataattgatatgtgcctacttttattctgatgtttggtcatatcctgacaatatttttcttctttcctggtctattgtatccagtgactgactgctgaaggtctgaatgatgaaattagtcattggtgccatcttaaagaaactcatcactgacttctccctatcagtccttcttactcacttctagtagggaaaacccaggcagaaaaaaaaatggcagagactggttgtacaactgacttacaaagttaaattttctttaatgtttttgtgttcaatgaagacagtctcttcaaaaactaattgccactaaaacttaaagaaaataatattggctcagccaaaagaaaaaaaaatagtcatgaaagttccattctatcactcaccagtcagaagacaactggaagaacttctctcagttcttgaagtccattttttaaaacaatttatgcaaagtgctatctatacaaacaaaaatgaacatgatggtattgagaatggaaaccaaatcagagctaaggcattggtaccggggaagaagacttctaatatttaggagtgaacagttttaaaatgcaggtgtttgggttctgcccctaccagggtctccaaaggtctgtcccatttacaaatctcacatgttctctaataaaaatgggtttgtttcagtcttcatggtagattgcaaggaagatttagttatcagattagatgctgtactgacaccttatggacccctgcagctttgactttcagggcatctggggaaatgtttttaatgggtaaagggaaatgaagatattctcttcagtgaaaggcatacgcactgagttttcaaattaccgctttcttgtggttccaggtggaattaaataaaaaggagttttcaccatcattctggatcattttattgctagcttgactctattggacacatattactaagactttaatatctgcaaaaacccaagaacacaatatcagaatgagtcactatttgtttatggcagaggctgctgctgaaagccccaatcagaagtggtattttcaaagcgggggctgtggttgaaaaatgttcagagtgtctatctgaaattgtttgattcccctgccccccttttttttaaatgagctgagagactgtctacagcaccttgagattgaagcttaagtactgcaatcactccaagtgagtgatccatgcttttgtatcaaaaacatgaatacaactatatgcctgatgaaaagatcatgccattttccaactggtttattcatactgaatacatatgagatggaaaacaagatttatgttagtgacaaaaccacagagagacaagagaagtgctatttctggatacctctcaagaagaggttgctctgaaacgcaaagtctctttgcacagccattaccaaagacagaagctctgagggcatttttcaaaccaggagggagagcaagggtcccaggcactgttaacctgaagcccagtggaacttatgggtctagcttgcagggtcctttcatctatgccaaaccatttgcagggctcgcttttaatctggcacccctctaaatgtatttaattaattgtcaaggttgaaagtatccaatatgtcagtttttatgagcagtcaaccaaggaagcagctcttggtttctttatatgtgccaggcagcaactcagcaacggtggtctccatcattttgctaatagaacacttctatttctaaaataataaataagtatctaaaacatagaaaccagtaggcctttacttatgcattcatctgtgggaagaagtaaggcagcaggaacagagaattccccattcaggtactgcccaagccagaaaatgtttctgtttttcttggttgtgtaatggaacagtggttctctttagaagtagtattaccctctagggaacattttagaaatctgtaggggagattttctttttaattgtcaccatgattaagaaaccctaaaagtgtttataagtctggatctgcaatgagttggagagtctcacacattgaagaattacagcctgctcaaatttttaatgtttcatagggatttcttatggttgtgaaaagcttaataataacccaagccaagaaacatattgcattatatgcataaaaacaaagtatattttatatcgttttaatatatattgaaattttttggaattcaactaccacgaaaataaaaggaagagagttctttaaatggttttgttcagagccttgcagtaattctgtttcagaaaatcatgacaaggacagcaactctcttcctggtatcattctgaatgacacctgtcatatccaaaatggctctatctttaattatacacatctgactacttcatttatgcattgtaatacatgtttgatgttaaattattttatgtctccttaggttacagtttgggcatcacgttgtttggggatagaattattttgtcaggtgaatgtattgcaaatattttctccaaattttgggcttatctttttcttttaaaaaaaatttttctatgctatctaattttaagcatgtgcatgtagtattgtttcctttcttttatttatttacttattttatttcaacaggtttttggggtacaagtggtgtttggttacataagttctttagtggtgatttctgaaattttggtgcacccatcatccaagtagtgtacactgtacccagtgtgtagtcttttatccctcacccttcttctacccttttcccaagtccccaaagttcactgtatcatgcttatgcctttgcatcctcatatcttagctcccacttatgagtgagaatatacaatgttcggttttccattcctgagttacttcacttagaataatagtctccaactccatccaggttgctgcaaatgccattatttcattccttttttatggctgagtggtattccatggtgtatatttatatatattaatcacattttctttatccacttgctgttatgggcatttaggctggttctatgtttttgcaactgtgaattgtgctgctataaacatgcacatgcagtgtcttaagcgtcttatgtcatagaatgacctcttttccttcgggtagatatccagtagtgggattactggatcaaatggtagttccacttttagttctttaaggaatctccacactgttttctgtagcggttatagtagtttacattcccaccagcagtgtaaaagtgttcccttttcaccaaatccacgtcaacatctattgttttttaattatttatttatttatttatttattttattatggccattcttgcaagagtcaggtggcatcacattatagttttgatgtgcatttttctgatcattagtgatgttgagcattttctaatatatttgttggccacttgtatatcttcttttgagaattgtctattcatgtccttagcccacttttacaggggattgtttgttttttccttgctgatttgtttgtagattctggattttggtcctgtgtcagatgtatatattgtggagattttctcccactctgtgggatgtctgtttactctgctgattgtttcttgtgttgtgcaaaagccttttagtttagttaagtcccatctatttacctttgttttcattgcatttgcttttaggttcttggtcatgaagtatttgcttaagccattgtctagaagggtttttccaatgttatcttctagaatttttatggttttaggtcttagatttaagtctttgatccatcttcagttgatttttatataaggtgagagatgaagatccagcttcgttcttctatatgtggcttgccaattatcccagcaccgtttgttaaatagggtgtcctttccccactttatgtttttgtttatgttttgtttgttttgtcaaagatcagttggctgtatttggctttatttccggattctctattctgtttcattggtctatgtgcctatgatggggacagggttaggcatgtctgaactcagactctctttggttggggcttgctgaggctgctgtgggggatggggtatggttctcagaccaatggagttatgttcccagggggattatgactgcatctgctgtcatgcaggtctccagggaagtggggaaaagccagcagttacaggcctcaccccactcccatgcagcccaaaaggctagtctcattcctactgccccacccaacagcactgaggtcatctccaggcagcaggcatgcaggactgagaacttggcccaggctaccagcgtcctggctgagaaagcagggctttcaagattcgtgccaccctgtgcctgcggcaacttctgtgctgtgcctgcactggctattcaccccctcccccagactccgtccaggaaatttcacattctgtcaaaattgttacaaagttcggctagaagttttcttctccctgtgtttttttcccagttcctctgtcagtcctcccaaaggacccctgtaagacaaagtcggaaatagcttccctggggaccaagagtgcccacagggctcttcccgctgcttcttctacccctgtattttgcttggctctttaagtttctctcaactccaggtaaggtcatgtcctactcctgtgatctagacttttaggttccccagtgagggtgtgtgttccggggcagacgactgccctttcacactttcaccctttcaccctttggtcactcacagtgttttggctgtctccagcggcctgcagcagcaatccgcttccttcaaagggtctgtggaccctctcagctttcctggtatgttcctgcagtgattcttggagcaaaagttcacagtgtgagtctccacacgctgctctgtctgtccaagtgggagctgcaagttaatcctgcctcttattggccattttttcctctctttttattttcttaacagttccttttgatgagcaggtgattttaattttagtagaaaagcctaaattatatttctaatatttagtactatttatgttctgtcaaaaattatggctacccaaagttcacaaagatagtctcctgttttcttctagaatttttgttgtttctgctcctatgtttaggtttgtaatatatttcaaattaatttttatatggcataaaatagagattgtgaggggttctgcatatggatgtccagttgtttcagcactatttattaaaaatacaaagcttttgctattgaattaccttgaaacttattaaaaatcaattgattgcatatgtgtctctacttacaggctttcaaaaaatgttgttgctgtttctccttacacaaatatcatattgtctactatggctttatattgtcttaatgttaggtggtaagattcatctaactgtattatttttcaaaattgtttttgctaatctaagacctttgcatttccatataagtttatgaatcatcttgtcaatttctacagaaaaccttgttgggagtttgattagacggctgagaaagacagcaaatctacagggtgagtaacatggctctggactcagggtacctggattcaaatggctactcaactgcttactatttatgtgcccttgaacatctgtaatcaggatattaattacatgccccctctgtgatcagaataattataaaacataccttctatggttgttgagaggattaaataatttgcatatacaattgcctactggaaatatctaattggatacattataaacatttcaaatttgaaatatacaaaatcaaactcctgatttttcgcctttcctaaactgctccatctactgactttctcatctcagtatactacaattccattttacctgtcctcaagataaaagccttatggtttcttgtgccagacaccttgaaatcaaccttaactcgttgctgtttctcatatcaaatatccaaaatgtcagcaaatcctgtagtttctacctttaaagatacgaatctggccgctttttacaacctcattgtaaccaccctgacacgctaacctggattattgcaataatttcctaactgatctctgagcttccacctatgtatcccaaaaatctattatcagcactgcattcattgcattactgtgaagacttaagccagatcatgacacttctctgttcaaaaccctcttcaaatagaaataccttcaaaatctgttcataatctcctcccaacccccatcattatctgaccccttcttctatgaacttatttcctaccatactatcctaatactcttgctgctgcagccacactagtctccccactacttctcaatcatacagcacagttcttcctttggatcttcgcagttgcttttccctttgcctggaagtctcttccccgagatgtttgcatggcttgcttccttacctccttcagcctttgattccgatgtcgacttctcaatcaggacttccctagccaccacattgaaaattatttgtatatattaacatatgcaatatttcctaactttcaaattctaatttcttcaagtaatttccatcactttatgtattatataacttagaaatatatttattatatgtccctcttcacccttatattaatgggtacttgacttgggtataaagtccatgaaaaaaagggatttcttatatgttgttcattcctatgttctaagtgtcaaaactgtgcctggcatgtagctgttgaataaatattgaataaatatgaatgaatacatgaatgaaatgagataatacacaaacggaatttagcacagttccaagagctcagaaaattcttaataactgtcagcaattataattttaacatttacacctgtgttcagtttcccagctttccagagcattaaagcatgttctaagtcttggaagaaggaggagaactcttttatctctttatcgttgacagtagcactacttgcgttcagttgggcagaaatgccagaatgctctggaattccacaggctgagagttagctgtacctgtccagactattgcctacccaaggacatggccaaagataaaaacttgatttactattcccctatcttgaataaaaactcacttccaaatcccatcagcacctccaaaatgctttctaatcactcatttctccaactccccttacccttatctatacggtactcccacacccatgtcacagtctggtgctttctatgagtccctttcaccaggtaagtctatttcttcaagtcagggaataaagaacccaagatatacctccaaaacaggcacttgtggaaacaatagttgagcaacagccttaaaatgtatttcagtggcagaaagtcaactaagtaaataggtagactcttcattgagccaaaaattttttgggggaaggagttgaacctaatagagtcacataccttttcgctactgatttccctttgttatttatatacttccatgaaaattgtaaataagaccaaattaaacatttttcctaatatatttccccaaatcgaaatctaagtacataaattattttcagacaattgtgttacctccagaactcagaactacagaaattcagacttattattaatgaaatcagagtataaagttctcgcagaccatatgagaggaacttcactcctacaatgcaattccagagctataaaatattatattcagagatcacctgcaccgccttccccactttacataagaggaattcagttctccaagaagtaaaagaccttgaccagggtcacagagtgagctagcagcagaacaaagactagaaatggggggtttcagcttcacgcctgcactgctccctcatgacctagcacctgttcaaaccaggtactttccttattgtgagtcctgaatattgaacactataattgcacaaggatatctgagttcatataggttacaaagacttaagcaatttaattcaatttgatgaaagagttgcaatgactttccaccctatgcaagaccagagagagagaacccatagacaaaacagcatgccctggatttggttgaaaggcctccacaaatctgaagcagcacatcacttagaacattactagctgtaacaaaggaagtgctttcttttgattatgttaagagagcaggatctaatccacttcatacctgtgatgataaagcacttattcagataaagaaagaatagtacttcatgccagattcattttatcaggatagaatacaaacaattccacagaatctgacatatagttcttgttatgttaacctgatggctcttgatacagaaatattttaagttataaaattgttattacatactacactgcttcataatggagagctatcaggtatctaatagcaattttaaagggcttagattttagtagcaagatcataatccagaatccagagacaaagaataataatttcatatgctttcccacaaaagctcttgtatgctctcctctacctgagtttttggaagcatgtcaagaatggctttcccagcagaggaaaaagtgattgctaagctataatttagggcaacaacacaactgaatttcagcagcatataccatcaggaatgagttttttcttccatttaattctgtaagcaaaggcttctgtcagtattaattccccataataattatgattacttgataagctaaaaacaatcaggaggattattcttacatgtgattgaggtaaccaagcttatgtattacaggaaaagcaagaataaatacagtgtacattttttcaggtatgggtctaaattacatctggggatcaaaaaatgaataaaacacagtcctcactcataaggaattcaagcctagttgagggacattggtgtgtaaataacaagtgctattctctactgggaaaagctcagggtctacagtcatacagatctgaaattgaatccagctttgtggcttatgatctgggagaccttaagcaagttacttagcctctactaggctttagttttctcatttaaaaaccagtgtacctccctctgaggtactgtgaggagtaaaggggataatgcctagaagggacttagtacttctccaggtattagtatgtaagattaccttattatacaagctgcaaatacataggtactatcagaaatataagcaatgtgccatgaaagcaatttattcagtctaatgattagacctctgctctgaactacacatgccctttataaaaccagcacagatcaagtgtgttttatgagttatgttttagacattttggagcaataatcataaggttattactatttcagatcaaagtgcaaaggctatgcaaggggtagccatttctctgaaattgccatctccaggactgattcaggaaaaaatacaaatctattatctgctttgctaaaagaaaattgtctaatgaaagtaaatcaccaggaaacccaatttactctacagtgaaatttggcttaaaattaatctttcttatacctaggcaaagagttttctggcaaaactacatggtttcttgaagaaatagattcacctagaagtcagcatggaccccaaagacagagttattttatacctgtgtcatcttgaactatcatgcaatgactttttaaaaataaacttttagagcagttttagatttacagaaaaattgcaaagaaagaaaattcttgaataccccccacccagttttccctaatgttaacatcttacattaggatggtgttaatcgccatcctaaagaaacaggatgaatccctgcccaaaatttgatttggatgtcaagaccaatgatgtcacacacgcacacacacacacacacacacacacacacacacacaccccaagaggttatgaaaatcttttctataatgggatgtttttgaaaagagcaagggagccttcccaaaatggttccaaatggcttaaatagccagaaaaggagacaggcttgagatttttttaactgatacataataattgtatatgtatatgaaatacatctgacatttcaattcatgtctatgatgtgtaataatcaaataagagcaattgacataatcatcacctcaaatatttatcatgtctttgtgctgagaacattcaaaatcctctcttctagctatattaaaatataaaataaattttggttaactatagtcaccctcctatgctacagaacattataacttatctaactataattttgtacccattaaccaacttcttcccatcctttccccctacccttcccagcctctggtgaccactattctactctctacttctatgggatctacttctttagctctaatatatgagtgacaacatgtgatacttatcgtctgtgctggcctatttcaattaacataatgtcctccaggctcattcatgctattgcaaatgacagaatttcattctttttatagctaaataatatttcattatgtatatgtactagatttttaaaattcatttacctgtcgatggacagttagattgtttccatatctgggctattgtgagtagttccgcagtagccacaaataaagatcctgcacaaagccttagtgctctgaaaacatccataaataaaaccaattgactctactcaaattacaccgccgttaagggcacatcaatcttcctagataagaaagaaaaagcacaagaactttggcaattcaaaaacgcagagtgtctccttaccccttatgaccacaatagctccccagcagtggtttctagccaaacaaaaatggctaaaaagacagacaagaactcaaaatctcaatgaagttcatcaagattcaggagaaagttgaaacccgatttaaggaatctagggaacccaagaaaattattcaagagctgaaagatcaaataaccattaaaaaaaactgatctgatggagctgaaaaactcactacaagaatttataatgtaactgaaaatattaacagcagaatagacaatgctgaggaaagaatttcagagctcaaagaccagttattcaaatcagctcagacaaaaatgaagaaaaaagaatagaaaagaatgaagaaaacctttaagaaatatgggattatgtaaagagaccaaacctgccacacatgtgtgtccctgaaagagacggagagagagcaagcaacttgaaaaacatatttgaggatgatgttcacgaacattttctcaatgtcactagaaagatcaaaattcagatttaggaaattcagagaacctctgcaaggtattatacaagatgaccatccccaagacagtaatcagattctccagggtccaagtcccatagaagtagagagtagaaagaaataatattaaaggcagctagaggaaagtggcaggtcatctacaaagagaacttcattgggctaacagtggacctttcagcagaaaccctacaaactagaagagaatgagggcctgtattcaggatctttaaaaaaagaaattataaccaagaattttatatccagccaaactaagcttcataagtaaaaggataaataacatttttttttcagacaagcaaatgctaaggaaatttgttacatcaaaatatcccttacaagaggtcctaaagcagtgctaaacgtggaaacagaaaacattacagccaccacaaaacacacataagtacatagatcattgacactataaagcaactacacaatcaagtctacataacaattagctaacaacataatgacaggatcaaatctgtacatataaatattaaccttgaacataaatgggctaaacatcccacttaaaagacaggtagtggcaagctggataaagaagcaagactcaactgtacaatgtcttcaagagacccatctcacatgcaataacaaccatagactcaaagtaaagggatggagaaagctctatcaaacaaatagaaaagaaaaaagggcaggggttgctattttaatttaagacaaaactgactttaaaccaatgattatcaaaaaggacaaagaatggcattacataatgataaagggttcaactcaacaggaagactttactatcctaaatatacatgcacagaacactggagcaccaaaatttataaaacaagttcttagagaagtatgaagagactttaaaaaccacaaaataataggagacttcaatggcctactgacagtattagacagactgtcgaggcagaaaactaaaaaatatttttgggacctaaacttgagacctgactaaatggacctaatagccatctacagaacactcccctagacaacatagtatacattcttttcatttgcacatggcacatactgtaaaatcaagcacatgctcagtcataaagcaattctcaataaaatttttaaaaattctagaactatgccaaccccactttcagaatgcaacacaataaaaatataattgaataccaagaagatccctcaaaaccatgcaattacatgtaaattaaataatctgctcctgaatgacttttgggtaaacaataaaattaagacaggaatcaagacattctttgaaactaatgaaaacagagatagaagatattagaatctctgggacacagctaaagcagcgttagaggaaaggttataccactaaacaccaattggaagaatatgtattctattgctgttggattaaatgttttgcaaatatcagaggcccatttggcttagagtatagtctaactctgatgtttctttgttgattttatgtctaaagtatttttccatttttgaaagtggaatgaagtcccctaatataattggattacagtctatctctccctttatatctaataatacatgctttatatacttgttccagtattggttgcatatatgtttacaattattatatgctcttgctgaatggacaattttatcattacataatgacttctttatcactttctaaagcctttgacttgaagtctattttatctgatataaatatagctattcctcctagctcttggttttcatttgcatgaaatatcttttcccttcccttcacaatttgtctatgtgtgtccttataggtgaagtgagtctcctacaggcaacatataattaggtcttgttttttaatctattctaccactttatatcctttatttggagaacttaatttatttatactcaaggttattattaataggtatagacttctgcaattttgttaattgattcctagttgtgttctgtaatcttttgttcacttcttcctcttttgcattctctgtgatttaatggttttctgtacaggtaggctttggtccttttcatttttttgtgtatctactattagtttttcctttgtgttcatcctgaggcttacataaaaaatcttataacaagttaatttaaactgattagagcttaattttgattgcatatataaactcctcttttactccatctcctcccatgttttatgttttagatgtcacactttacatcttttcataatattagcaaattattgtcactttattgcctattgatctttatactagatatatactaataattgattttcccaccaccattacagtatcagaatgctttgaatttgataatgtactttcttacttttaccatgcattttgtattttatatgatttttatgtcaccaattttcatcctcttccttcaggcttgaagaactttagcattttttgtaatccaggtctagtggtaatggatactctcagcttttatttgataatttttcttaacacttaatttttaaaaggcaggatttctgggtatagtattcttggttgacaatcttttttatttcagaattttgaatttatcatcccactcccttcgatttgcaaggtttctcgtggtaaattggttgatagcttatgaaagttcctctatatgtaacaattcacttttcccttgctgctttcaacactctctgtttttaacttttgaaaatttgactatgatctgttgtggtgttagtctctttggattcatcttcttgatatcttacgggcttaatggatctggctttctaattcctttcccagaattcctttcccagatgtgagaagtgttctgcaattatttctttgaatacgttttctgttctttactctttcttctttttcttccatgccaataatgtataagctgttccacttgatgatattccgtaggtctcttaagctatcttcactctttttaatttcttttgttcctcatgttggttcattttcagtgctactttcttctgcttcataaagtctgatgttaaacccttctattaattttttagttcagttatagcattcttcaaatatatgattttcatttggtatgtactttatgctttctatgtcttatttgaagtcatcaacgtcttgcctagttgtcttgacctctgtgaatatcttttgataccattattttgaattccctgtcaggtaaactgcatactctcctttatttgagttgatttctagagatttatcttgctcttttctttggaacatattcccttttttcttcatattccttgattctctgtgttggtttctgtgccttaaataatacacctacatctctccaagactggacttgtataagagaaaattttcacccattcatttggccagagatttcaaagtgcctctctatttgttgttgttgtttagactactatctctgtttttatagccccctggagcttaggatatgctacatcttgtcagtaccccaaaaatggtatgataggagatagtctatttaagatgtagctggaaagattgagatgttagatatgtattcccattcttcctatcattatggggagactgggtgcaagaacttatctcctttctctctgcactaagacagaagatctgtggaaaatgcctatacttatgttcaagctgcaccttctaatcttggaggaatagccactaggtgtaagtccattatatatacatctatttgttttctctagtcttgggtcactcagaatcacaacgccccctcaattttcagaggtggttaattacacagttccctaggtgggagacacgaaagttgtggcactcagtgcacagtcaaactcatcccagaaataggcctggatttatctctggggcaaacaagggggaggtctcatggaatgctgagctctggctctgggtaccaaaggtttattgtttgtttgccccgttagcttcttgaggaaggttcattagagaccaggccatcaaatagccactgggaatgtgtgttgtaagcctcttctggagattaagtgagagtttaatgttgttgacccttttctgcactgctccaagggagtgtagcccttggaagtgtttggatgcccacttaaaactatgtctttgttccagaatgaaggaagactcatatgcctagtcttttgttcccgcaactactaggtttagaatggagcctttcagggggtagcattaaaaactaggactatcgatgtgtgtcctaaactccttctggggaaaaacaggtagtggcattttttgacccctcctctgcacagctccagaagaatgaagcctctagaggagtttgcctgcctatttttaaatccctctttttccctctggtggacaatgacatgtgtacactggtccctttggtacccaaagctaggagatttcaaatactattccttaggtgaatgttgcaggatttgagacacttgatgtgagtgcaaactcttcccaaactagaggagggttaataattgactgtctctttaactcctccatggatgcaagttagttagaatccaggctgccggacagctactggaaaggtgttttgtaaacccctctcaggaggacttgggcaggggaaacagagagctgtgggttttttaaagctcctttagtgctcccaaggggataaagtccttagtagtgcttatgcacatgtataaacttccactttttttcctacagtctagaggggcatgggcatatctaatcccttgcatttctaaagtttgtgaatcaaccaccacatcttggggaaatttagggtttgggtcctttacgtgaggtccagatcttcctctctacacagagaacctgggtgttgagatttctttctcagtatcgtggtgcaatgccctgggtggggtccatgcccaagtgtgcgtcagcttttcccacccacttaatgtggacgttttctcaattgcctgttgggtagaagtctcttgactggcctttggttttgtctcgggggagtttttctgtaaatagtttatctggaacatctgcgattgtagggagagtcagaagtttcctatttcaccgtgttggtgacatcacccacccattcttagaatttttattatggttgaagtgttgggccaaggtgagcattcctttctggggacaggagcttatgtgatttgaatctcccactagtactaaagaggggaacacccaagctttattattagcttgcccagattgggggcagaaggggaagatagataagtaacgcttaaaagtcgtcatccatcaaacatcaacatatggagtcagctttttcattatacattgtccttttttaactattagtgaatcaatagtcatatattttattagctaaagtcagcattttattcatatttccttaatgtttagctaacgtcctttttctgtctgcattatgtttatttatttattttttaaatctaggactcatttttttttatgtaaatagcacaatagttgccacaggacaagaaggaatcaaatgacaaatttattttgattaattatcaagaaaatagagaatatgatattattttcactttctgatacaagacccaactcgtgagcctgagcctgtcattgccctgggacctctgctgcatactctttggtgccaattatgtatttgcttctctctctcactgacacaccttcctgtcaccttgctctcctatcaacatgtcattttgtaaaaggggcagcagaagataggaagaacatagacctcaacctgaggtaagctctatagtgtctaaatattaacagttattgtctattgtacatcaacgattgtattggaccaccctcaagattttgccatacccatatttcttctctgttatgattcacttaatacttttctccaaattcattctttttttaatagttacatttctgaaaacactttaaaattaaaacataactaatgaaaggaaaattactttgcattccacctaaaatcaactcaaatgctcctagtggtataggtctcacagcatgggaaatactgctctatactattcgtttatcaatgaataggaatactacatgatgtttctcttacccagtgagcagttaaagtatttttgtattatactttaagttctcaggtacatgtgcagaacatgcaggtttgttacataggtatacatgtgccatggtggtttgctgcacccatcaacccgtcacctacattaggtattacttctaatgctattcctccattagaccaccagcccccaacaggtcccagtgtgtgatgttcccctccctgtgtccatgtgttctcattgttcaactcgcacttatgagtgagaacatgtggtgtttggttttctgtttttgtgatagtttgctgagaatgatggtttccagcttcatccatgtccctgcaaaggacatgaactcatctttttttatggctgcatagtattccatggtgtatatgtgccacattttctttatccagtctattattgatggacatttggattggttccaagtctttgctattgtgaatagtgctgcaataaacatacatgtgcatgtgtctttattagcagaatgatttataatccttcgggtatatacctagtaatgggattgctgggtcaaatggtatttctggatctagatccttgaggaatctccatactctcttccgcaatggttgaactaatttacactcccaccaacagtgtaaaagcactccaatttctccacatcctctccagcatgttgtttcctgactttttaacgatcaccattctaactggagtgagatggtatctcattgtgattttgatttgcatttctctaatgaccagtgatgatgagctttttttcatatgtctgttggctgcataaatgtcttcttttgaaaagtgtctgttcatatcctttgcccagtatttgatggggttgtttgtttttttcttgtaaatttgtttaagttctttttagattctggatattagccctttgtcagatggatagattgcaaacattttctcccattctgtaggttgcctgttcactctgctgatagtttcttttgctgtgcagaagctatttagtttaattagatcctatttgtcaattttggcttttgttgccattgcttttggtgttttagccatgaagtctttgcccatgcctatgtcctgaatggtattgcccagattttcttctaggatttttatggtcccaggtcttagcttttagtctttgatccatcttgatttgatttttgtataaggtataaggaaggggtccagtttcagttttctgcatatggctagccagttttcccaacaccacttattaaatagggaatcttttccccattgcttgtttttgtcaggtttgtcaaagataagatcgttgtcatggcatgaaaaggatgacctttccagtctgcaatacctgcttgaccactaagaccaaacagctcaaattaaaggtaacaaattccgcagaggcaattgttcaacacaggaaaaagaaaccactttaaggattttaaactggaagagattttacataagctgttttaaacaaaaccattggatgacctggagtaacagtgtcggaaactcagctgagctggatagagaactgagctgcccgttgttggagaagttgattaaagcagcagccgaagatcgaagtaacagtcaagactgtaatcacttactgcaatagtataagcaagaggccaaaaccaaagaaactgccaactcacccaggtcttctaaattccccagaaaggtgcactagtggagggtcagtgaatcaggacagacatgggggtcagctcacgattgaggaagccccaaacaaaaatctccagtagtattatgaaccctggagcaggaggttggagtgagacaaggagagctaggagtagaagagtatggagtcggaggagggaacggtttcttaaggtctcctcccactctactcttaagaaagcttcagtagaagcacctgaagaaaactccagcaggaagccctcagataaagaaacttctgaatgaagacacctaggctaggaatgcaaatatgtttaagagcatgggccattaggggaatctgagttccagaatgcaattctctttaaagattgcaatgcactgggtatgccccaagtctggggagggcaactttcctcggaggggtttgccagataaagcctttgtcattgcctgtggttgggcctgaaatatcaaacatagatttttggccaggactcctcagcaggatctagtcagggccttcacaaagtacattcagaatgacaattgacccaccagaaagccatcatgccaccacttgatattttaaatgaaaagacccaccaacatatctgatatccatatctgatacccagtagaattggaatgctgctatcaccactgtcactattgtcactaccacacctgcctctagaaacccagcaatctggaggatggaccctggataatgttgcaggcaaacctcatttctctacaactgtgctttccaccaacagtcgattaaaggaagacgaagatcgagtgtgtgtggatgatacagcaaataaaccttcttctagttcttaaagattatggttttcagtgtttagtgagcatccgtgttcatctttaaaggatagaaaaatgcaggaggcatcttgtatccatgaagatactaaaacacggatttcctcaggaaattgatcactcaagcatccataatcttagtagactgcccttatagtcgtattgcagaatgtgtgatctgccatctactgagggctcatttttccctctcctctctcatccaagattggtgatagtttcaaatttttctcccactattatgtagaataatttccaaacttgacactcaattgaatcatggtgtccaggaaaatagataaaataaatatgacttcatataccagaagtcatattcctttgaatacaatcagggccataaatggcacttgcttctataacacaaagtgctattataattatatacatgattttttaaataattaagtaacttggaaccagtttctattgcaataattataagaaacaaagacctccaactgaatgaacccctctgaaatattttaataaactctgaggagtactatttgtcaagcaaagaaatactgaattaaggtaaatgccagcttaggatgaaaagaacagcaacagtgcctaccttcattacctcagcctctccctggctaagataatcacttaatcttttatgcctttgctaaaacctcattagtaaaaaggagacctgcctactaagcataaggttaaggctttaatggactttagaaatcatttacttttatgactcaaagcactgaagtgcaaattctttttatttgaatatttgagggcattaaatgagcatttttaatggatttcaattgtcaggataaaataaaatttctcaaggggaatctgaattttaacaaacattaaaatcaaagaagtaaaaagatgaataaatggagaaaaagtattgtagtaacatcaatttttgccaatctaattttttaacaaaaacttttaagtctatttttggccaggcatggtggctcacccctgtaatccagggctttgggaggctgaggcaggaggatcacttgaggccaggagttcgagaccagcctagccaacatggtgaaaccctgtatctactagaaatacaaaacttagccaggcatggtggtgggcaccagtaatcacagctactcgggaggctgaggcaggagaatcgtttgaacccgggaggtgcaggttgcagtaagcgccactacactccagcctgggtgacacagcaatacaccatctcaaattgagtatatttatttagttttaaaactaactttgaaaatctcttcacctagggaagttatttcctgaaactattttctactgccttttagaaacactgccttcctggttttgtttcttttttgtatgttggctttgtttggtttgggttatgtttgtttgaagaaaaaaaaaaaaacctgaagtgattcttgaagtatttttaagtgagcacattttaatttgacataacattggatttcacttggtgaaaagagagatactgaataattagtagtatctgataagatgtttagacggagaagtgtagactcaccatgtacaaagcagctatgatggtgttcgcccacctcttcccctgcctaatgcctattcatctgacatttatcatccagatttcacttcctctaggaagcttccttgatgcctccaaacaaggtcgaaagcactatctacatgcttcttagcaatctgtagctctaccatcaacattttattctgattttgcatttaccttctttcctctagtagaatatgtgccagactgtgtcttgctaaacattgttaaatagcactagtatactgctggtacagaataagacaaccaacaaatattgaatgaatgaatgagtgaacccagagttaagcatctgctcacttagtgattgggttggtttcaggtggaaagtccataggctgatatcaatttgactggtatcagtaagaagggaagtgtaagatacacaggtgtcagtttcctgagggtcttagatgaatgctatgtagactggacttatttcagttgttagctctagatatgagggacaggcagacgatcactctgaagcaggttggagcacattttagtgggcatttattggttaccttctcagtatattatctagtctctgttatcccagaaataccccaaattgcaagccacttagcaaaagaaatttaatctttacaccctgttctaatttaatctacctttttgctactaccagctttccttggccatggtgactgagtcaaggacagactcataatctaaggcaaagcaataagtcatcaggagactcaatacctgcgtgtctctcaaccattggaaaaagtgaatattctttgtatctggatgtgaatgagaaaatacacaaccccaggagctgctagaacccatcttgagtttgaagagtttgccttataataaaaccaatatcaaaaaaggagggtctaatatggggaggtacaagcttttagtgatattgtttgagtcttggataaagattcacttgaagctagaatctgccctccgcattcctttataaaccttgcgacacatgaaactgagcgtgttacctctcaaaagtattcccacaacagtagtcacaaacctgtcataacagtcaacatactacattgaaataatttgtttatatgtgcattcccctatactgtgagcctttggggcatcagacatgtcttgtcacctaggatggtatctggcacatatttagtgctctataaatctttgtagaattaacaaatgaatggatggataagagttgcaatagaggtaaattatatttccaaatttttttatttattcctgacaaattaatcatattcctgtatttttttctctatatttcaaaggtaattagatgtcaacactttttactttcctttttctgaaggttttataaggaaactatgtgcaggatatcaattttttggagaatgactcccacattggctattctagcttattcccacaggaattcctaaaaccaagcaaataatttcaaatttgttgagatcgcataatttagtttagaataaagagatcttgtcacctttcctctaaaggaagtgtctgctacaggcattccctatgggtatgtataattggaaaattaaaaagcatatttaaaggcaacattgtgctataaaaaatgttggcaatgttccaagggggactgtgtatgctattagatatttttgagaatttactctgcctgtgctaagaattttcaataattcccttcttgggtaaaattagggcatcagcagagaagtaaactctctaatataagcagcaagtttccatttttcaccataatgtgttcctaaaaactatgttgggaagtaaaatgattaaaaatagaacttttttgctttcatacaattttcgttaagtttaaaactgaagttatttgttcacataagcaagtaatatttatatactggttaggtgagatattgatcgtggctttcttctggagccaagagagaataaaacaactggacaatgtaagatggctatgtctctcagaaagtaatacagtcgaaagcctagttcaaagtaagaaacacatagtagatataacaccactgttcattccagagcctgtggaaggtggggctatttgctcatgtcattctttcctgatttatctatattaaaccttagaatctttcttaataccaaacttgaaatgtcactagcattcatttgaaattgttactagcattgacaggtttaataccgtagacttaaggtgactggcttacatgcctacaaccagggaaacattttcacctggtggcaacatcttgatttgcagtcatagacccaggagaaagaatccaacattttaagtctaattcagcaaaaccaggtctacaaatagtggcaaacataacttaagaaattatctttaaaatgatggcttttactacacttcgtgaatttctagaagtcccctgcccatgctatcatgggatattttaataataatcaaattgttatgtagatatgccaaataattctgttcaggcagacccatttaattcagcaggaatttgccgatatcctgttctatgcatagttcattagtggattattttaggagtttgaaaaaaaacacctgtgctttaaaaatttatactattttaatgtcacaaatatatatgcagagttctgcttccactaatgatagagtagcttatattggattcagtttaccgaagactagaattataaatcaggacaaaatattaaaacaaaaaaaccaactatttaaagatacaagacagtggtcaaatgcaagcaaaaaatgaaatttccttttgaaataaggagactacagtaggtgaaatttgtgtgtatgtgactttgtgcatatggacactcacaaaccaatgggatatctagaactcaattttaaagctaaagtctcactacctttaagagtcaggggataaatttcagggctgaaagtttttctgaaaagtgagggatgagaccataagggaggaagccacatccagtaattcatttatatatataaaacatacacacacacaaacacacacacacacacacacatcacactacgatcaccactgccacatcaccaaaatttcttggctagtccctgaacagcacatgtgtggaaaattccaaggagactggcagaaagcagtaggtgcaaggccagagaaactaagcatatcctagcctccacaggatgtggagtttggagtttgaggttaaccaaatagcccaatggatccaaaattaatactcctcagaagatgataaaactcagagtctctacaatgtatcactctaaatatccattatacaatcaaagattactatctatgtgaacaaataggaaaattttactcatagtcaagagcaatatcaagcaagagaaaacaacccttaaatgattcagatgttggagttagcagacaataacttaaaagcacttattataaatatattccaacatgtaaaagaaattattgtgataaaaaatgaagagacatggaaaatcaacaaaaaatttaaaacctagcaaataaccaaatcaaaagtttaggactaaaaaatacaatatctgaaataaaaatttaactggatgagctaaacaaaattggtgataaaaatatttggataaatcatggccaaggattccccacatacagaaaaaaaatgtaaacctttagatccttgaagttcagtggaacaaaatggaaataaattaaaagaaaaccacatttatgtacatccaagtcaaactggtgaaaacaaaggataaaaaggaaatttcagggaagccagagaacgcattacatagaggcaaaatacatacagacagtctatgacttacaatggttagacttataattttccaactttacaatggtatgtgaaagcaatacacattcaataaaaactttactttgaatatccatgcaaccatcctgtttttcacttttaatacagtattcaataaattgcatgaaatagtcaacattttattataaaacaggctgtgtgttagatgattttgcccaactatagactaatataactgttctgagcacatttaaggtaggctaggctaatctataatgttaggtagggaggtatattaaatgcatttctgatgtgatattttattgggtttattgggatgtaactccattgaaatttgaccatatatatatgaacactggctaatgtcccataagaaataatggaatccaaaaagcagtggaaagaaaaaatactatcagcatagaaattattattttaaaataaaggaaaaataaagacaacaaaaagtgagagaactgatttatagcagattatactaaattaaatgctacaggaagttattcagctaaaataaatcataatatatagattccttcagatctacaagaaggaataaagagcatcagaaatacaaataaatgaatacatatattatccattttttcactgaatttctttaaaagcccttgcgtatttaaagaaaacattgtaacttttattgttaggtctacaatgtatgtacatgtaatatacataatattaatagcacaaaggatggggtaggaggttaaatggatctatgctgtctggaggcttgtgcattttacaaaaaaaaatggtacaatattaacctacatcaactgtgatgagtaaaagatacatattataacacctatggcaaccaataaatgtaaatccaaagaggtataacttaaaagttaatagaagtatcagggtttaaattttgtccctctaaaagttatatatatctaagttctaatccccagtacttcaaaatgtgagtttatttggagatatggtttttacagaggtaatcaagttaaaatgaggtaatttgggtagctcctaatttaataggatttgtgtccttttaaatggtaaaatttggagacagacacacacacacagggagaaagccaggtgaataaggagatggccttctataagccaaggaagagaggctggaacaaattcctctctcatggtcctcagaaggaaccaactatgccaacaccttgattttaggcttctactcttacaagcttgtccaacctgccttattttgttgttgttgttttgttttgttttgttttgttttgttttaggcttttagcagcctaaagccatggtttttcgtttctgtctctggtgattagtggaaaagaggcatgaggaaggggttttactagcccaaccagagacagaaactaagaacccacaactgtattctctcccttggacacccctgcacactgagacaaagacatttcttttgtttaaactatgtatagtgtagtactttgttacagtagagatagcaaattaatacaagaggatttaaaataaaattttaacaaatatttgattaaaagaaaaggaagtagaaaaagaggaacaggaacaaccaaaagagaaaaaaaaacaggaaggataatggagaaaaaaataataaaaggttaaacataaacccaatcacgtcaattaaatgtaaataaatgaaataccttatgtaaaaaacagaatgtcagactgaatttaagaaagcaagatctaaatatatgctatttgcaagaaatgcacattaaacataaaaacacagcaagatagtcagtagaaggatagtgaaaggcattccatgaaaggactaagcataagaaaggtgaatcaatgtgttaataaatattactgtatatgttatattagcatcaaattatctttttaaatattcatgtaatataaattttttatgatgaggaaatttaccagaaataacaaaggacattttacaattctaaaagtctctattaggaagatgaaacaatcataaatgtgtattatctaataacagtttcaaaatacatgaagtgaaagtctaacagaactaaagggagtaaacagcagacccacaaattaggtagaaattttaatagccctctcaaaataattaaaagaataactagataaaattcatcagtagactataaaatagctaaacaacaacatcaactgctttgatccaattgacatttagggaaaaatatatactgcaaaatgcacatactttaatgcccatagatagtcatcaaggtacactatatgctgtgtcataaaacagatctgaataaattgctaaggactgaaattttacaaagcatgttcagtagggaagcatatttaatgcatttctgacttatgatattttactgggtttactggaataaatggctctactattctggggtctggaaggtgatggcactcttcccacagctccactgggcagtgccccagtggagactctttgtgggggctccaaccccatatttctccttggcacttctgcagtagaatgtctttgcagtggcaccaaacctacagcaggcttcttcctgggcacccagcctttcccatacatactctgaattctaggtggaaactgccaagcctcctttaactcttgcattctgaaggcctgaagaattaacaccacatgaaaaccaccacagcgtagggcttgtgccctccagagtagcagcctgaactgtatctgggtccctttgagtcatggctggagctcaagcagcaagggatgcagggagcagtgtgcaagcctgcacagagcaacagggtccagagcctggtccctgacaccattctttgctcctagacctctgggcctgtgatggaaagggctgcctcaaagatctctgaaatgccttcaagacctttttcccattgtcttggctattagcacttggctcccttttagtcatataaatctttctagcaagcggttgcttcctacccacttcaattcctctccttagaatgctcttgccttctctaccacatggccaagctgcaaaatttccaaacttttattctctgcttcccttttaaatataagattcaattttaagtcattcctttgctctcatatctgagtgtggacagttacaagcagctatgccacaccttgaacattttgctgctaagaaatttcttctgccagatactctaggttataattcataagctaaagcttccacaaatccctaagacatggacacaatgcagctaagttctttcctggggtgtaacgtgggtgatcttcactccaggtctcaataacttcctcatttccatctgaggcttcatcagcctggccttcactgttcatatttatatcagcgttttggtgataattacttgacaagtctctaagaagttccaaacttccccccatcttcctgtcttctgagccctccaaactcttcctacttctgcctgttgcccagttccaaagctgcttccacattatcaggcatcttcatggcaaaaccccactctcaataccaattttctgtcttcatcctgtttgcattgctataaaggaaaacctgagactgtgtaatttattatcaaaaagaggtttatgcagcttatggttccacagaatgtgcaaacatggcacccatgtctgttcagcttctgataaggtctcaggaagcttacaatcatgatggaaggtgaaaagggagcaagtatgtcacacttcataaaagagcaagagagaagggggagatcccagataattttaaacaaccagatcttgcgtgaactcatcgatgagaactctctcattaccatgaggacagcaccaagtgattcatgaggaatccacccccatgacccaaacaccttccacaaagccctacccgcaacattggtgatcacatttcaacatgagttttggaggggacaaaacgtttaaactatatcacaaccttaacaaaattttaagaaattaaaaccagctatttgtaaataattatcattataaccaaatgaaatttacctgaaactatatcattgatttaaaatctaaaatcaatcattacattcaccacattatcagaataagtaaaaaacaaaaacaaaatacaaaaaagactgtaactatcaaaaaatcaaaaatatttaaaaattgatcatttttggtgtcatttgattgaatcatttgatacgattcaatactcattgagttaagaactctcagcaacctagaaacagaagagaacttcctcattctataaaaggcatctgagaaaaatctacagaggacatcatacttaatgatgaaacatttagtgacttcttactgggatcaagaacagatgtttactattacttctgctattcaacattgcactgtgtaatctaactagtgcaatagtgcaaaacatagatcaaagaaacaaatattgaaaagataggagtgaaattatgtttattcacagataatattgttgtctatatggaaaattcttagtaatctaggaagcaactattgtaactaatatttgaatttagcaaggtttcaggacacaaaatcattaaactaaagaattgcatttctatattctaccattaaaaattgcaaataacacttaaaagactattacacttaaaataacataaaaaatattttattgttcttagaaataaattccactaaaagtgtgcaatacctctataccaaaaaccacataacattgctgaaaaacatttttaaagacctaaacaaacagaattgcagcatgttcatgaatcagaatagtcaatatttctaaggtgtcaattatttcccaaatctataaattcaatgcaatcccataatcaaaggtagtaactttctagaaattgtcaaactgacactattatttacatgaaaattcaaaggacatagaatagcccaaatattcttggaaaaaaagaacaaaactgatggactttcatcatctcacttcaagtcttggcataaagcttcaataataaagatagtgaaatattggcttaatgacagtcaaatatgtcagtggaatagagtccagaaacagaccaattcttatatggtcaattaattttccaaaaaatgaccaaagttatttaatagcgaaaagggagtctttctttaaaaatggtgctacagcaactgaatattcacatgaaaaaaataaaaataaaccatgaactcttctgttagtctgtttagtgttactataagggaatacatgagactggataatttataaagaaaataggtttatttggctcacagttctacaggctgtatgagaaataaaatgccagcatctgtttccgaggagggcctcaggctgcttcctctcatgatggaaggcaaaggggtaacaacatgtacagagatcacatggtaagagaggagcaagagagcaagtggagagacgccagactgtttttaacaaccagttcttgtgggaattaatagagtgagaaaccactcacccccttaaggaaaggcattaatctattgataagcaatctacgcttacaacccaaatgcctctcattaggccccatttccaacattggagctcaaatttcaatctgagatatggagaggacaaatatccaaactataacaactctataccataaacaaaaattgtttttgagatgagccataaacctaaatgtaaatgttgaaagtataaagtctctagaataaaacatagaacattatttttgtggcctggagttagacaaacatttcttaaatacaatacaaaaagcaataaccataaaagacaaaaatgaatacactagattcatcaaaatttaaagtatctgctcatcaaaagatcattaagaaaaagaataggtaagcttcatactggtagaaaatgtttgcaatacaatatttttgacaagggttttattttcataacatgtaaataactcctacaattcaatagccagaagacaaacaactctataaaaatgagaaaaacttgaacagaaaacaacctcccaaggaaaagcatagaaatggtcacaagcccatgaataaagcattcaatataattagctctcagaaaaatgcaagttaaaaccatcagaagatgccagtacacactcactaaaaaagcaaaaatactcacaagtcaatcactgggggacctggagcaatcagaactctcatacactacactgaaactgtaaaatagtacaaccaccttgaaaaacagtttgtttcttattaagtcaaacatacacccaccctatgatccagcattttcacacctaggtattctcccaaaaagaatgaaaacaaatgtccacaaataacttgttcaagaatgttcatagtatatctattcataatagcaaaaaacttgtaagcaacccagatgtccatcaacaggagaattaataaataagttgtggtatattcataaaaggagtcctactcagcaataaaaagaaatctattactgatacatacaacagcatggagttatgtcgagcaaaaagtcaggcattaaagagtacacatactatgtgagtctattagaaattctaaaacaaacaagactaatctatagtggaaaattcataaaagtgtggcctttgggtgaagaggtcattgactgagaaagaattttctaggttgacaaaaatgttctgtatcttgatgggtattatgatctgaatgttgctgtgccccactcccaaatttatatgttgaaatttattccccaatgcattaatattaggatggtagggctttgggaggtgactaggtcatgagagaagagcactcatcaatggattatgctcttataaaagagattaaagagggagagtcctagcctcttgggacctttcggccatgtgagaacacagcaagaggtgccatctatgaagcacagtgagctttcaccagacatcagttccactggtgccttgatcttggacttccccacctccagaactgtgagaaataaattcctattatttataagtcactcagtctaaggtattttgttatagcagcctgaatggactaagacaatagggatggtggttacactggtgtatgtatctggaaaaacattgaatggtacatttaagatttgtgtattttaatatatataaattttaaattaaactgaaaacaaaagcaatattggaaataaaagacagcttcatagagaaaaagatgtagacacatgccacagacataaaaacagaaactatcaatacaagaaggaatacaaaaaagaattctacatataatttaataaaaatccatctgaaaattaaggtaaggaattggattttgatacataagttcctaaagataagtttgaatatcatttatgacaaaagacctcataccatttttattagagatatatgggtattttcattgtatattgtattggaacaaattctaggtattcacatatgtatagtcattgcactaagatattcaataaaacgatttattccaattatatctcgctaatttgccagcaaaaatgactaatttttcaacctggtgcttcctaagagagatctaacttggctgtaaattttttaaatttattttattattctgttggctgctcctggacttcactgtgaaaggtatttgcttgcaaacatattaaagtatgaaaaatatccagagacagtaacctaatatattgtcacacatttacctattatctcaagaaatagcatctgcttcaattatgctaataaaatgattctgtggattctgtatgctattttctgcttattgaaaataaaaacatagcaaactatgttaatttcaaacaaacttgcacccaatgtctttcatttttgaaaagagcagctagctactttgttcaatgatacaggcagtatctttctcacttgctctcaccgttcttctaatgatttcagggctaaggaaaatgtttagaatactacccagaaaatagccataaggatattattacacatagtgcatcttgaattggtaaaataaccaaaagtttttctactttattaatagaattacccacttctacatgaccaaacttctgcttgaccttgttttacacagtcgtctaatatactattttcttcacttatatctcccagacatcagcaaagacatctgcaaaggcttgaagccattctcctttgccttaggaaataggtccgaaatgattcaatgtgccagcctgctctcaatgctacagttatagatgggtcttttctgtgagccatgccaagcataaatccaaaatcacaggtatcaccatagattttacattacttatactgactttctagtggccattaggaataccataaaaactaatatgcctaagtgggtttaatctctcaggaaaagcttctctgcattttcctgcaacaaggctttcaggccactttgagtttaattcaatttaattactgagtctccagctccacagagattcctggctgaccccaataaacagattttctcaggttgcctcacacccaagccctgtagtctctttgctcacagttacataaaaattgtgttgttgtataaaatcatcaatcaaccctgagcaaaacaaataaattagaggagcattcctgggactggaaaagaatagtgagccttagagagaagagaattggttgagtctattcctgcctcagatttaaactaaaatccattacatcaccagaggttcattccattttggtgcctgcctacctgtgcatattactgcacagtaatatctttataatttttttaacactaaatttcagccaagttgaacatctttggcttcttctagaatatggtgtactttcttgaatctgtgcctttgttcacactactctctcttacaaccatttctccccacatatatccacacacttaccttcccccattttgctgaaacatttcctacctacaccacatgtctcacattagttgcatttttttataatttttattttttgtagataccatacatttatgaggtacctgagatgttttgatacaggcatataatgcataataatcacatcagggtgaatggggtatccatcacttcaagcagttatcctttcttagtgttacaaacaattcaattatactcatttagttattttattttttttaatttttgtaatttaatttttaagttgatgggtgcatgcgcaggtttgttacagataaacttgtgtcataggggtttgctgtacagattatttcatcacctaggtattaagcctaatacccattaattatttttcctgatcctttccctcctcccagtcactaccctttgattgggctcagtgtctgttgttcctctctatgtgtccatgtgttctcatcatttagctcccacttataattgagaacatgtagtatttaggtttctgttcctgcatcagttggctaaggataatggcctccaactccatccatgttcctacaaaggacatgatctcattcttttttatggctgcatagtagtctatggtgtatgtgtaccacattgtctttatccagtctaccattgacaggtttttaggttgattccataactttgctattatgaatagtgctgtaattaacatatgtgtgcatgtctctatgatagaatgacttatattcctttaggtatataaccagtaatgggattgctgggtcaaatgatatttctgtttttaggtctttgaggaatcaccacactgttttccacaatggcttaactaatttacactcccaccaacagagtgtaagtgttcctttttctccacaacttcaccagcatctgttatttttttactttcaatagccattctgactggtgtaacatgatatctcattgtggttttcatttacatttctctaataatcagtgatattgagctttattttatatgtctgttggtcatatgtatgtcttcttttgaagtgtctgttcacgtcctttacccacttttgtaatgagcttgtttttttcttgtaaatttgtttaagttccttacagatgccagatattatacctttatcaaatgcatagtttgcaaaaatgtgcccccattctgtaggctgtcagtctactttgctgatagcttcttttgctgtgcagaagttctttagtttaattagatcccatttgtcaatttttgcttttgttgcaaatattttgatgtcttttatcgtgaaatctttgcccatttctgtgttcagaatagtatttcctaagttgtcttctggggtttttatacttttggatgttacatttaagtctctaatccatcttgagtcaatttttgtatatggtgtaaggaaggggtccagtttcaatctgcatatggctagccagttatctcagcaccatttattgaatagggagtcctttccccattgcttgtttttgtcagctttgtcaaagatcagatagttgtggatgtgcagcattatttctgggctctctattctgttttgttggtctatatgtctgtttttgttccagtaccatgctgttttgtttactgtagccctgtagtatagcttgaagtggggtagtgtgatgcctatagcttcgttctttttacttaagactgccttgactatttgggctcttttttggtttcacatgaattttaaaacagttttctctagttattggtacttcattaggaagagtattgaatctataaattgcttttggcagtgtggccattttaatggtactgattcttcctatccataagcctggaatgtttttgcatttgtttgtgtcttctctgatttctttgagtagtgtttttcagttctccttgtagagatatttcacctccgtggtgagctgcatttctaagtgtttcactcttttgaatggtgattgtgaatgggattgaatttctgatttggctcttggcttgactgtttttggtgtataggaatgctagtaatttttgtgtgttgattttttatcaactttgctgaagttatttatcaacctaaggagcttttgggcccagactaaaaagttttctagatatatctgcaaacagggatagtttgatttctgctcttcctatttgaatactctttatttctttctcttgcctgattgctctagccagaactttcagtactatattgaatagaaggagtaagagagggcatccttgttttgtgccaattttcaagggggaatgctttcagattttgttcattcagtatgatgttggttgtgggtttgttatagatggcgcttatcattttgaggtgtgttccttcaatgactagtttattaagagtttttaacatgaaagggtgttaaattttatcaaaagacttttctgcatctattgagataatcatgtgttttttgtctttagttctgtttatgtgatgaatcacatttgttgatttgcatatgttgaaccaatgttacatcccagggataaagcctatgtgatcgtggtggataaggtttttgatttgctgctggatttgatttgccagtattttgttgaggatttttgcattgatgttcatcaagggtataggtctgaagttttgtggggatttcttgctgtgtctctgccaagttttggtatcaggatgatgctggtctcataggaagagttatagaggagtcctcctcctcaattttttggaaagtttcagcaggaatggtaccagctcctcttcgtctatgtgatcctgagcttttttcgtttggtaggctatatatttggtaggctgattcaattttgaagctcattattactatgttcagggattcagcttcttcttggctcagccttgggacagtgtaagtgtccaggaatttattcctttcttctagattttctagtttatgtgcatatgggtattcataatattccctgatgattatttgtatttctgttgggtcagtggtaatatcccctttgtaatttccaataatgtttatttggtttttctcttttttctcattagtctatcttaacagtctattttattaattttctcaaaaacaaacttctgaaattgttgaccttttgaatggtttttcatgtctcaatctccttctcagctctaattttagttatttctttgttttctgctagctttgggatttgtttgcacttgtttctctagttcttttagttgtgatgttaggttaacttgagatttttctaattttttaacgtgggcatgtagtgctataaattaccccttaacactgccttagttgcatcccagagattctggtatgttgtatctttgttcttattagtttcagagaacttcttgattttgccttgatttcattatttacccaaactcattgggagaaggttattcaatttccatttaattgtatggttttaagtgaatttcttagttctgatttttaagactaagaaatttgattaccctgtcgtttgacagagtgcttgttataatttaagttcttttgtatttgctgagtagtattttatatgcagttatgtgattgaccttagagtatgtgctatgtgatattgagaagaatgtatattctattgttttagggtagagagttctgtaggtgtctattaggtccatttgatccagtgttgagttcaggtcctgaatatctttcttaatgtactgccttgatgatctgtctaatactgtcagttgagtgttaaagtctccaagtacttttgtatgggagtaaaagtctctttgaaagtctctaagaacttgctttataaatctgggtgctcctgtgttgagtgcatatttagttaggatacttaggtcttcttgttgaattaaactctttaccattatgaaatgccctactttgtctttttttatctttgttggcttaaagtctgtcttatctgaaattgagattgcaaactccgttttttctgttttccatttggttgatagacttttctcccgttattttgaacctataggtgtcactgcacataagatcggtctcttgaagacagtatatcaatagatcttggttctttatccagcttgccacactgcaccttataattggggcatttagcctagttgtatttgaggttagtattgatatgtgtgtatttgatcctgtaatcatgatgttagctagttattatgcagaattgttgtgtggttgctttatagcgtcactggcctccgtacttaagtgtgtttttgtagtggctggtaatgatctttcttttctatatttagtgcttccttcaagagcttttgtaaggcaggtctggttataatgaattccttcagcatttacttgtctgaaaaaggatcttacttctcctttgcctatgtttggtctggctggatatgaaattcttggttgtaatttctttctttaaagaatgttgaatattggcccccagtatcttctggcttgtagggtttctgctgagagacctgctattgttctgatgggcatccctttgtaggtgacctgccctttctctctagctgcctttaacattttttcattcatttcgaccttggagaatctgaagattatatgtattgaggataatcttctcgtgaagtatcttactggggttctctgaatttcctgaacttgaatattgacttttctagctaggttggggaaattctcatggatgatatactgaaagattttgtttcttatgaaggtgtgttttttttttttctatgtaaatagttgttaaattggtgtgcttgtggaggggataattggtggagacttctattctgtcatcttgctccaactctcctcatttacttattttaaaatttacaatcaataattgttgattgtattcaccctcttatgctaccaaatactagaggttttaagttctacctaaatatatatgcttttatccattaattatctccgttttcctctactacctttcccagcctctggtaaccatcattctactctccatctccatgagttcaattattttaattttagctcccacgaataagtaagatcatgtgaagtttgtctttctgtgcctggctcatttcacttaacacaatgacctacagttctattcatgttgtgcaaatgtcaggatctcattcatttttatggctgaatagtacaccattgtgtgtgtgtgtgtgtgtgtgtgtgtgtgtgtgtgtattatatatcacattttctttatctgtttgtctgttgatggacatttaggctgcttccaaatcttggctactgtgaatagtgctacaataaacatgggagtgtagatatctctttaatgtactgattttcttgcttttgagtatatacctagcagtgagactgctggatcatacgatagctatatttttagttttttgagaaaccaccaaattgttttccacagtggttgtactaatttacattcctaccaacagtgtatgaagatttctttttctccacatcctcaccagcatttgttatttcctgttatttggatataagccattttaactggggtgttcttggtacctttgtcaaaaataagttcactgtaggggtgtggattggtttctggtcccttattctcttccattgtactatgcatctgtttttatgccagtatcatgcttttttcgttactatacctctatagtataatttaaagtaaggtaatgggactcccccagttttattctttttgctcaagaaagctttggctattctaaatcttttgtggtttcatataaatcttaagattgcgttttttcatctcagtataaaaatgtcattggcatttcgatagggactacattgactctgtaggttgtttcaggcagtatggacattttaacaatattgattcttccaatccgtgaacattaaatatctttccttttggtgcatttgcttccatttctttaatcaatgttttacagtttttgttggaaagatctttcacttcttcagtgaagtttagttctagccattttattttatttgtacctattgtaaacaggattacttccttggtttcttttccagattgttcacttttgccatatgaaaatgttgataattttctatgttgattttgtatcctgcaactttactgaatttatcagttctaatagtttttttgagtctttatgtttttccaattataagattatatcatctgcaaacaagaatattttgacttctttatttccaatatagttgcccttttttttttcctttgtctgattgctccagctaggacttcaaatactatactgaagagcaatggtgaaagtggacatctttgtgttccagatcttagagaaaaagatttcagtctttccctattcagtaatactaactgtgggtctgccaaatatggtttttatttagttgagatacagtccttttatatcaagtttttttagggtttttatcatgtaggaatattgaactttatcaaatgctttttcagcctcaattgaaatgattatatggtgtttatccttcattctgttgatgtgatatatcacattgattgatttgagcatgttgaaacatcattgcattccagggataaatcccacttggttataatgaatgatctttttttttctttttgagacagggtcttactctgttacccagactggagtgccacacacaattacagctcactgaagcttcaaccttttgagctcaagtgatcctccttcctcagcctcctacgtagctagtagcaaaggcacatatcaccatgcccagctattttttgtttgtttgtttgtttagtagaagcagggtctcagtttgttgctcaggctggtcttgaactcctgcactcaagcaatcttctaaccttggactctgaaaatgctaggactacagtcatgagccaccatgcctggccaaatgatttttctaatgggttgttgaattcagtttgctaacattttcttgagaacttttgcatcaatgttcatcaggaaaatttgcctgtagttttgttttgttttgttggttttttttttttttgagacagagtctcactctgtcacccaggctggagtgcagtggcacaatcttggctcactgcaagctccgcctcccggattcatgccgttctcctgcctcagcctcccgagcagctgggactacaggcgcccgccaccacgcctggctaattttttctattttttagtagagactgtgtttcaccgtgttagccaggatggtcttgatctcctgacctcgtgatccaccctcctcagcctcccaaagtgctgggattacaaagtgtgagccacctgcctggcctgttttgttttattttgtttgtttgttttttgatgtgtctttggttctggtatcagggtaatactggcctcatagaattagtttggaagtattccctcttcctctatttatcagaagtttgagtaagactgctgttagttcttctttaaatatttagtaaaattcagcagtgaagccattaggtctgagcttttctttgctgagaggctttttgttatggctttaatctaattacttcttatttgttcacattttggacatttttgtggtaaaatcctgataggctttatataggaatttatccattttttctaggttttccaatttattggcatatagttcttcatagtagcctctaataaaatttctgtagtaacagttttagtgtctcttttttatccctgattttatttgggtcttttcttgtttttttcttagtatactaaaggtttgtcagttttaattatctttccaaaaatccagcttttgttttattgatcatttgtattggtttctctatttcaatttgagttattttctgctctgatctcgtgttattttttttcttttacaaattttgggtttagtttgctcttgattttctagttctttaagatccaacattaagttttttatttgacatttttctacttttttgatgtaggtgctttagctataaacttccctcttagtgctgctttcattgtatccattggttttggtatgttatgtttcactgtcatttgtttcaagagcatattgtttaatttcagtgtgtttatgtaatttcccaaatttctcttgttattaatttgtagttttattccattgtgttcagagaatatacttgaaatagttttaatgtttttaaaattttaagacttattttgtggcccaacatatggtatctccttgagaatgacccatgcaacgaagagaagaatatatattcttcagccattggatgaaatgttttataaaaacctattaggtccatttggtctatagtgctcataaactctagtgtttctttgttgattttctatctcaatggtgtggccagtgctgaaagtggccagctattattgtattggggtgtatctgtctcttagctctaacagtaattgctttatatatcttggcactccattgttgagcacatatatatttataattataaaatccccttggtgaattgactcttttgtctttatataatgactttattttttgctttgatgggttttttcttgaaatctattttgtctgatataaatatcactactcctgctctttttcattttccatttgcatggaatgtctttttccattcctttatttttagtctttgtatgtctttgtaggggaaatgtgtttcttgtatggaacagatcattgcgctcggtttttttttttttttttaattttatccattcagccactctgtgtcttttgattggagagtttagtccatttatattcaatgttattattgataaataaggactcactcctgtcattttgctatgcatttcctggttattttgtggtcttatcttgtttccttccttcctatctttgttttagtgaaggtgattttctctggcggtgtgttttaatttcttgctttttttgtagctgttgtatgtttttagatttgaggttaccataaggcttgcaatactatcttataacccattattttaaactgatgatgacttaaaactgattacataaacaaacatgcaaaatgaaaactaataaatactctacactttaaccttatcctctcactttttaactttttattgtttctgtttatgtctggtcctgtctatatcttgaaaagttgtagttattatcttcattggttcatcttttagtctttctactcaaaatatgagtagtttacacaccacaattataatgtatactattctgtgtttttctgtttactattaccagtgagtttttacttcagatgattttttattgctcattaacatccttttctttcagactgaagaacttcctttagcttatcttggaggatacgtctgatgttgataagatccctccatttttgtttgtctgggaaagtctttatttatccttcatgttagaaggatatttttactgaatatgctattctagggtgaacattcttcaccttcagcacttgaaatatgtcatgccattctctcttgccctgtaaggtttccactgaaaagtctgctgctagacatattggcgctcattgtatgttatttgtttatcttgctgcttttgggatactttctttatccttaaactttgggagtttgattattacatgtcacaaagtagttttatttgggttaaagctgcctggtgtttcacaaccctcttgtacttgaataccaataccattttctaggtttgagaagttatcttattattcctttgaatacagtttccacacctatctctttctcttacctccactctaagatcagtaactcttagatttgcccttttgaggctatttttttagatcttgttcatgtgcttcattgttttttttttcttttgtctcctctgtgtattttcaaataggctgtcttcaagctcactgtttctttcttctgcttgatcaattttgctattaaaggactctgatgcactattcagtattgaaattgcatttttccactccagaatttcacttggttcttccaaattattataatctctttgttaaatttagctaatatgattacaaattccttctctgtgttatcttgaattttgttgtgtttccttaatatagttattttgaattctctgtctgaaacatcacctgtctctgtctctccagagctggatcccctaaataaggtaccagaactggtaccttatttagtttatttgatgagttcatgttttcctgggtggtcttgatgcttgtggatgtttgccagtgtctaggcattgaagagttaagtatttattgtagtcttcagagttaggcctttttgtacctgttcttcttggaatatttggaaaaaaagattttccaaatattcagaggaacttgggtgttttaatctaagttttggtatctgcagtcatatctgtattatagggtacaccaagctcagtaatgctgtggctcttgcagacttgtagagttaccaccttggtggtcttaaataacttccagaataattctctgaattactagacagagaatcttgttatcttccattacttgtctccaaacaaattgagtcagtctctctctctccctctctctctctctctctctctctctctctgtgctgagctgtctggagctgggtaagggatgacacaagcaccccggtgattactgtggctgggactgggtctgacttgaagctagcacagtactggttgtcaccactgcctggctactgcctatgttcattcaaggtcctagggttctacaattagcatgtgacaaagccagccaggcttatgtccttcccttcagggcagtgagttctcctgatctcagatggatccagaaatgccatccaggagccagggcctggaatcagaaaccttaggaatctatctagtgctctattctactgcatcccagctggcacccaagccactggacaaaggccttccaactattccctccacttcaaggaggagaggagtctctgccaatagccatcactgccccagggccatggcaaatattgcctggctagccaatgttcacgcaatgtccaagggttctttagtcagcttatggtgaatgctgccagacctggggctctctcttcatggaagtaggctctctttggcccaaggcagatccagaaatgccatccaagactcaagtcctggaacaggggaccccaagagactgcttggtgctctaccccactgtggccaacctggtacctaagctgcaaaacaaattccccttcactcttccctctcctttcctcaagcagaagaagtctcctctatgtagccaccactacagggaacacgctgggtcacacctgaagctagcacatctctgagtctcacctaaggcccatggtgagtactgcctgggtatcactgctggttatttggtgctcaaggaactctttagtcagcaggtgatggattcttccatgtctgggtccttcccttcaaggcaggaggttcccttctggcccagggtatgtctagaaatgtcatccaggagctgggtcctgaagtggaggcttcatgactcttccagtaccctatcctattgtggctgagctggtatgtaagttgcaaggcaaagtcctctttagtcttccctctcatctcttcaagtggagaggtatctgtaccagagctgtgagctgtgctacctggggctatgggagggctggagcaaacactcccttggccactccagatggtgtctcactaggtcatgtgtccctcaagtccactggctcagagcccagcacaacatcagaacttgcccaaaacttttagtccttctggcctagattgccttacaagtttacttaggaccccagagcccttaagcctacagtagtggggcttgccagaactcagattccagccactgggataggcaattcccctctggctagagctgttctaaatgctccctcagtgggtgccagctgaattctgccaaatgttgctttctgctgtgacaagacagcactgactttcaatgcatagtcccacaaatcctgtactctccctccctgaagcacacagatcctttctccgcactatgtggctgctgctgggagctgagggggtggggggtggtattagcaatttaagactgtctttcctgccctcttcagtacctctttccgtgatatgaagttaaaaccaggtactatgatcactcatctgatttttggttcttatgaaggtgctttcttacgtggatagttgttcagtttggtgttccagcaggaaggataattagtgaaagcttctcgtcaaccattttactcctccttctctctagttgcaatttttcaaataattattcccgaatgcccccagattctccttaagtgacatttctaggggtttccatagtccctctactcctccaagaattaataaataaatgaagccccaggaggaaaaaaaagagaaaatacaaaatattatatatatatatacagtaaacatgaaatagaactattataatctaaggtcagcttataatattatagaaacaggatgaatccatgctaacaaagttaggtctgttctacagagtttaaaaattgagagatatcaaataaaaatactgatttctggcttctctttaaaaagatttctggaaatactatacctatgttttaacatgccaaaaattgtctggggctggggagcagttaatccctttgagagagtctgtgggctccagttcaccactcctggtcactgcctgcaacacttatatgtgttgcctactggacctctgtcagcgtgttgaacttacagccttgtatagaccaaggttgaaactttaaactctatgtttatgttgacaacatgaggccaaagatgaaacaaaaaggaagaaggatttgtgttctgagatttttaaaagcagaagaaaaataagaatatgacaaagagtatatatccagtttttctgtttcagtagctttagttaagtctagtttgcaaatggttttgtcatgatccgataggaaaggaatgtgaaatggttaataatatgcattaaattaaaactctctgtttatctaggtagcctggtacctgaatacagatggtaactgaataacaatgtcatagagttaaattttcaatgcgaagccatcattcaaatatgtgcttcaggtgctacagtttgatgccctacactgccctgtcaacaaaatgggtggttcctttatgctcaggcaaataggaacacatgagccctgtgtggaaatccaaaaggaatggtccataagaaagcaattcctgtattttatcatagactgttgtccctttcaaagccagggtattatttagtgtatgatctcatctctggagactagtaaaaatatattatttctagtaaatgcaaatttttactttagtattatgagaaaatggggacactttagaccataaaaagggacactttagaccattttatgctttggggaaaaagacttttaaacatgacatgtcatccaaaaaataaatagcttcataaaactgccccagggaagatgaaaaagttgtaagaataaaaatcttctgagacattaaatgacccacaaaatgcaattattgacaataaaattttgttcttcataatacttacagaacctctaaaatatcccttttaatataggtgaacaaagctactaccacatcatattagtttcctattgccactgttaacaaattaccagaaagttcatggcttaaaacaacacacatttattatcttacaaactctggaggtcagaagtcctaaaattgaggtgttttcagggctgtgttccttctggatgctccagaggaaaatccattatcttcttccacccagctgctaggggccatttacatgccttagctcatggcctcttcttccatcttcaaagccagcactgtagcatcttcaaatctctctatgactctgaccctcccccatccctcttatagtggcttgtagttacattgggcacctcctaagataatcccagataacatctcatctcaaagttctcaatttaatttcatctgaaaagtcccttttgtcattgaaggtaacatattcacaggttctgggggttaggaaattgacatctttagacagccattactctgcttacaagacacattggtcttgatttgacttggaacatacaccatgacagcaaggaaggtaatgagagtaaacaaagtgcatttaggtaactctcaaagttgtttcggacaaaactgaatcacataaaaacagaacattctattttgctgcaattttttacctttaatctactaatttatatttgaaataactgtttttagaaatatctttctttgaatgttgcagatgtgaatgagatataatgaaaagaatgaatgcacacttattgatcattgtactaaggtcattgaacaacaaaatctcatcaaatagttaagtattttaaataatataaaacacatggaagctttacccaaggagagacagtgatcttatttaatattctgtgtggctaaatgaaaccttgatgagaaaagggggccttcagatatagtaaaggttgcactgtgtgtgtgtgtgtgtgtgggtgtggtgtgtacgcatgcgtagtaacataacattcagtaagcatgcaccatgttccaggaacttttcttagcactctgtaggtattacttgtttaaccctcaccataacccagtagagcaattcctacaattatccttttacaggtaattacattgaggcacaaagaaatgacctaccccaaatttcaaacctagtaagcaataaagcttggatttaaacccaggtgttctgccttcagaaccaaaaattagaaaagcctaaaagtttcttttatctgttttaaggaaagaactttccagaaggaaagaactagaggaaaggtagaacacattgtggaagttctctatgcagatcaacaaggtatacagacttttactaattttcttcatatgaacccacaaacccagaagcaagcattattatctagatttggagctcttctactttgaaattgatagagttggacatgcacagattaataataataatattttctacatttgctgttgaaacacagataaatgaggaatgatcctagaaaaaactttacagatgcacacacatgcacacacacacacacacacacacagacacagcacagggaccccaaggtcactgtcttattgaactacatagcatgttaaacacaattactaccttttcttgggcaaagtctccatttttccatattatttaaaatgcttatgtatatgatgagattatgttggtcaaacagcataggacaatgttcagtaagtgtttgttcatttttaaaattttatctcattcacgtatggaaggttcaaagaaagatgtttctgagaggagttattaaacatttaaaaagtaaaagtaaaacgaaacaatttatgtttgagaaaaaaatgttgtctatgaaatgcttcccactaaaaccatttgtttcctgttttccctcttatctcaaggatcccatgaccgagacacctcatgccttccagaagctgaaggtgaaagctcactaagattaaacaactgggaaatgttaaatgaaaaagtatcacagctgagacaaagctcctcagcctcagcatgtttgtcagtgtgcccaactgatgtagtttggctctgtgcccccatccaattctcatcttgaattgtaatccttataatctccacatgtcaagggagggacgtggtgggaggtgattggatcatgggggacatttccctcatgctgttctcatgatagtgagtgagttgtcatgagttttgatggtttcatgtgtttgacagttcctccttcacacactctctctcttctgccaccttatgaagaaggtgcctgcttccccttcacattccatcatgattctaagtttcctgagctcccccccagccatgtggaactgtgagccaactgaacttctttcctttataaattacccagtctcaggcatttataatagtgtgtaggctgggcatgggggctcacgcctgtaatcccagcactttgggaggccaaggcgggttgatcacaaggtcaggagattgagaccatcctggctaatatggtaaaaccccgtctctactaagaatacaaaaaaattagccgggcgtggtggcgggcgcctgtagtcccagctactgggaagactgagggaggaaaatggcgtgaacccgggaggcagagcttgcaatgagctgagatcgggccactgcactccagcctgggtgacagagcgagactccacttaaaaaaaaaaatagtgtgtaaacggacgaataaaccatctatcacttttcacacaaactttcctacctgtactttgtatccaaacctttgcctttttaatctcctgaaagaataaggaattgttgtttccaatagagtggcttcttcatacaatttttatgattaaaactgatattctacagttggttattgatagccccatacctttctgtctaaggcaaaggatgaacacatggatgcatatccatatgtaagtgcccaatgagttcaccttgcccattgcctagacagagcccatttatcaagacaggggaattgcaatggagaaagagtaattcacacagagcaggctgtgtgggagatggggagttttatcgttactcaaatcagtctccctgagcatgcacggatcagagtttttaaagataatttggcaggtaggggcttgggaagtggagagtgctgattggtcaggttggagatggaatcacagggggtcgaagttaggttttcttaatgttttctgttcctgggtgcaatagcagaactccttgggccaaattaccggtctaggtggtgtcagctgatccatcaagtgtaaggtctgcaaaatatctcaagcactgatcttaggttttacaatagtgatgttatccccaggagaaatttggggatgttcagactgttggagccagaggctgcaagacccctaaattgtaatttctactcttgtagctaatttgttagtcctgcaaaggcagactggaccccaggcaagaagggggtcttttcgggaaagggctgttatcagttttgttcagaatcaaaccatgaactgaattccttcccaaagttaattcagcctacactcaggaatgaacaaggacagtttaaggattacaagcaagatggagtcggttaggtgtgatctctctcactgtcataatttcctcagttataattttgcaatggcggcttcacatacacaaacatacacacaatgtcaagaaaaaacaatacagaaagaaaagctcacctcaacaggcccaaatttcagtaacataaaactcatattatctaacagaataaatataaaaattcatgtaacatttcttacattatagggcaacatttgaaactggaagatgttttagagactatcttgaccaccccttgaattttcttgttgaggaacttgaagtttagaggggaaaaatgttttcaaaagagtcgggataatgttagcctgtgtcagcactaacatctgactaacaagtcagattgctgacactggcccatgctcacaccttaataataatgacaatttaatgacaatgggactaattactaataaatttgagtattttctatgtgctaggcacttcacatgcattagctcatttatattttccaaatctcttgtgagttagattttattagcatacctactttaaaggtgaaggaactgcagctcagaaagttaaacttcactaaggctgcatgtttagttgatggcaaagctgagtttagaagccaaactgaccgtaaaatctgggttcttaacgactatgcagtatataaacacccttttcatgtataaacatgaaaagatgctaatgcctacacaacacaaccacaaacacatacacacacttacagaaatcactaaaaataggagattcttggctactttttttctaatttttagtaaagtgttattttaatttagttcccttaggacatttttatgaccttttaattcttgtctccttaagcttttaccgacatctaagaaagaataccatttcactggctggaaccactatctttttaattagtacaggtggcaaaccagattacgatgctagttagcaacaacagctacattatctttacattagtgcactttcattgcagtttagctcttttaaaatctcagaattgctgtctcagttaatattttttatctaagcagtcacgacagttatcaaatccatctcactagattaaaactttgcaagttttataattgatacattactataaataggaaaatcaaatgctttaggggtagatcctgaaagacaaaaaaattttctagaaagcacaatttctgatcctgaagaaaaatgtatatcttactgtttttctatatttatgtcttctaagccatgtttgttggaatagaaaggaaactactatgagacagaggctttgtataatcatttcttttcattcttccaacagtgttaccaggtaagtattattacccacatttgccaggtagtttgtgggaaatagaggctcagagagaataagtaagttgccaacttagtaaatggtgaatctagatttgaatccagattttctctgacctaaatgctcatttcactctaacacactacagccaggagagaacccacttcagtatgagtgttacagttcatgtctgttcagagtgcatattagtggctgtagctttcattgaatctgtataaatcccattccccaatatcagtctccaaagaaatatctgaactccagaaatcctaacaagtggtagaggtggggaggaggtgcaggaggtcatgagtagaatgccaaaaagcctttaatctaaggcaatttcacatataagcttcagacaaagctaaaagcatctctaatcttaaaggcacttacaaaaggtcattttaaagttgtcagtttcctgtttgtgaggtcctcagaaataagaattcatcagtggtgaccatgacaacaaaccttcttcccatcaaagcctccccacacctctgctcagcgattagccgagtagaaaggagatacggacttaccatatttctaaagatcagtctttcagactagctttggtttgaaattttaaggactatatgaatttctaattatagactttttaagtaaatcattgttaaggcttaacaggcacaaattactcacatctttatgacaaaggaattccaagtaacaaatcatttttaagtcatcataaagctaagtgtattcaaaattacatttgcttaaggaaaacaatttaattcaagcgaggtattttgacatggagatttttgtcctttggatatgtacatctgtaattacaaatatttaaataagctttcatgaccattatgtccatctcctaaaaccatgaaaaggacactcatgaagggaaacatgtcttgctcacagtagaaagtacaggagaaactgcttgttcctccttgattccagttatttgcctgagccttcttagctatctatatctatgtcctcagcctccacccaccagctcaatttggaatgagatcactgaaaggttcatcttcactttgaagtggagcccataccaactgccatatgagtccccaggcccacgtgtccacatttctcctaagcaccatctttcaactctgggctctttttaatctcttgaagagcaatttaaaaaatacatattagctgttgaaatatatatttgtcataacaattctattttatagatttctcctaagaaaatattcggtgatgactatattcaaagatgtaattacaaggatgctcctctgtgggttatttttaatttccaacaataagtgatggtttaatcattcaaaatgagtttgtttaatcattcaaaatgaggttgtagatgtccatggcataatgtcattgaaaaccacagtttaaaagagtatacttgatcccatctttgtgaacgtacacagctatacacgagcacacacaggcacacacacaacatatcaacaatgtacatcatgggaatatagatgtattccatatttttctttttttcatatgtagtttttattgttttctatgataaattttgtaataaacaatgattcatttttaatgtttttagttctgtataaaagatgaaagaaagagcatagaaacaagaataaaaatgagatgaatgaaacatttcacctcctccaggccattctcaaatgccacctaactgatgccgtctgtttaaaattacaacctccacccttgacaagtctactccttactttatttatctccatagcactttctgccatctattatatcatatattttaattgtttactttggttttgtctgttctcatacaatgtcagctccttgagggcaagaactttgttccagagaagtgactatccctacacatttgatgcgaaagagagagagagagagagaagagagaaagaaggaagaaagaaagaaagaaagaaagaaagaaagaaagaaagaaagaaagaaagaaagaaagaaaaagagagagaaggaaggaaggaaggaaggaaggatctgttgactatgactataaaggaatagctcaggccagtaccaaatatcaagaatgttagactcactaatgatcaaggcttataaaaatgtttagaacaacataaaagaagtaacaaggagagttaaactatattctgagcaagaagatgaaaatgtgatagaccactgattaaaacaatacagggttagatacaaaaaaaataatagttctcccccttactactttgcttttctctactttaaagcatgacagtctgtgaaaaaaggctgaactagtgctgccgtaaggacactgaagtgagaaggatataaaagacctcttagttgctttacgtgagatacagcctaggtgaccctatcaccgcttctaggaggactttcatctgctgtagacacctacaacacgctatgctgtcttggtgtaaaatcacaatttattgtaattaattaccactcagaaggtaaaacctttgagcataagcattatattctattcattgttgatgtctcagtgcctatcctagcacaaagtcctcagtaaatacatgttttattaattacttaactacaaatcagggtactgagaaaacttgtaaattaaattattgatccatgctaacttttttttttttttttttttgagacacagtctcactctgtcgcccaggctggagtgcagtggcacgatctcggctcactgcaagttccacctcccaggttcactccattctcctgcctcagcctccagagcagctgggactacaggagcctgccaccacgcccggctaatttttttgtattttttagtagagacggagtttcaccgtgttagccaggatggtctcaatctcctgaccttgtgatccacccgcctcggcctcccaaagtgctgggattacaggcgtgagccaccgcacccagctatgctaacaaaactttaaaactcacatagaattagacaagtaacaaaagatagagagtagacaattatccgattttacaaaagtagaacaaatatttagcaaatcattcactgatattttattgttgatctcaggccaaattctatactgaataattaaacagagactttgtaagtccttcagaaaataagctgtgatcaataggtactgtcacaggttcactcaggaatatttttgccccatcagccagattttcttcttgactagggttagtagatattttacagaaccatcagaaacttttgatttctgcaaaagcattgaacaacagctcacataatatctatgtttacagtgtcttgtacataacagatgcttgataaaagtagattgggcaagtgcttataaagattattagtggaatcatttccactcaacatttttcatgatgttttttctttcttttattgatccatgcttttcctctactctggggtatttactttttctcaccttccagatctgccaatcttttcttgaaaaagttatcccaggtgtctcatataactctatttaattacaggatttaagaatttatttatataaacgactggaaaacatggaagcttgatttcacctatcaattttgctttgggaagacagacgggtcaagggaaagtgatgaaacaggtgctagaggtcactgatggatctgaattttcttgtattttctctgacgttccttcaggctcaaactttacttgctttcccattgcccttttgctatcctggtatatgcataaaaagaatatcaatgtgatagatgtgttactctaagatgttgagggttgaatgctctatcactatgacatcattctattaaaggagaaggtagtggataattttttatttatatgtggtaactgccatataaaggcattagacaccaaggtgcagtcacacaaacttgaatttacttcctccaactctctgatacatatggatgctctgagtacaggtatgcatgcacacacatacacacatacagctttcacacttacaaaatgatgcagaaaaccctgcatgaattttctttcccttggatatgcatgctcatgtagaaaagcacttgactgggagttaagaggcctgaattcttatcttgtctctaccattagcaaattatataattgtgagtgagtcattttcctccctgaactttagttttctcataaaataaatgaggtttggtagaggaaattaagtgtttacaaagttgttggaagggctgaaggaaaagactcctggccagtgtctcgcaatgtctctaaaacaacacagaactggccccctaaggaaagttctacccctgaggccaccatggctggcctaggtctggagctatccattcaccgagaagcagcctatgaacactgccaagctggcaaatggacacccgaatcagcaatccagagattagcatcaggttaagaaatggccactacacccactaattattggcatctagaagactgaaaaatgaacactaaaatctgctgttcactaaaatcacatccttgctggctagcactgacaatcaggacaacaggcaagaggcttcttcctctatttttcctttaaatcccatgcaagtgcatctcatcagtaaaatttgtgtcacattcagatccttcgttgcatggaaatcttgataatatagtttttagcactttctagcctctgtgatacagatgagaatatagaacagattaagactggatgctaaatgctgaaaaataatgtttagaagtaatatgttctgaaaatagaaaaagctgcttcaggatctagagagttcccatcaatggagatggacaaagcagaaaccagataatctattttcagaaatgttgtaaatgagactgattttgaatagtaatttgcagttcttgttgcatatttcagtcctctgatgctattcccaaagattctttttcagtgggcctgtggtaggtcccaggaatctgtaatgttacaattcccccaagtgattgtgagatatagctgtacttaaagaaccacttgactataatgtcaaacatcatctccagccctgtttatttatgactcctcaattctagatctttaggaccatgcaactgtatgtgccacacacattcctagtacaaggagccaaatgttgtcttcagtcgaacacagattttttaagaaactctagggtataaactggtctattattctgtttattatattatttttaaaaggaatctgtttaccaactattctgcagtaacaaaaaatagctccaaggagattctaactgaaggcatgctttcacatgaagaatttatgactacagtgtcctgaggtaatttattttttcctgtggaggatttccaggccgatacaataagacaagaatgctgaacacctgctatataaaagacattttaaggttttgtttatgaacttagttcatgttgaagatgtctgcagatttatctcctgcacgagtatcaaatccaatgctcttgtatgcttgcccttgaagggttggtaaatgtttggccgaatagaacatcatttataaacaggttttattactggacttacagttggtcagttaccccaaatgattattctatacaatttacatctaaagtccagatttgttacactaggaggaatgtcaggatttatgttgggattgcaggtcttggtacagaagacgtagcttgaaggtccctgttatgtaacagagagatttccattttagcaggaaaacatgcagttgatctgctattaggaactgaggatcttaagggaacccacaaatagaaaatctggctttggtcaatagcatgcttatactttgggaggggtattgagagagataggcctataactgcctttttgcaactatatttactttaattttcttcatcatatatccacccaaggccagttttatattctgagggtaaaatacatttcagattttttaaaaagccatggttcattagtgcttggtgcttgacagtataaggttgtatactctatacacataaaataaaattataagaattaactatacaaatgtatggcagaaaccacatctaactctgcatccggctactgacagttttcttttttgttccagtttctttaggctacagtcatatcctaatgatgactgtcttattgccctatttttttttagaatttttcaaaatatatgaaccaaatgtaatactatgtcatatcaaattttagatcaaaattattaggatgccaagtaaataaaagaggaggaaaagagtttatccaatatggtgagcagagtaatagccctgaaatatgcccataccctaattccaggaacatgtgaatgagtatatctcacatggcaaatgaaatgtgaagatgtgattaagggtatggatgtgcaatggggaattaccctaaattatacagtggtcccaatctcttcacatgagtccttaaaatccataacctttcccagctgccttggttagaaatatactatattggaagtgctcaatctgccattgctagctttgaagataaaggaaaggagccacaatccaagaaacgcaggcctttccctagaaaatgtaaaaggcaaggaaatggattattctttagaaactccaaaaaggacgtcctgccaacatcttgattttagctgacagaggcgtgtgttggatttctgccctacagaactgcatagtaatgcatttgtattgttaagccactaagtttgtagtaacttgtttcaacagccataaaaaactaatagattcaaaaccttttatctccatgattgttcctggtctcatcagagcagcagaggctaataacttcccaataatagtcaataaagtaatttcacattttaaaggaagtttagctatagaggaaggacatagagtttgaagttgaagacaagactcaatgaacaagtagcaatgtgaccttgagaaaaacctcaagttttctgaggcttaatttcatctaagccttgcttaccttgcagaatagttgaacatgtcatatttataaggggatataaaatcctttgtatattataggttaagtatccctaatccaaacatacaaaatctaaaatgttccaaaatccagaacatgttcagcgctgacatgatgtcacaagcagaagattccacacctgacctcatgtgatgaattgccatcagaatgtagccaaaactttgtttcatgcacaaagttacttaaaacactgtataaaattctcttcaggctatgtgtataaggtgtatatgaaatatgaatgaactttgtggttaggcttgggttccattcccaagatatctcattacatatatgtaactattccaaaatctagaagaatctgaaatctaaaatgcttctggttccaatcatttcagacaagggatactcaacctctattctctataaacaatcatattgcccattaattttttctccaacaaaatatgtatttaagttaaagactggccaaatttttaatttaggatcttcaaggtggaaaatatccctccagtgattaggaaagacacaagaagacaataaagattttatcactcacacatcttgggtggggagtgtggtacacagcacacctgaagactacacatacacaggttaagcagaacaggcagggagaaataggaactgtgggccaaagcctttgttgaggctaggccattatccaaacaggggagttttaattggtgggtttaaagcaagtaggcatgagttccaagaggtcacgctgggacagagaggtagtcactatggcataactgcacagctttagggatgtggaagtcagaaggttactcaagtaggtttatctagctgtcccagaaagaagtagtcatcagaaagtgataaggcagatatctggattggccacatagaggaaatgggaagaggtgtagaactgaaaactgtgtgtcaatggtgactgaaccctgcttttggtatggagaagttcaacttatatttaaaatggatgccaggacaacataaaattataaaaacgtattacacaaactgatggcagacattattcattgtctcccaaatgttctttcttcttttctgctcttatagaaaaatcacccaagttttatcttaaaacatggcaatccagccacagactccatcttccagggtcatttgcagccagggattattaagttctaaccaatgggacatgagtggcaactgaagtgtgcaaatcccagatgatggcttcaagaagatgttactttctacttcttcttgtcctgttcccacaggctagagtggctgtagtggcagagtcagccctctctaagggagatcactgggctggggcagggctagcaatgacacctattcatttacttattgtctatagcaaaatcagcattgagttattgggacaaaaatcatatgacctgccaagactaagatatttactcttagccctttacaaataaagtttatttgtacctcccttaggcaactggagatcaagaaaagaaataaaatctgggtctctggacaacctcctggagcagagatattcttccctgctaactacctaccagcttggactttcaagtgagctagagataaactttatacattgtttattcatctattacattgggcattataaaatagaaacattaatagaaacaatgatgatgataacagctagcgcttttatggtgcttattatgttatagggctctcctatgggtatgtaagatttgtacacacacaaatttaattccctgataactctatgaggtaagtactattttttattcccacttggcagatgacaaaactgaggccaagcaattaagtaacttttccaaaggcataccaaataggagatagagccagggtttggaccctagccatttggcacctacatctctgcccttaaccatatattatattgcctcttagtagactacatgttttattttgactctgaacaaattagtcaacactcctcaaattcattttaccaggagacctattagaaacaatagcttaaccccaaaatattgacagatggtgggttcgagttagaaaaataaatagcaatttattttaatatcctttttagtttatatctcatcttcagactttttatcttcagactccaattgcctaaattcaatattttaattaagcatagcaatagtcctagttaaattagggcaatagagaacctatttggaaatgaaaacaaagggaaaataagataaatgttcaaagaaatgaaatgaagcccgagatttcatgagaaaaggcagggtgtgggaaggggagctaatgaatgtataacctaaaatcaagtacttaatatgctatagaaactaggcagaatgcttcacctccatagctacctgcaagacattcttaaagttagaatccaaagttcaggaaaattgagctagttgctcagggtcacagaactagtcaatgaaactcaagtctttgttacctcaagacaagctcctttacactagaatacctcaaagagaacaaacaaaaaccaattacacccctgccccccgccaaaaataagaaccttagtgatttcaggcaagaaaaggtttaagaatgaggtgaattacttacagcttctgtagatgatctggcaggtattgcagaaggctgtgatgcacaggactgcctaaggctaatcaagtgtctatgagagagagaaaaaaaaaattcataaatggtgatgcaagcaaaatcggttaaagttcatagccccataataggtaccaaccagatcacgaaaaagagaagttatatctgtgaagaaattgttaagcattcaagaaattctctccccagttggcataactattttcactcccgaggagaagattagtttctaataagctcttcattattgattcctctgagccttgaagttgccctaaagacggagaatactgataggttgagccctattacagttgggaggttaaatgcaagcactgtggttttctcagtcaactcattaaaaagaaatgacctgtagaattaattcacagtaaaatgttatcccctagttccatattttccagaattagtcagtaaggagagataaacattattatccctcaaaaatgaattggtatcatggactcaaagttggaaaggccttttggaaatcatttattcattttatagatgagaaaccaaattattcaaagacatgggtggcattatgctttccttgttcttaaagtatgacatgagtctctgttgccaagcatatttcaaagcttatcacatgattatataccctctggagttgatcttgtttgagccatggatcattattcagaaatattcagaaggaaagacacgtgtataatacacacaaaagtcatcttctccagaagtgaacagaatggatattcttggtatctgcttggtgtggttaaataacagaaagtggtatagagcaatatggggcaataagtggcaagatataactgtataataaagtataacctcattatgtgtggctttgtagacaataaactagaggttggctttttaatgcagttcaggtcaccagaggagtttggcaggggtatgacatggctgattttaatcatttatcctttcattcattttatatcgtatattagtctgttttcatgctgccgataaagacatacctgagactgggcaatttacaaaagaaagaggcttattgggctcacaactccatatggctggggaggcctcacaatcatggtagaaggcaaggaggaacaagtcacgtcttacatggatggcagcaggcaaagagagagagagagcttgtacaggaaaactcttctttttaaaaccatcagatctcatgagattcatttgctctcacgagaacagtgcaggaaagacccacccccataattaaatcacctcccaccgggttcctcccatgacacatgggaattgtgggagttacaattcaagatgagatttgggtggggacacagccaaagcatgtcatcaagtatagttctaggccctaagaaaacaatagactacctttccagcccacaagaacaacatagtctatttgaggagacagaactataaaatgtaattgcaatacaaagtaacaagagaagagtaagaaagtaacaataaggcctggataggcagaagaaagtcttcagggaaggaatagttaaatatgttattctgcaggcaaagaagactacagtttcaaaatgatttcacatatgaactcacattttattgtcatatgtaaaatgggatatataggtcaacccacaccacttaggaaactggtactcagggaagctgagtgactgtgtgagaccacacctcaacaatggtacaatgttttaatcctgagcacagactgatttatagcagctgcttccagttgtactgagaataattgtaaacatcaccaaaattaagtagtaaataattttgtgatttattaagatatctagtatgatctgaaacagaatgatggctttttttttatatcaaagttatcctgcaggaggctgggtgtggtggctcacacctgtaatccttgcagtttgggaagctgaagcaggcagatcatttgagcccaggaggtggagaccagcctggacaacatggcgaaatgccatctctacaaaaaataaaaaaattagtcaggcgtggtggttcatgcctatagtaccagctacatgggaggatgaggtgggaggatcacctgagcctgggagacagacgttgcagtgagcaaaatttgcaccactgcactccagcctgggcaatagagtgagacttgtcttcaaaaaaaaaaattatcttgggggagaaaattcatgaacaactgtgatggttaatactgagtgtcaacatgattggattgaagaatactaagtattcttctatgaaggtgttgccaaaggagattaacatctgagtcagtgggctggggagagggctgacccacccttaatctgggtgggccccacctaatcagctgccagtgaatatgaagcaggcagaaaaacatgaaaaggttagactggcttagtctcccagcctacatttttctcccatgctggatgcttcctgccttcaaacactggagtcccaagttcttcagctttgggactcagacaggattctttgctcctcagcttgcagacagcctattgtgggaccttgtgaccatatgaggtaacactacttaataaattcccctttatatatatatatttatctatctatcctattagctctgtccctccagagaatcctgactaatacagattttggtaccagaagtggttctagagaaacagaatattaaggatggaattttttagttggttttggggtttctggagctggttgcttagtacaattagacccaaaaatgctaagcactctatttataatagtatggagaacactgatagtccttagtatgaactgtttagagagttagacaaaataaatgcatttgacactcctgatccaccacttgtgagaggcaaggagtttcaagactctatacataatacctttggccatctgtggagaacaaggaacataatgaaactggttggttgctcctaagttcactgggcaaagtgatgaaagaaaacaataaactcagggattctgtctcccagcttcagaagcagatactgagcttcaaatcgtctaagattgccctgagtcaaagtcttatctactggagagaaagagctgaaattgtggagaagcagacacaagctcttatcatgtgagtggctgacttgcaacaaaaagtgcatgcacagccttgccaggtgtctatcattaaagtgaaggcattgcttggattagaatgggaccttggaacttggaatggggttgtgtgaaaggaccctgataaagctggagatactgggcgtgtaaagtctgaatgaaactttcttgccagaagaaagagcttccccatccccagaagtggcagcataccctctcggacccatgctgctatcagcccttccacttttgcctgaggaggtaaaccctgtgctgcctgaggcaacagtgatggcctccactgaggcagttgccaggcaagataatgttgattctcctcaggagccaccccctgtttgcttctagacctataactagactaaagtcccaaggaacccctagaggtgaggttgagagtgtgacccacaaggagatgtgccacactgaaaaagaactgcttgagttttctaatttatatgaacagaaatctggagaacaggcatgggaatggatattaagggtgtgggataatggtggaaggaacatagagttggaccaagctgaatttattgatttgaacctactaagcagggattctgcatttaaagttgcagcccagggagttaaaaaacattctaataatttatttgcttggttagctgaaatatagattaaaacacgacccattgtgagtgcctggaaatgcctgatttcctttggcttaatatagaggaaggaattcaaagccttagagagattgggatgatggagtgtattagtcactttatacctactcatcccagctgcgagagcccagaagatatacccttgatgaatgctttacaaagtagatttatgaggacagcacctgcatttttgaggagctttataattgctcttctctgtatgtcagatctaacagtgggaaccacggtcactcaactacaaaatttaaatacaatgggaataatttgatctcaaggtggcaggggccaagtgacagaacccaaccgtcaaaggcaaggtgggcatagctaccataatggacagcagaggcaaagcagcaatcagaatagtctgacacgtgaagagctctggaattggctaattaatcacagtgttcctagaagtgaaatttattggaagcctactgcatttctacttaatttatataaggaggaaatgtccaggtcaaatggacaaaagaagaatttaaattataaaaacagagaatcacggcccctcaatcaatttccagacaagccagtttacagacccagaaccccttgaatgaaagggaggctgggtcctcttgaggaaggaccccactacactactgacaatttgtgcagtgaatctttctcccatccttccccaagtacacctctggccttccaccagggtagctgtgcattggagaaagggaaatgatcagacatttcagagactactggacactggctctgagctgacgttgattccaggagacccaaaacatcattgtggtcctccagttaaagtaggggttatggaggtcaggtaatttgtagagttttagctcaggtctgacttacagtgagttcagtttgcccttggactcatcctgtggtcatttccccagtgccagaatgcataattggcataaacatatttagcagctgacagaacccccacatgggctccctgactggtagggtgaagggtattatgatgggaaaggccaaatggaagccattagaccttcctctacctagaaaaattgtaaatcaaaaaggcaatattgcattcctggagggattgcagagattagtgccaccataaaggacttgaaagatgcaggagtggtgatgcccaccacatccccattcaaccctcctatttggcctgtgcagaggacaggtggatcttggagaatgacagtggattatcataagctttaccaagtggtgactcaaagtgcagccactgtaccagctgtagtttcactgcttgagcaaattaacacatctcctggtacctggtatgcagctattgacttggcaaatgcctttttctacattcctgtataaaaggcacaccagaagcaatttgccatcagcagtaaagactagtaacatacctttactttcctacctcaggagtatatcaattcaccacaagatatcacactggtccattatattgatgacattatgctgattggatccagtgagcaagaagtagcaaacacactggacttactggtgagaaatttgcatgccagaggatggtaaataaatccgactaaaattctgggaacttctacctcagtaaaatttctagggctagagtggcatggggcatgtcaagatattccttctaaagtgaaggataagttgctgtgtttggcccctcctacaaccaagaaagaggcacaatgcctagtgggcctatttggatttgggaggcaacacattcctcatttgggtgtgttactccagcctatttattgagtgacccaaaaggctgccagttttgagtggagtccagaatagaaggcggctctgcaacagatccaggctgctgtgcaagctgccctgccacttggaccatatgacccagcagatccaatagtgtttgaggtgttagttgcagatagggatgctgtttggagcctttggcaggcccccataggtgaatcacacaggaggcctccaggattttggagcaaggcccttccatcttctgcagataactactctcattttgagagacagctcttggcctgttcctgggctttggtggaaactgaacatttgaccatgggttatcaagtcacaatgcaacctgaactgcctgtcatgaactggtgctttcagacccaagtagccataaagtgggttgtgcacagcagcattccatcatcaaatggaagtagtgtatacatgatcaggctcgagcaggtctggaaggcacacgtaagttacatgaggaagtggctcaaatgcccatggtctccactcctgccaccctgccttctctcccccagcctgcaccaacagtctcatgggggagttccctatcatcagttgacagagcaagagaagagtagggcctggttcacagatggttctgtatgatatgcaggcaccacctgaaagtagagagctgcagcactacagccactttctaggacatccctgaaggagagcaatgaagggaaatcttcccaatgggaacaacttccagcagtgcactttgttgtgcactttgcatggaaggagaaatggccagatgtgagattatacactgattcatgggctgtagccaatgggttggctggatgatcagggacttgaaagaagcatgactggaaaattggtgacaaataaatttggggacgaggtatgtggacggaactctctgagtggtcaaaaaatgtgaaaatcttcatatccaatgtgagtgctcaccaacgggtaacctcagcagaggaggattttaataatcaagtggatagaatgacccatcctgtggacaccactctgcctctttccccagccacccctgtcatcacccaatgggcccatgaacaaagtggccattgtggcggggatggaggttatccatgggctcagcaacatggacttccacttaccaaagctggtctggctatggccactgctaagtgcccatttgccagcagcagagaccaacactgagctcttgatatggcaccattcttcagggtgatcaatcagctacctggtggcgggttaattatattgaacctcttccatcacgaaaagggcagaggtttgtcctcactggaatagacacttactccggatagtggtttgcctatcctgcacgcaatgcttctgcaaagactaccatttgtggactcacagaataccttatgcactgtgatgttattccatacagcattgcctctgaccaaggcactcgctttatggctaaagaagtgcagcagtgggctcgtgctcatggagttcctggtcttatcatgttcctgtcatcctgaagcagctggatcaatagaacagtagaatggccttttgaagtcataattacaaagccaactaggtgacaatactttgcagggctggggcaaagttctccagaaggccacatatgctctgaatcagcatccagtatatctcccatagccaggattcatggatccatgaatcaaggggtagaagtggaagtggcaccagtcaccatcacctctagtgatccgctagcaaaatttttgtttcctgtttccaggacattatgttctgctggcctagaagtcttagttccagagggtggaatgctgccatcaggagacacagcaataattccattaaaatggaagattggcacctggacactctgggctcctcctacctttaagtcaacaggctaagaagggacttacagtgttggctggggtgattgacccagattatcaagatgaaatcagtctactactccacaacggaggtaaggaagagtatgcatggaatacaagagatccattagggcatctcatgtcctgtgattaaggttaatgggaaactgcaacagcccaatccaggcaggactacaaatggcccagacccttcaggaatgaaggtttgtgttactccaccaggaaaaaaaaaccatgacctgctgaggtgcttgctgaaggcaaagggaacacagaatgggaagtagaagaaggtagtcatcaataccagctacgaccatgtgaccagttgcagaaatgaggactgtaattgtaatgagtattttctccttcttttgctaaaaacatgtttgtgcatgtataaccttgcactaaaacaaaatcttcattttatttcctttctcctgtatcatgtgacataagatttatttagttcatatcagcatttaagcattgttaactttatgtattagcatttgggttgtggattggtgtgtttttggttgcaggaagcatagttgtattatgttaggtataattatggccttataattgtctttatttgaagattatgtatgatctcaggagatgtgtatgggttcaaattgacaaggggtagacttgtgatggttaatactgagtgtcaacttgattggattgaaggatactaggtattcttcagtgagggtgttgccaaagaagattaacatttgaatcagtgagctggggaaggcagactcacccttaatctgagtgggcacaatctaatcagctgccagcaaatataaagcaggcagaaaaacatgaaaaggttagactggcttaggctcccagcctatatctttctctcatgctggatgcttcctgccctcaaacattggactccaagttcttcaactttggtactcggactggctcccttgctcctcagcttgcagatggtctattataggaccctgtgatcatgtgaggtaatgctacttaataagctcccatatatatatcctattaattctgtccctctaaagaaccctgactaatacaacaattaactaaatgataaaattatttttctcatagagttgtaaggattaaacaagaaaatagtcttcctatattatgcaacaattctgagaattatggagacctgaagagtcccagccaccctcctaagacaactctaatgtattgcttcttctgtggctggagctggaagttgggtattccttgaagggagtaaacaaggtccaggatccacacataaagagacagcttaactttttcacttctgtgatgcatgacagcctacgccctagtggaagagagccctaagtgtcttagagagaatttgtcctgcaagatctaagggttctggagaagaagtgcagacctagccaacatgaacatccctggaggaatcctgatttttgtggccttcagaggaactggagagataaacagatcgaccaaatcctctatacccataaagctggcagaatgtaagattttacagccactgagaatggaagtagaaagcctattttatgtccttgagtggagactagcagaatacctacaagtagagtccagtatgcagccagcacagagttgcagagattcctgtgcttaggaagcatcatttatatgtttgacagaactgtgttaacctgagcctcagtgagtaacacaaaggaaaataacccagccagagaggagtatagaaataatccagaacaagaaactcctaggaaaacataactgctggaatatggaggtgggatcttgttaaaaaataaaattattaataaatgaaatttaatcacagcacaaataacactttctgaacctacaaaccttgatttttgtcataaaaagtttggtaggtgaactgaacaaataggttcatgacactttcagataataatgacaaatctacatttatcatcccatttatataaaatcttgtgtgtgtgtgtgacagagagagagagagagagatgaacagaaagatactcatcaaaatgttgatggtgctcatctcagaataccctaaaaagggattcatgcttccttcaaatttttgtataccatataaattattctactaacacatataatcagaactgtctatgcaatcattaattctatcttcaatcaaaaaatactccaatgttattgaaattaccagtctatttgtaccccacaggatagaagacatgaaagaataaaaaccgtaagaaagcttggctgctagtgactttatataagaggaaacaactataaaataaatctttttagcagaacaattggatcttataacatgcatggatgggcagctgagcatagaggctgaggtagtgcattgatggaatttccatatcatcctagaccacttgtatcaattctaaaccacagaatactgaacatgaccatgtttccactgattcactcaagtgttgttcacatattttttagccttctcaaaagagaaaccactgtgttttggttcctaactttgctagatataaaaaatatgaatcattgtataaatcattaaaggaattaaactttctttcattttaggaaaggttattaaaatttacaacttctgaatgtgtatcacttattaaatgatggaccataaatgaatgtatccaatcagaaattgacaatgtcctcattaggtactgttcacacagcgatacttgtttatgtcatatctcagaactgagaaactaaactgtagtggtacttaatgaagcactttataagcaatagaaatcaactgaaaaagtggatttccagtaattaccatgactaatactaatgaaaaatgtctctaaatggagacacgacaagggcataaaatttgaatcagattatgcaaaaagtcatactcaggaaacaaacgtggaaagattgcgacttgcgtcaggtcagttgttagcaaagagcccattagtcctcaagctgtatctgccttaaatcaatccccagaaaatacttgaaataaagaagcacacagcaaactgaaacacccacaactggaaagagagatgtcattcatagtaattataagcagatatttctgcaaagtacattcgtgtagaaatgcccttattaacttctatgcagtcaacacatatttatagatctaacacagtattgagacaaagtggattactattcttagtaattaataagactaagtgattattattaataagaatatgggacagagagatttatgtaggttatttttgctattacttatttttgatctagcatgactttgtactttctttttataaaagatccccacatggctgtgagaaacacttttcttgttttttggatggaattgacgttgcttcccacattgatggtcattagccttgggctggccaataaaagcacttcttacagctgaccatagtgattacataactgaaacccagtcagatcatctctatggcttgacacgtggataaagagaaagcatcactcttgttatggagttaaaagctataaatatcatctcaatcttgagtttctggtcactatcattcctgccacagagttaaaaaaggccaagaaaatgaagttgatactgaggaaaagagagtcaatatatgaaagagggagtggaaaagaaagggtagagacgagaggaagcggaggggagtgctgggcaacacttgaaacccagatccagcaatgactttccagctacattagctaaaacagcaaacagcttctttatgaaactgatatagtctgaggttcatttattttatttcaaaatcaaatgatatagtgtgaggtgcaaatagtagcccagaattacatagcagagtttgaacaacagggaaaaaataccaaccacatcagaaaagaagaattcatttgcccacacagaaattatttataggaggcacttgaagtaaatctcattgtactatataaaatatataaatacactgtattttatttatagtagttagatcttattgtttatgtagttatatactatatattatatacataatgtaactgtatagaatgctggataaagctctgtagctcttctcatagattaaatattactataagattagattaaatcaccaattcatttagctaataatgcaaaaacatgtcaaatataggtggcaacacagggaggggacatatgcaggatttataattatgcgtggcctaagccctcctaaggcatccagttgctatctgcattgtcattacaactaggattttccaaaagataagaaattccatttttgctatcccaattccatcttatactctgggcttacctcacttttctgaacggactaacaccaaatgtctacgccttttggtttcagagaattatagcaggctatccttcttcttaaaatctagcatcatcaagccatgcccccctctgaacacagaaattagagtcattctccaaatgtcattgattaatgtctctcctttagatttccagtgttctagaaagcccattttcccccagtccacaccatgactctgatttaatgcccttttcatacagagtttggtccgaaggtgaagatcacaaatcaattcccacaaaaatttaatttaaaatgcaatttccatcattctaagtcaatcttttgtttttgtgttcttaaagtctcaaattaaggaaaaaattacttcagatattcttaatgatggagatctcaaacacacatctaagataatagtttcaattaaatttgtagttcccaaagaagccagattaattttaaaacattccatacaaaatatggtctttaatgcaattcttttcagagtgtgtcatatatcaccactaagtagagctacatacttatacattggtatggaagcaaagaacagaatattaatttaggcatgttggagaaaccgtaagttacctcaatcgtcatcagaatcatcatctttatcatcgttgcaatgtttattgaatgtttacaatcctattttttggtgctattattatgttcacactacagattttaaaataaattgcattctaagcaattatattagaatcagactcttttctgctaccactattgagaaatactggataagacacaactaaaaacaggagagataagattgccaggctgctagaagcactggctgacatgaaaacaactatttaactttaacagcagcacaagaatgggagacaaaaacttggatccccagaaggtcaggagtttaactgaaacttctgcaggtacccaagaccatagaaggagaaatggcaaaaagttgtgtctatcccaggcctctgcttagtttgaaaataaaaaagaggaatctcccaaaaaatttgtaatcacaggctaactgtatcagttaattactatcataataattgcctcaaaatatgtggcttaaaacaacactaattgattctcagagttctggaagtcagaagtccacaatgagtcttatgaggctgaaaccaaagctaagattaggactacattccttccagagtctccaggagataatccgtatcttgcctgtttcagctttcagacaccactcatgacccctttctccatcttcagtcagctgtgaggcatcttctcttctgtcctctcggctttcttatttatttatttttttcttttgtgagatggagtcttgctcttgtcacccaggctggagtgcaatggcgtgatcttggctcactgcaacctctgcctcccaagttcaagcaattctccggcctcagccttccgagtagctgggattacaggcgctggccactatgcccagctaatttttgtatttttagtagaggcagggtttcaccatgttggccaggctggtctcgaactcctgacctcaggagatccacccatctcggcctctcaaattgctggggttacaggcgtgagccaccatgcccagcccctcttggcttttttatacagctttattgaggtataattgatatagagaaaagcacacatatttaatatatacaatttaatgaagttggacatatatgtatagctgtgaaaccatcatcataatcaaggtaataaatatattcagcacctccaaaaatttcctcatgcctctttctggctttatttattgtttgatttttgtggtaacaacacttaacataagacgtacttccctaacaaaaattttaaatgaacaatacagcattgttagctataagcagtatgccatacagtagatctctagaacttatttattgtgcatagttgaagctttatattcactgaacagcaatttctcatttccctctcccctagcccttgaaaattattgttctactctctgtttctatgaatttgacctattttggataccttatataaatgtaattatgcagtatttgttcttactgtgactggattatttaacacagcataatatctttcagattcatccatgttgtggcatatgtcaggatttccttctttttaaaggcagactaatattccattctatgtatgtactacaattttttgctgagcttggtgaaacagaaactagatcaacctacagataaaagaagctctgaaaatccaagcaaaataaatatgaagaatcaccacacctaggtacatcctagtaaaactgctaaaaaccaaatacatacgattgtaaaagaaacctgaataaaaatgacacactatgcttataggagttgcaataagacttacagcaaaatattcaacagaaacaataggagttagaaaataatgaagtggcatctttaaatttctgaaagaaaataattactaatcagaaattctatattgaacaaaatatccttcaaatatttacgttcagaaaaccaaatctgaagtaattcatctttagcagaatcactctaaaacaaataccaaagagagttgttcagggagacagaaaataccccagagggaaacatgaaaatatagaaaactgtaaaaatcaattgaaataataaatttgttcataaacaaatgaatatggcctctacataatgtcttgtgtggtttaaaatagaagtaaaatataaaattaaaatgcatgaaaacaataattcaaaaaaccaaggagataattatgttgtctaataaagtattaaaatatatgaagcaaaatttataaaaccacagagagttacagaaaaatgcaaataaagttataaatttcaacactattctctcaatagttaatatgaagggtagagagaaagccagtaaggacatagaaggtttgagcaacatcatcaaacaacttgactcaattgacatttatagaacactccaccttaaaacagcagaatacatattcttttcaggtatatacagcacatggcacatctaccaagatagatcattggaaagtctgaacaaattttagaagattcaaatcaagtattattatattattattataactcatgggtcaaaaaataaaccaaaaagagactcaggaaatattttgacctgaatgaaaatgaaaatacaaaacatcagtatctgtgagatgcagctaaagtagtgcattgaggaaaatttataacactaaatacccatgattagaaaagaagaatggtctcaaagcattaatctcatattcacctaaataagtgagaaaaaggagagcaagttaaatccaaagaaataaaaattcaagaataataaaaatcagagcagaaatcagtcaaatagaaaacagaaaaataatagaaaaaagtcagtgaaaccaaatgctactccattgcacagatcaacaaagttgataaacctctaggcaaactaatgaaaagagaagacataaaataaaaatgtcagctttgggtgaggtgtcatcactataaataataaggggccattagggaatgttgtgaaataaagtcaataaattacagtttatatgaaattgatacattttttgaaggacataatcaaaaactacaattctttgtaattaggttctttttttcttcctctggtagcagtttctgtatgagaaatgtgggctgttttcttaaaagccgttgctgatctaggaagcggggagatgggaccaggataaggtaaaacaccacaagctatctgttcttaagaagattcaccagtttctcttcattgagtgtttccctggttgctgcaaacttttagttagtttccagagttccaacaaaagttgtttctaacattttttgtcagtttttttccccagtgtttttatggaggaatatacttttgagtcattacttcactatctccgttgatgaaaatttaatttataacaaatctagcaccaccactgatcaaaaacaagacaaggatgcccatctttacctccttttctcagtatcacactagagatctccatcaccaagataagacaagaaaaataaataaaaatacaaggattgaataacaagaaagaaaacttttatttttcactagggcctccaagagaatatacagtcattttatatttattataaattgagttcagcaaagattttgcatatatgaccaatttacaaaatcacttgcatttctgtctacaggaacaaatcactaagaaaaataaataatgtattctagaataataggaattaaattaggtaacttcatcactataattcacagaaatcaatttgtgattaaagacataatgtgtaaacttaaaaattgataaagacatgtaaaggagaacatttttatgtccttgagttagaaagggacttataaatcaagattttttcaaaactgcaaagagaaatattgataaatctatgcagcagattatattttccaaagatggccacaacaatattctttattccacatactctttttgtaatgcaatctcatcactcctcccattaagagatcaaggctatgttctctcttttggcaaatgggttggcttctgtgacttctgactaaagaaacagcagaacgaacattttaaaattttaaggctgggtgaaagataatacagcttccaccttacttgtgaaatactcacactacagcttttacttgccaggtaatcagcacacctcagcactgtcatgctgtgaggaaactcaagcaagccactgcagagacatagtagagaaaaattctgagactaagtaaaaagagagaaatatccagccagcttcccactgttccggtcccagctaccatcccactgcaaccacataaaagaccctgtaccagaaacactcagcagagcccttccctaattcctaacccacagaaaccatgggagataaagtaactgttactgttttaagccacggagttatagggtgctccttacacagccctagaaaccagaacaacttggttctgtgaaaattgaaaaacttccatttctcaaaaataccacaaagaatagaaacatatcccacagattacatgatgatacttgcagccagaccatatgcagttcatgcaaacaacttctccaatcaacagaaaggcaaataaacaaatagaaaataggcaaatgatatgagcagctaattcaggtgaccaataccacaggaatgacagataccacattaaaagttgcctaatttcacaggaaacaggaaaatataaatgaacatataaataaaatacagcatatagggaaatgtaaacgaaaataaaaatgataccattttacctcatcatatcacaaaattttaaagtgcaagaataacaaacattggcagaatgtggagactggggaactttcctgttctgctggtgggtgggtaaattgctgtgatcagtttagagcattaaagttgcagacacatattctatgactcaaaaatttaactcctacatataaatcctagagaatttcacccacctgtactgcaggaaatatgtatgacactattcatagcaatatttttttgcaacaactagaaaaaaaaccccaataatcttaatgttcaacacaagataatcagtaataaatcagagcatatgcataaaaataattgatatataacaaagaaaatgaataaacaataactgtgtatcaacactggtgaatctcacaaatatgttgaacaaaagatatgagctatagaatatacataaagctctttatataaaatttaaaaccatccaaagctgtacaatacattgctctgtgatacatatacatatgtataaagtataaataaatatatgaaagaagcaccaaattcaggataatggttacctctgggtagaagagaggcaaggtgatcaggaacaaatacagaagagaaatctgggttgccgattatttatttttttaaactgagaagtaggtatgtgaatatttgccacatttttctttagacttttgtatgtcttaaaaattaaataagtttgagagcttgaatgacataagcaacacttgacacagaggaagaaaggttagcactaaaaatgacactccaggaacagaagcgcacatacctaggggcttataggcattcacagagacgcagacatagaaggctaccaagacactcacaggtggaggggagactgaaagtcaagagatgaagtgaaggaaatggctgcttgcttggattcttactatggattccctcctaggcggacgtcttctggcaacacttgtaacaaagccagttctctgagtctttggagagtaaactcatgccaaatttcagccccttcctggctcccataatcactaagtgaaagtctcacccagaagattccagaaaaatgaacaactttttctgtgattcctatatagataattcaaaaaagccacaaaccacagaaatactttttatataatctctcacttttctctcatgaaaaacggaaaaaaatgccctgatatctggaaaatggcctgacacttgcaactaggcctcagtgatgtttgaagctggcctgtaactcacagctaaaccattgtattctcctgttgtacataatctcacggaatgccaatatcagatatgctcactctgagtccatgataaactgaagcaaaatttcatagctttgtctaagcacagataagcacaaagttaccaggcatcccacaatatactaaatattacccctcctggctaatacaagcgactgatgcttctttactaaatacagctttatccttgtttaagtctgacagataagattaagatgttcaatcatagaattgttctgcttttttataagattgagatacccaatgtttctactttttgacagcacccaacatagagcaaacttctacttccttagcttttcctacaatcacccaaccaaagcccaaatctcatatcagtttttttctaacagtctcttactgagaaacaacccatggtttcttatgatgtatgctctccctctctatgaataaagcataagtgagtaagaaaccccacttactaaacgacaagtatgttcttggtggtgtttggctggaggatattgacactcgctatgcctatctacaaaggaagccaattacagcagacctgttagtggaattgcacttctcaagtccttcaaatagttgtatggctaccactttgtgatatggaaaagtttatatgaacctgaaatatagaatgctggcccacattataactgtaagtaaaaatttccaatttcactaaattttcttctctttgatcatgaccgtaaatatattactatttcatttgcttttatttttcatctgagcagaatacaaaaacaagttttgggtgagatggggagaatgatgtaacctgtacaacaaactcactcagctgggaagtagcatgcaaactggcattcagacccaacactgtctaaaccatccacacttcatcactatgacattttaaggtaattgtgatgcagaagaagagagaaaggacagtccagatagaaaacagtatgtgtaaaaccacagagaagagacattatctttaggtttacagcatggcaagtgttggagtacagcctaaaagtaagattggtggaggcagatattgagagtaacagtatatgcaagaatagtataggaaggtttggctgggtcacatgtgttaggtgataatgaattcaaaccatattttgtaaccaacagagattttaagctatgggtagaggcaagagtatatgataatcaaaactatgttttcattctattttttaaattgacacatgataattgtaaatattcacagagtacatagtgatattttggtacatataatgtgtaatggtcaaaccagagtaattagcatattcatcacctcaaacatttatcatttctgtgtgttaagaacattcaaaatactcttttctgccttttgaaagtatataataaattattaactatagtcatcctatagtgctgtagaaaactagagctcattcctcttctcctatctggctgtaattttgtatccttcaaccaatctctttctataccctctctccactactttccctgcctcttgcaaccactattcaattcactacttctatttgatcaactttgtttttacttccacatacgagtgaaaatatgtggtgtttgtctgttctgtcttgtttaaattaaaataatgttctccaggctcatcaatgttgccacaaatgacagggtttcatttttatagctgaatagtattccattatgtatatataccactttttatttatccattcatttgctgatggacactttgattggtttcatattttggctattgtgaatggtgctgctacagacataggggtgcagatgtctcaacaatatactgatttcctttcctttggatatatatccagcagtaggactgctgtatcatatggttctacttgtagttttttgaggaacttccatactcttttccataataactatattaatttacattccaaccaacagtgtataggaatttccttgtctctgcatccttaccagcatttattaatttttgtctttttgaaaatagccattttgagtagagataataattcattgtggttttgatttgcatttccctgataattgtaatcttgagcattttgtcatatatttcttggccatttctatgtcttcttttgagatatgtctacacagatcgtttgcccattttttaatcagattttttgttttattttgctattgacttgagttctctgaatgttctggatattaatcccttttcaggtaattttcaaataatttctcccattgcatagattgtcttttcactcttttaattgtttcctttgctgtgcagaagctttttagtttgaaataattccatttgtctatttttgcttgttttccctttactattgaagtcttagccataaaatcctttcccagaccagtgttctgaagcttttttcctatgttttttgtagtagttttattattttggatcttacagataagtgtttaatctattttcagttaatttttttataagatgagagataggggcctagtttcaatcttctgaatatacagtttttcccagcaccacttactgaagagactgtcctttaccaaataaatattcttggaaactttgtcaaaaatcacttggttataaatatgtgcatttatttctaagctctctattctgttccaatggcatatgtgtctatttttctgccaataccacactgttccagtaacgatagctttgcagtattttgtgaagtcaggtagtgtgatgcctccggctttgttttttgctgaggatttctgtggctatttggcttttttgtggttctatacacattttaggattgttttttctatttctgtgaggaatatcattggtattttgacaaggattgcattaactctgtagatctcttccactaatatggtcatttaaaaaatataacttctttcagttcttgaacaggggatatctatctgtttgtcctttttaatttctttcatcagtgttttacactttttcttgtagagatttgtcatctccttggttaaagttatctgtacatattttatttttcatacctattgtaaataaaattgctttcctgattttttccagttacttcattgttggtgtatagaattgctgctaatgtatgtgttttgattttgtatcctacaactttattgcattttttaaatcagttttaggacttttttggtggattctttagttttttatgtataagatcatgtcatctacacatacggacaatttaaccttctccatttcaatttggatgcactttatttcttttcttgcctaactgctctgggctagatctttcagttctacatcaaacagaagtgttgagagcaggcatccttgttgtgtttcagatcatgaaggaaaagtttccagctttgccccagtccataaaatgttagctgtgggttttttatatatggccttcactgtattaaggtatattcctgctatacctaatttgacaagaatttttaacacaaagtgtagttgaattttatcagatgctttttctgcatctacgagaggattatatgggttttgtccttcattctgatgatgtgatgtatcatgtttattgatttatgtatgttaaaccatccttgcaactccaggataaattacacttgactataatgtataatatttttgatgtgctgttggattcaatttgctagaattttgttgaggatattttaatctatgttcattggatattgggctgaagttttcttttttgttgtgtattatctggttttggtatcaggattatgcaggccctgtaaaatgagtttagaataaatctttttctctcaatattttggaatattttgagaattaggtcttccttaaaagattgacagaattcaacagtaaagccatctagtcctggaattttctttgttcagagactttttattactgattcaagcttgttactcattactgattatggttttctatttttatttggctcaattatggtaggctatgtattcagggacgtatccattttagttaggccttcaaatttgttggaaaatagttgttcatagtagtctctaatgatcctttgtatttctgcggtaccaattatgatgtctctttttccttctcattttatttatttgagtcttctctcttttttcattaatagtctagctaatgatttgtcaattttgtttatcttttcaaaaaaccaacttttttgtttcattaatcttttatattgtcttttagactaattttatttctgttctgatctttcttatttcttttcttctactaatattgagtctgatgtgttcctttgtagttccttaagctaaattgttagattatttgaaatctttttacttttttgatgtaggcatttattgccataaacttgtgtcttgatactgtttttgatgtattccgtaggttttgatatgttgtgcttctattttcatttccttcaagacttttaaattttcattttaaatttttcattgacccattgataattcgggagcacgttgtttaatatccatgtatggttttaactcttcttgttgatttctggttttattccattgtggtcagaaaagatacttgatataatttcaatttttaaaaaattctgaaacttattttgtatcctaccatatggtcaatcttggagaatgttccatgtgatgatgaaaagaatgtgcattctgcagctgttgagtgagatgttccttaaatgtctgttaggtccatttggtctatggggcagttttgagccaatttttttttattttattttctgtctagatgagctgtccaatggtaagagtggggtgatgccctcacttattattgtgttggaggttgtctctccctttatatcttacaacatttgtcttacatgcctgagtgttctggcattgggtacatatatgaatctagttctaatatcctcttgctgatttgacccatttattactatataatgtcgttctttgtttctttttggagttttttttaaacttaaagtctattttagctaagtatagctactcctacctgtttgtggtatctatttgcacggaatagctttgtccttcccttcactttcagtctatgaaaactgtttctttacaaataaagtgagtttcttgtaagcaccatatagttgggtcttgtttgtgttgctgtttttttgctttttaatccattccatcagtctgtgctttttacagaaaatttaattgatttacattaatatttactattggtaggtgaggacttactcctgccattttattaatgttttagctgttttgtgtattctttgttcctttcttcctctcttgtttatcactgtggtttagtggtcttctgtagtaataacattttattcatatttctttctcctttgtgtaactgttgtaccaatgaattttatatgtttgtgtgtttcatgttagtagttaccaccttttctctttcagatgtagtacttccttaaccatttcttttaaggttcatctagtgactgatgaaccccttattttttgctaatctgagaaagactttatttctgcttaatttctcaaggacagttttgtgagtaaaaagctggcattctttttttctttcagcatttgaatgtgacgtcctattctctcaggaactgttacatttgttctgagaaatcacttttagtctagagggactatcttatatgtgagttgacacttttctctttttttcaactttcattttagattcaagtggtgcatgtgcaggtttgtcacaagggtatattgtaacttgctgaggtttagggtatgattgaacctgtaacacaggtactgaatacagtacccaagaggtagtttttcaaccttttccgctttccttcccagtcttgtagtccccagtatctattgtttctttctttgcgtccctgtttgcccagtgtttagctcccacttataagtgagaacatacaaatattcagttttctatttctgcattaatttgcttaggataatggcctccagctgcatccatgttgctgcaaaggaattgattttattcatttttatagctgtgtagtattccattgtatatatgtatcatatttttttccaatacaccttaatgggcatccaggttgattatatgtttttgctatgtgaataatgctgtgacaaaaatatgagtgcatgtctttttggtggaacaatttattttcctttggatatgtacccaggaatgggactgctgggtcaaatggtagttctgtttttagttctttgagaaatctccatactgctttccacagtggctgaattaatttacattcccatccacagtatataaacactcctttctcttcacagcttcaccagcatctatagttttttttttactttctaataatagccatgctgactggcatgcgatggtatctcattgttgtgttgaattgcatttctctgatgattgatgatgtggagtaatttttatatgtttcttggccacttacatgttttcctttgagaagtgtctgttgatgtcttttgcctattttaatgggggttttgtatttttcttgttggatattagactattgttagatgcatagtttctgaatactttctctcatccactaggttgcctatatattctgttgatagtttcttttgctgtgcagaagctccttagtttaattacatcccacatgccaacttttgtttcatcgcaattacttttgaggacttagtcataaattgtttcccaagactggtgtccagaatggtttttcttacattttcttttagaattattatagtttaggtgttatatttaaatatttatccatgctgagttaatttttgtatatagtgaaaggtaggggtcctgtttcattcttctgcctatggctagccagctatcccaccaccatttattgaatagggagtcccttcctcattgtttatttttgttgactttgttgagtatcacatggctgcaggtgtgaagctttatttctaaattctctattctgtttcattggtctatgtgtctgtttttgtaccagtaccatgctctttttgttactgtagctttgtaatagtttgaagttgggtaatgtgatgacccagctttgttctttttgcttaggcttgtttcagccattgggctcttttttagttccatatatatttttagaatagatttttttctaaatctgtataatgttcgtagtttgataggaatagcattgaatctgtaaattgctttcagcagtatggtgatttaaatgatattgattcttccagtacatgaatatggaatattttttcatttgtttgtgtcatttatgatttcttttagcagttctgtagttcttcttctagagatctttcacctccttagttagaagtattcctagatattttattttttcatgactatcgttaatgggattgcattcttgattttgctctcagcttgaatgttatttgtatatagaacagttactggtttttgtatgttgatttgatatcataaaattttactcatcttgtttttcagttcttggagcggcattttggtagagtctttagtgttttctaggtgtagaatcatatcatcagctaagagaaataatttgacctcctcttttcctattaggatgcctttaactttttctcttgcctggttgctctggctagcacttccagtactatgatgaataggaatggtgagagtggtcatccttgtcttcttccagttcttaaaaggaaagattccaggttttgcttattcagtgtgacattgactgtgagtttgtgataggtggtttttattatttggaagtatgttccttcaatatctagtttgttgaaggtttttatcatgaagagatactggattttactaaattttttttctgtgtctgttgaaataatcgtttcattttgtttttaattctgtttatgtgatgaatcacatttgttgatatgcatatgttgaatcaaacttgcacttcagaaaggaagcctacctgatcatggcgaattaaatttttgatgtgctgttttattcaatttgctagtattttgttgagaatttttgcatctatgttcatcagggatattgtcctgtagtgtgtttttggtttcgtttttttcatgttttcttctccaggttttggtattagggtgatactggctttgaaaaaatgagttaaggaagagtcctttctctttgattgtttgaaagtcccagtagaattagtaccagctcttctctgtaaatctggtagtcttcaactatgaattcatctggtccaggtcttcccccacccccacccctaccccaccccccgttggtagttttttggttaccggctcaatttcagaacttgatatttgtgtgttcagggtttcaatttccttctgattcagttttgggaagtcttatgtttccaggaatttatccatttcctctagattttctagtttgtgtacaaaaaggttttcataatatctctgaggatgtttcgtatttctatgggatcagtggtaatgacacctttgtcatttctgattgtgcttatttggatcttctctggttttttccttgttaatctagctagagttctgtcatatttatcctttcaaataaacaagttttgggattttttaattttttgtatgtatttttgggtctcaatttcattcagttacgctttgatttcatttatgtcttttcttcttgtactttgggggcttgtttgttcttgtattcttagctcctcttggtgtgtgttgttagatcattgatttgagatttttctaactctttgaggctggtgttcaggatgataaactttcctctcaacattgcttttgctgcatctcagagattttggtatgttgtgtctcagtttttatttatttcaaagaacatttttatttatgctttaattttactgtttacccaaaagtcattcaagagcaagtagtttaatttccatataattctgtgtgttttagatatccttttggtattgatttctatttttttattccattgggtctgaatgcataattggtacaattttactttttttaattttttgagcttcatagttgagcatgtggtcaatcttggagtatgttctgtgtgcagatgataaaaatgtatattctgtggtcaatgggtcaagtattctgtaggtatctattagatccaattggttaagcgttgaatttatgtccagaatttctttgttagctttctgcctccatgattggtctaatgctatccatggggtgttgaagtctcccactattattgtgttgctaagtgtctcatatgtctagaagtacttgtttatgaatctgggtgtgccagtgttgtgtgcatatacatttaggaatgttaactcttctttctgaattgaacgctttatcgttatgtaatgcccttctttgtccttttttaatgttgttagtttaaactctgttttatctgatataataatagtgacccctgctgttttttcattttccatttgtgtggcatatctttttccaaccatttactttgagcatatgggcattatcacatgtgagacgggtttcttgaagacagcagatggataacgcttgttattttatccaacctgacactgtctaatttaagtggggtgtttagactatttacattcaaggttaatattgatatgtgaggttttcatcctattgtgaagttgttaggtggttgcctattccgtgtttctcacagagttgatctttatggacctcacagattcccgtttgctcacagagttcatcttaatgcagcatcttgttatttcccagtgactgaggcacactaaaagcctctaatctgccatctcatttccattttctgtatgtcacttttctttttctgtttataaatcgtccaccacatggctgtgcttgagcctctctgagcctactctggcttgggaggctgcccaattcataaatcattctttgctcaattaagctctgttaaattttatttgtccaaggtttgttcttttaacacacgaaagcttttctttctctgagacccctggtggcaattggataaagaatggctactacatactgagtgacatttttctcttgtgggttttaggattctctgtctttgacttttgacaatttgactataatgtgctttagagaggacccttttgcatggaatctatttgagaatctctatactttttggaactggtaaccatactattgcaagacttgggaagttagcaactattatttaattaaataggtttttttacactttttcccatctccatgttctcttcttgaaatctcatatggtgccccatgagtcttgtaggctttcttcattctttcttttcacttggattattgcaaaagatctgtctttaagttaataaatgttttcttctgcttgttcttgtctgttgttgaactcgattgtatttttatttcattcactgaattcttcagcatcaagatttatgtgggtttttttacaatatttatctctttgtttaatttctttcagatcatgaattgttttcctgattttgttgtattgcttacctgtattctttgtatcttactgagtttgcttaagaaaattattttgaatttttttctgttattttgcatatttccttctctctgggatctgttactgaagaattattatgttcctttgaagttgtcatgtttccttggtttttcatgtttcttttgcccctatattgatatctgtacagctggtagaacagtcatctatctcaattttatggagtagctttcacagagaaagacttattcccatagatgagttctatgatgtcatttggttgggttatgttggctttggctgtaggtggacacaggcttccatgaagtttcttcagctgtaatccatgttagcaatgtctgtgagtgccttggtggcctacactatgggagtttggcagtggtggtgtggctttgctaggggtgagtttgccaaactatctctcaggcctggagtttacacatgcatgcagtgggttgaccagtttgggacctggcttggcagagttagggccactgggctttttcataggccaggggcatgggagcatgagatgggttggcctttggggaactgttttgccaggatcagggcctctgggctgtttcatcaacgaggggtacatgtcacagtggcttgtttggttcaaggaaggatccacctgaggcaggtcaaccaggctggttctctggctgcttggctggcttgggagtaggtcttctggaggttggcctactgaattgtttctccagctgagggcatggacatacggctacttggctggctcaggggcttgtccactggaagcagatcttgagggctggttctctggccaaaggaagaggtcttgcggctgctcagctggcttaggggcatgttccccagactgtttctcctgacagaggggtgggtgtggggctgctcagtgggctttggagcatatctgctgaaggaaaatccaccagatcctaaggaaagcagctagacctgcaaggccacgtttttaaataactgtgagcagagtcaaaaatggattaaatataggacagactcaatagcctacagaaagcccattttatgaaatatgtcaggaagttactcttgcatctaagaaattattctatatttgtctcatcacatccaggtgaaacagctttgttattatcttaacacccatgggttttgaacagccatagtaagcttttcatagctcatagggagtatttgtgcagctcagttaaattatgacttctaattaggatttaattaaaatagaaagcagcttgtttagaacatggcttcgtatgtcgagttacaaagcttcatctgcatctttgttaaagatttttaaaatcctctgtatgctgaattaaggaagaatgattctgaatacattctgtaaaacctatgggctccataaataaccattaggaaatattagacagaaatatgatagaatccctgaatttgtatttatgcttcctttcctaagccctatttaaagatgacacccaaaagaccaaagtgatacataatagatttaatccacgatcctcgactttgatcaaacagtagtgactaaactgaatggggttttgagaagacatgtcagagttcagcaggaaagagtacatagaaaaattttgataaattaaatacagg

(The sequence listing continues in the following parts.)

What is claimed is:

1. A method of hybridizing a nucleic acid probe or synthesizing a nucleic acid product from a sample from a human subject with parkinsonism, the method comprising:

(a) hybridizing a nucleic acid probe to a polynucleic acid from the sample by nucleic acid hybridization or microarray analysis, or synthesizing a nucleic acid product from a polynucleic acid from the sample by PCR or sequencing; and (b) detecting a genetic variation from the human subject by the nucleic acid hybridization, microarray analysis, PCR or sequencing, wherein the genetic variation is a copy number variation (CNV) comprising a deletion of SEQ ID NO.: 18 or the complement thereof, a CNV comprising a deletion of SEQ ID NO.: 19 or the complement thereof, or a CNV that is a deletion of SEQ ID NO.: 18 having the 3' terminal 12,860 nucleotides of SEQ ID NO.:18 or the complement thereof, wherein the genetic variation is in a UNC13C gene (gene number 258).

2. The method of claim 1, wherein the genetic variation disrupts or modulates a RNA transcript with a sequence of SEQ ID NO.: 206, or a protein product encoded by the RNA transcript.

3. The method of claim 1, wherein the genetic variation comprises a CNV comprising a deletion of SEQ ID NO: 19 or the complement thereof.

4. The method of claim 1, wherein the genetic variation comprises a CNV that is a deletion the 3' terminal 12, 860 nucleotides of SEQ ID NO.: 18 or the complement thereof.

5. The method of claim 1, wherein the genetic variation results in a loss of function of the UNC13C gene.

6. The method of claim 1, wherein a whole genome or exome of the human subject is analyzed.

7. The method of claim 1, wherein the sample is blood, saliva, urine, serum, tears, skin, tissue or hair from the human subject.

8. The method of claim 1, wherein the detecting comprises purifying or amplifying polynucleotides from the polynucleic acid; and performing a microarray analysis of the purified or amplified polynucleotides.

9. The method of claim 1, wherein the microarray analysis is an array Comparative Genomic Hybridization (CGH) analysis.

10. The method of claim 1, wherein the sequencing is high-throughput sequencing.

11. The method of claim 1, wherein the detecting comprises detecting a first genetic variation that is the CNV comprising a deletion of SEQ ID NO: 18 or the complement thereof, the CNV comprising a deletion of SEQ ID NO: 19 or the complement thereof, or the CNV that is a deletion of the 3' terminal 12, 860 nucleotides of SEQ ID NO.: 18 or the complement thereof, wherein the first genetic variation and a second genetic variation are in a panel comprising two or more genetic variations.

12. The method of claim 11, wherein the detecting comprises detecting at least two of the two or more genetic variations.

13. The method of claim 12, wherein the two or more genetic variations of the panel comprise 10 or more genetic variations.

14. The method of claim 1, wherein the parkinsonism is Parkinson's Disease (PD).

15. A method comprising administering a therapeutic agent that treats or slows the progression of one or more symptoms of parkinsonism to a human subject with parkinsonism, wherein the human subject comprises a genetic variation, wherein the genetic variation is a copy number variation (CNV) comprising a deletion of SEQ ID NO.: 18, a CNV comprising a deletion of SEQ ID NO.: 19 or the complement thereof, or a CNV that is a deletion of the 3' terminal 12,860 nucleotides of SEQ ID NO.: 18 or the complement thereof, wherein the genetic variation is in a UNC13C gene (gene number 258), and wherein a sample from the human subject has been assayed to detect the presence of the genetic variation.

16. The method of claim 1, wherein the genetic variation comprises a CNV comprising a deletion of SEQ ID NO.: 18 or the complement thereof.

17. The method of claim 11, wherein the second genetic variation is intergenic.

* * * * *